United States Patent 7,868,149 (PLANT GENOME SEQUENCE AND USES THEREOF) - sequence listing, part 30

SEQ ID NO: 14926 - DNA, 332 bp, Oryza sativa
caactccgatccataagagaccttatcgaatggcagccaatgagttggcagaagttaagaggcaagtagatgatttgctacagaaaggatacatcagaccgagttcatcaccatggggagctccggttatttttgtggaaaagaaagatcatactcagagaatgtgtgtggactatcgtgcactaaacgatgtgactatcaagaataagtatccactacccaggattgatgatttggttgatcagcttaaaggtgccactgttttctccaagatagatcttcgatcagggtatcatcagttgagaatcaaagaggaagatatacctaagaca

SEQ ID NO: 14927 - DNA, 711 bp, Oryza sativa
ggcgatcaccagtaaggcaccgcaggtacatgatgatgacacggttggatgcctccgactggtcgtcggactgagggtggaaggccgtcgtcatgtggagcttcgtacccaccagacgcatcagctcgctccagaacgcggacgtgaagaccgggtcgcgatccgacaccatggattgtggaacgccatggagacggacgatctcggcgaagaagacttgagcgacggattccgccgagtatgggtgcgccaaaaggatgaagtggcagtacttgctgaatctgtccaccacagtcagtatgacggacttgccgcgaacacggggcagcgcttcgacaaagtccagtgcgacgtcagtccacactccttgtggcaccggcagtggaaggagaagacccgcaggctggaggtgctcggccttgtagcgctgacagacctcgcaggtccgcacaaaaatcctgcacaacgctcttcatgttaggaaagtggaaatcccggcggagtcggtggagagtgcgcttgacgccttcatgtccctcctcatggacagcgcgcaggacctccttgagcaagggcgacgctgggggcaagtacaggcgggcagcgaacaggaccatgccgtcgggcatgggaccacgggcctgcgcgtgtgccggacggatcttcgctgtagcgccaccagcgccgggtcgacgttctgtgctttgcgaa

SEQ ID NO: 14928 - DNA, 216 bp, Oryza sativa
cagatccaagcaaaagaaaccgcaggcgaggaccaaatcgcgctatcacagatcgccgcatcaaatcaaacgcgcgagggaggcagattatggaacgggaggcggagagggggcgtaccgttccgaggggcgaggcgaggtctcgccggcgggcggctcggagaagcagcgacgccgccatggccggacggggaggggaggggaggggagggaggc

SEQ ID NO: 14929 - DNA, 461 bp, Oryza sativa
ttgatctcttgaatatcaggatcattaatttgggcttctctaacttgatcaattagagtgggcttcgcttctaaggctgcaactgacggagctcgtggctcctcaccgggagaccgcacaggccccccctttgccggttcggccgggggcttagggtgagatctcaagctctcgctgtatgtggaaagatcgcgtgccaggaagaaacgcgagacacggacgatgtatacaggttcgggccgctgggaagcgtaataccctactcctgtgttttggtggatttgtgtgtggaggagctacaaagtgtgagccgatctatcccttgctctaggctctaaatctggaaaaaatccatcctcctctccctatgggcaaggtcctccttttatactttaaggggataccacatgcactcttccctttcaaactggacttttcttctttacataaatggacggaga

SEQ ID NO: 14930 - DNA, 774 bp, Oryza sativa
gagtgttttgttcccattatgtatgggtgtcgaaatgtaaactttgctttatatacagtggaaaatgtaccttaaaaacttctccgaaacctccttctcccagcttattttctgccgagaagttccttgttgcagctctcaacactgttaagttaagggtcggtgggtcaacatagtcattgtcctcctcattgccggtgttgtctgacaaaaaaaaaatgtaacgcatgagtgcgaggggacgtagctagctgaggccaaagactgatatttattgcacttccacaatctaattgatttgaaatttctagggagatgcaaaaagttttatttcaattgagagtttcagagcatttttttttaaaaaaaattgaaatcgaaaggcttttcatagaaagtttcattttattagttgaaagtttcatcttctgtgttaaaagtttatctcggtgtcttagctatttcaatcatttgggttacgaaacgaagaaagggaattgggggcacgcaagattacattgtgaatcatttgcaatcacatattttgtcgcatcagaacttaatattgagcctccgatgtattactttatatgagttgtcttggcaataaatcgtacattgcaccgtgctatctggacactttcgtatactgaaattcagaagttacatgcacgctgtgtaatgggtatatttttattcctctggaaggatttcattttataaatccactcttacaataaagttgtagcacactaatttctaaaacttaacatg

SEQ ID NO: 14931 - DNA, 565 bp, Oryza sativa
ttttctttcttctttctgcctttgccttctttttcctcaaccgttgattctttcatggaaatcacggcttgtgcggcgaggaaaacatggccggcgggtctcagtcgtggtcgacgacggggtcgtgcggcagcgaggccttgcagcggcagctcggctcggcaggacgtcgtggcgtgcggcggcggtgggacgtcccggcgtgcggcggcgagttcagcgcgcggcagccaggtcagcagcaggcggcgtggctagggatggcaattttccccgcggggccgggtcccctgcggggacccgcccctacgggggcgggggcgggggcgatttcagacccgcgagtgagtcggggtcggggccccgcatttgggcggggaggggacgggggagacgtttcacccgcgggtgacccgcggagccccgaggatgtatattagacttaatcatagtatgttgtaagcccaaaaggcccatctggcctatcatatatatacatccaaaccctaatttccccacccctccactgctccacaccctatccccaatctctcacccaggcagc

SEQ ID NO: 14932 - DNA, 14562 bp, Oryza sativa
acaccgatctttgaacgaagctcctgaaacctggttctgcccagagatttggtgaatatatcaccgagctgctccgcagttcccacgaacatcatttcgatcagtttcttttctgcacactcccggatataatgatatttgacatcgatatgcttactccggtcatgatgcactggattttttatcaatgatattgtggactggttgtccaccttcagcagcggtgcggtgatctcgtcgcccagcacctccgctaacagccgcgcgagccatactccttgacatgttgcggcggctgcggcgatgtactcggcctcacaggaagacaatgccaccaccttctgcttggaggactgccaagtgacaggcccgccattgatgaagaaaatctggccggacgtgctctttcgctcatctggatcgccagccagatcactgtcagagtaaccaaccagcattggcaaagcgcaccgtgcacctgggccaaatcgaattccccagcagcgagtgcctgccacatagcgcagtatgcgccgaacggcagcgagatgatcttccctgggtgactccatgaagcgactgacatacccaacagagaatgccaggtcgggtcgcgtgttgacgagatagcgcagactcccaaccaagctgcgatacagtgtagcatccacaagcggaaaatctgaaccctttctcaatttcaaacgtacctccataggagtctgacagggattgcagtccttgagtcctgccttctcaagaatcttgccggcatatgcggcttgccccagcgtgatcccatcactgtcctgggtaacctcgatgccgaggtagtatctgagtgcccccaaatcactcatcttgaagagcttcatcatctctcccttgaagctgcggatctcgtcgtcgtgatcgccggtgatgatgaggtcatcgacgtagacgcccaccatcagtcgtcttcctcccctggtgcgtgtgtacacaccatgctcggagctgctgcggtgaaagccgagtgacagcaaggagctatcaagtttggcattccacgcgcgaggcgcctggcgcaagccgtaaagagctttgtgtaggcgatacaccttgttcttgtggttgtcgtcgacaaaacccggcggctgcgagacataaacttcctcgagcagctcgccgttgaggaatgccgacttgacgtccatgtggtggacttgccacccttggtgcgcggcgacggcgagaaggaggcgcaccgattccagccgggcgacaagtgcgaagacctcgtcgaagtccaccccctgtcgctggacgtaccccttagcgacgaggcgcgccttgtagcgcacgatcgccccctgttcgtcacgtttcagcttgtagacccattttagcccaattgcacggtggccatggggtaggtcagtgagcgaccaagtgtcgttgtcgacgatcgcgttaagctcgtcttgcatggcgccacgccagcttggatccgcctcagcctcagccagtgaagcaggttcgtcggcgctcacaacatggagctcgagctgttccagcacccgcggagcgtgtccgggcggtgaggcattccccagcaggttatccaccaggcggtagcgaggcacgacgtcgtcatctgcgtcggcgtccaggatggaatcttgggtaggcggcgtgacaaactcaaccgcctccggcgacggaggcgacggaggtgccggtgtcgtgggggccgacggagccggcgatggtggcgagggtggagtcggcgacgaagcaggtgccgtcccgatggtggtcgtcaccacctgttcgacggtgaacggctcgagctggggagcaccatcaggcgtcactggtccccagtcccaggcgatgtcttcatcaaacaccacgtccctagacacatggacgcgctcgctgactggatcatagagccggtaggccttcgagccttgctcgtagccgaggagcaccattggcgcactccggtcatcgagtttcttcagcccgggcttggtgatcttgacgtgccccacgcacccgaaagtgcgcaggaaatgcacagcgggccattggccataccatgcttcatagggcgtctggttgtccaagcttttcgtcggcgaacgattcaagagaaagaccgctgtggacatggcctctccccagaaccgcccaggaacacccttcgccttcatcatgctgcgggcagtggcgacgatggtttggtttcgacgctccactactccgttctgctgcggggagtagggcgccgtcaactgccgaccaactccgagattggcgcagtattccccaaattcgattgaggtgaattcgcttccacgatccatgcgcagtgcacggagtttgcgcccggactccacctctgcacgggcctgaaagtgcttgatggcgttcgcggcctcatccttgctcctaatcatggttagccacatatagcggctcatgtcatcgacaagcaacaaaaaataccgattaccagccggcgttgcaggttcgatcggcccacagagatcgccgtggacgagctccagatgttcgtcagcgcggtacttggactgcgtcgggaacgccgctcgccgctgcttcccgagcaaacagccatcgcagacttgagtgacttgttgtagcagcggcagcccacgaaccatttcctgttgcgcgagcttgcggagagcaggaaagttgaggtggccgtacctggcgtgccaccgccacgccggctcggcgctccttgccgcgaggcagaccggacggtcgatgtccagcttgatggtgtagaggcagtcgtcggagcgtcggacacggacgagtaggtgccctcgaggatcccacacgtgcaggatgccgtgatgaatcagtaccttgctgccggaacgatccagctgtccaaggctgacgatgttcgccgtgagccgcgggatgtagtagaccccggcgatgccgcggtgttccccgaacctgcaggagaacaggacggtgacgcggccctcgatgcgaaccaccgagccgtcgccaaacctgacagtgccggtgaccgccgtgtcgagctcggcgaaagcggagcgggacccggtcatatggttggttgcgccagtatccaggatccacatcgccggatcatgttcgccaccgtcgtctagctgcgcgaagaccttggcctcgaccacggcaagttcgccaatcggcgacggcgccctcggcgcgctcggtggcgagacgacgtttgtcggtgcagcgacgcgaggacgcggcggatccagctgcaccttggccaggagcagagcaggctcttcgtcctcctcctgggctacgtaagcttgctgggccttgggcttgctgcgacagtctttggcccaatgtcccctcttgccgcaattcttgcaatttcccgggttacggcctcccgggttggctggcttgggctgggcctccttcggggctccatcgtccttcttcccacgccctcgaccccggcggtcgccgttgccgctggaggagtgagcggcgtcttgcagagaggccgccttgcggaatttcgccagccattcttcctcggtgaagaggagacggccattggcgtcgacccgactcgatgccgccgcagtcttgcactgcttgcgttgctcgacggagcgcagacgcccagtaacctcctcgagagacagctcattgacgtcgagcaaggtctcaatcgagatggctatttgctggagatgttctgggacaacctgcaacaatttctgaacgacctcagcttcagtgatattatcacctaaggtgcgaaggttgttggcgaggccgccgatccgcatcgagaagtcgtcgacggtttcatcgtccttgaagaggatatcaccgaattctcggcgcagctgctgtgcattcgcctcacgcacgcgctgcacaccgatacggcgagtcttgatcgcttcccacgcctcctgcgccgtctccttgacagcgagcgtggcgagcatctcggcgggcacggcgcgaagtatcgcggcgagcgcctgctggtcctgccggtagtcgacgagatcatcgccctccggctccaccgcgccccacagacattgggcttgcatgttcacccgcattaccagcgcccaatcttggtaatttgtgcgggtgagtgtcgggtagacgacgctgctcgtggtcgcctcgcggacgacgcgttccaccacgacttggccgcggccgccatgacggccacggcgcggagacggcgagcgccagcgacgacgcggtggtgagtgggagacgcgcggcgttggtaacgacatcaggaaccccggcgatcaccgaaggctctgataccaattgttagcagcaaaacgaaaaactgtagcttgtctggcaaaacagaaacagaacaacacagagtattttggcgctgcattaactggcagcttttctggattagagcttaaccttaaatagcaaattacaagaaagttaaacgtggccatagtggcctcctaattgtgcgtgccacactccttgccacttcgcgtcatcccacgaactggagcacaccacgcacgacaccacggactccgcacgaacgcagcgtgcgtcaagcccactatgcacacaaacaggatgaacagatcatgtgcaagactcaacgtaaaaacaaagggaaactaactactctgagcagctagacttattactaacacttcttccttttcttttctccgattccttctccttccctgtgcaaccggccgatgcggcggtcgcggcggcatcggtgcaaacgaggcccagcgcgggcgaagcctcaacggtcggcggggccgcagccaggacagcgcggccggcggccaacgtgagtacgagtgtggtttgggccggcgctgttcgtggcagtcggcggccggtggtggtaactccgtcaatcggcattcgccggcgactcccagtcggcagtgatggaatccaacaaaaaccacaaaaacggaatcggaaggatgcgagcaattcttttttgcaattcaatgtccaagatgcaaggggattcaagagatttctctaccttcttctttctcggtctccggtagaacgtcgtgctgataacatattacgcaaccctcctgctatatgaagtagtccatgataacatattacgcaatccttctgctatacgaagtagtccaagaggtcctatatgaagtagtccatgataacatattacgcaatccttctgctatacgaagtagtccaagaggtcctgtaattctacaaaagtggagatataagattgtaattctacaaaagtgaagatacaagatttaggggtgagactctcttctcattcatcattctatcctcctcaagcacaagtgtataatatgatcacccctctcctctttgtatagccttcctccatatatggaaggttttggtgtgggccaattaatatatatgggctgggtgttcatggacccaagcccataggtttctaacaatacagaccaatcagcctaatcactagctagctagtacaagttcgagataaagctccagctctaccgacttccacaagcgcaaaacgtatatttatttttggccctgtcttcatattattttttctgtgagaatgaccgatctctctatattatctagttgaaatagattagcgtgcgttctacctaactctaggtatagtaacgggttatggctaatgagcccttttataactttacttaagctgcgtttggaagtgagtttaggatgcgctaatacatcggtgtcttttatgcaaactttttatttcagtttttttaaataacaactaaaatccttttcataatagtcgatacgcaactaattaatcatatgttaatggtttttcttgttatccgtgctaacttaagctaagcctagatctggcgattaaattttctatactaaaatatgatcgaactaaaagaccactttggtcctgtttggggagcttgtcccagctgcagcttttcccaaaagctgcttctgctagaagctgccccaaacagttcacagcttacagattctgaaaaataaactaagaagccagaagctggagaagctgagtttcagagcttttccagattctcagaagctggctaccaaacagctacttctcagaatctaaagcttccccaaacagaccctttgccttggtagtgttggaattttgaggaaaaagaataagaataggaaaacgcaccgtcgtgttatgcatatacatttttgcttgttcatcgagaaaaaggatcgctactgcaggtgctccaacgcctgcgtcagaaacggcctaaaccgctcaatgttgacccgcacgtcctgcttcccgaggtaccactcggccacgtttccccacccgctcaagtgcacggcgacggggtccttgatcatggggtggtccttgccgaacacgtccatcagcgagctctcgtcggcggcgatgtcgtactcgatgtaccggagccccatgtctcgcgccggctcgccgaagtccgtctgcgcgatgctctcgagccggccgtacggcacgatctgcagcagcacggcccccgtggggaggaacacgcagttggtcagcccggctccgtgcacgcccaccatcacgtcgtacgagttcacctcccgggcgaactcgtcgtaggtgctcgtcggacggccgccggcgacggtcacctcgaaccccgccgctcgcgcggccgcggcgacctccgggaggttcatcagcttccggctgttggtccgctccaggatcatcatccgcggccgtgcaccgtggttggtaccgagcttgatcggccggtcacgcgggagcgagtaggattgcctcaagaactcggtgaagttgaccatggtgtagccgccgccggtgtcgtcgagggaggggtcgatggtgaactccttgcggctgccatagccgaccaccacgtgcgggtaacagcggacgacgccgcggtcgtcgtccttctccaggtcgacgatgtcgtgccgcgagatctggctgaagatcctccggtacttgtccacccagaagggcagcaggttgacgacgaggagctggacctcgccgccgaagcgacgcgcgccgatgaagagcgggacgagcacgtcggtgaagtcgtgccagtagttgccggtgagcccgccgagctcgatcaccatcgccgggacgttcagccgcgtcgtgcacggcggggcgtcctccgggttggggacggacctcaccgtgacgggtttgaggccgtcgaggtacttccgggagtagggctttatcttccactcccgcggcgccgcgcgcggcgagaccagggtgaccacggcggcgccggcgccgccgcctccctgcgctcgcgtgtcgccgtcgagcacgcagatgtcgtacttgccgaacgacgtgtcgcagatcggcttggtgttggcaacattgttgaagtcgtccgttcctcctcctgatcaatgatcagttgatcaccacgtcaataacgcgcccacgcttgaaaactggtataacgtattggggctgcaattcatgacatgtgaaatgaagagctggtccatcaggaatattattatttaccgaattcactgaattctatcgtatccttcttctcggattggcgtccttcctcccagtagttagagctcctgtcgttgcctgacatcatatacacataataagataaaatgtgatactgtggcacgctggcaagtcggtgaaagaaaaacaaacttgagaagtcaaatttggtcatatataaggaattttgtagtactatttttcccaccaatcacctcccatttaaattctctttattttgatatctaattactctcttttccttaacaatatcaataacacatatataccagttttaccaacaaattattatttggttgcttacatgctattttatagcttaacgtgtagtggtagaaatgaaaataacaaggtacctaattgttcctcgattgaatttttctctgttcgttgcttctcgctttcgtcatctttctctgaaggagcaaaaaagaaagagaataatttgaattcgatatcttgtagtaggtaaaaggatatgtcgtaattgttgtcgcttgattagtatgctctctggaatgacgtagctgacgtttaccttgacgttggcctgttgatcgttccgtgtgtgtactagctacctcctccctgtggccttcctccagtcctctgctcccatcttctacagacttcacaatttcagcaaagaaaagaaacgggattatctaacagcaattcttaatcatgttaaggctgtatatataccttgccatgcttgattcccttgatatgttgtagcaggaatcgattcagttttactagttgttgctgggcctaaataagctgcggcaaaaggaaatcaggacatgaacctccatgttggaaagattgaacacatgaatctccatgttgttgtctaactctagactttctcgagtttccaaggcaaacaaaggaagatgataattaagcaagcacatatggagaaaaagtaatcataattaccatttgggctgttgctgaactgcgcattgaccatcaagtagagcagcaccaacacgaagccaagaactaagccatatccaatatatctgctcttccacgacgacgacgacgacgatcgatttgcgcccctcgtcgccgccttcgattcccctcgcctcatctcgggagtctccggtggcagaaggatgatcccgcggcagtttggccgcgcctcaacataagaatcgaattaatattggaacttggtagttggtacttggtactacttggtagagtacgtttccaattccctacttgactgattctatatcaactttgggctgttgctgaactgcgctttgagaggtttctttatcagcttcttctactggctgtgcttgcaatttgtggtaaaataatagcattccagctttgacatattgcttagccaaccaatcgacgacaagttcagtacgtgagcaaccatagctgattttctgttaggtcgtgggccatcacgcacgtcgccctcacattccggcgtataagtaaaagatgtactggaatcttatctatatatcaaattattgaacaggacagcttactcaagcttgattagctttaactatatatcatcgggttgtcttattgagacggcctacaagatacattccagccatcaaatgacatgtgcacattctaaacacatgtagctagcaacttgtgtagtggccccacgtacactactccaaaaacgatttttctggacaagactcctatttggttgcagacggaccgtaattagccatatttgcaaaatcgacctctatttttcataccgctccttaagaggtttgcatggaaaaatcgattttcgcagacgatactcttaaatagccgcatccggaaatgagtctatttttgcaaggggacctcttaaggggccacatgtaaaaatacattttcgcaggcgggcatgttaaggatccaccgagaagcctaacttgcctccacttttccctctcaacacttcaaaatttttcaaagtccaaccttatcttttcggtcctcatcctttcctcgctctctcttggcggccggcgagtgggcagcgggcggcttaagctacctcgggcttggcccctcgacggccccggctaccggtgggagcgggcaaatccactgcccctaaccacgagagcgaaggtgatgggcggtggtggcggcaatggtggtgggatcgggtggatccgccacccccgccctcgggagcgacgacggcgggcagatccgtcgcccccgacctcggaagcagcaatggccggtgggtggcagctgaagcaggcttgtggcaccaggctagctagggttttggtttttcaatttcgagatttttattttttttttcgaaattttatttttgcatacggctcgcataagcacccgcatgcgaaaatctggtttggccgcatggcgcccctatcacatggaaaaatagggtttggccgcatggaaaaatgcttttttagtagtggtaaggttgggcggtagcatgattatacaagtgcacaataactaaaacactcttctcacatataggcagcccggccctctccccaccctcacccttcactaagtaattaaattacatatgagcatagtgatatagccacacatttgtatccagtcctgttttgataaattactcagttatcggcctatattagtaaataaattactcatgaatataataatctagccacaaaatttattctggccttttctctggtaaataaatcacctccagttattggtccaaccttcttttggtaaataaattactcttagttatcgggctttctcgtggccataatatttactcggtatattctcttaataaatagattagttacctccaaaaatcagttgattagtacaaaacaaccatcctacttccgtagaatatggagtaatatttttgctcggaaagtattttcccgaggaagaagagtgatggcaaggtaggattgtggatgtcactgacttgtggtttcctacatacaaagtctcttgtaatacgttgctagaagtcgtttctgttgaaatactgagatagtattccatcctgacgaatcggaacataataccttcccccacatttcgcaacatacaaagaaactgaatggtaagaaaacacaaacagggtcatctactggcacgagatcaccccaacatatagttttccacctgacaactattgcaggcatatcacaagggccttcgacggacctgccgaaacgagtcaacaatcgtcagggcgaagcgcagcagcgaagcactgattgacgcatagacagtagcttcgggcgaagccgagagcctttaccacctagccaagggcctttgcctcaaactagagaactcggggtccaaaggggccgattggtcaatgatggcccacgttgcggcctaagaggaagcccatggctgaattgtctataattgccctcataaatgtccctattataagggtatccacgtaaattcccctgtatttatttaccctagggtgcatgagtttatactaagactataaatagaccccaaggggcatgtaatgtggggatcccaaaaaattcaatattaatacatacggtttaacttttccacaaaaagtgaaccacatttttcgacgaatgcagctgtcattcgacaaacacagcaaaatcaacatccatacctattttgacaagcagctccgggtcgtatgctcgcgtatgagtgaacacccgatccctgaggaggttgtaggtctgcacatcctgatctctttgcaagcccagcttggagtcgggatggaaagtttggccttgatcctcatccattggcacttggccatatgactcagcatgcccttcactcttgcgtcctcattggacgggcacgcactcaagctgtaggaatagtgatgtgagcgcgagcttgcagcccgctttattgcgctgagaaaacgcttagagctcttcttcgtcctgcacacaaagcaacaaacacacgaataatcaaaaacgggttacgttagcaaaagccggttagccgtccaagagttagtcgtccttgtggagcttggttgctaccacaaaagtcatcattgtttgtattaacactccccaaaatcgttcttatgggcgagaacgcaccacaaaatcgtcttgtggggtagtgacactaccacactacgttcttgtggggtaatgacactaccacactatgttcttgtagttcaacccttaaggttaacttgatatgcaagaagaaaaaagtggatactcaaacttgagacaataacacgagaagcactctagaacgaaaatagaaacccaagagaaaactagtgcaacttggtttgaggcatgcatggagaacaataaccatgggttagcttttataggggcgagccacccctggtttggccacaccaaggggtcggcaaacccctaatggctacccatgtttccctcctttcgacgtaagaatagtggcatcctccactaaataaaagtgaaagttcatgtaatagaccgccctctagaaccgcgtagccaactcatccgacgggtgcgccaacttacacacaccagcccatttacattttcatccttgtttcgtgtaaaagggttaacaagggagtggcatggttggagggacaatgccttataagttggttccacccttgctaaactagcaaggtggtactaaacatgtgcacacagctctcatgggccacacatgcctcatcctaattggtccagggtgtcacagtttggtcccaagaaagatgccaattcatacctctttatatccctaagtggtcccattttgattttcaagaagataaataaatatgagatatcgacttaatttacctttcagcgaaggactcattatttaaagtccaacgagcgggacttctccgttccaattaatttgaagctacgtccagttctggagatgatgcgacggatgactattgttatttgactcgccacactttcttagttttcttgggtttagctagtgtggatgattcagcggacttttgaggtcgcagtcttggctgcgccccttacctcttcagtgtcttgtcattctgatattaaagagggagttccatccttaacactttttccatgaatgcaatgaggttgtccttcttcgggggtgtcatttcgacctctcggatatggattttttttttgaccgggaaacagtggaggaagcccccaaggttaaatttcaaatataaaaaggaaagaaatctgtacaagcaagaaaattacaagacgtcaatccatgtttgcaaaataggtctatcagctatcctaagtctaaggaaatgtagacttagctcctccttgagattagatttccatatctgaacagaaggttgtatatgcttaaagattaaatcatttctttgcttccataacagccaacaagccacaagaaagatctccataaagcatgaaagatgaggtcgggcactcctgtgagattgcagcatttgatgaaattcctgtgttgtgtcccaagaaaaaccaattgtgttccagcaagcaattgcaaaagggcactggaaaaataaatgctctctagtttctcgcagacccaggaagcataaaacacaagtaacaggaacatttggcggtttgcaatatcttctttccaacaaatctcttgtattaactctatctaggaacaacaaccaggcaaagactttaaccttcatgtatacttctcggatatggattatgaagtgaagtccttaattaactagggcaacttgccaaactacaaaagcacatagcatagggtagcagcttaaggacatgtagttggccctttgagcaactaaataacgcatagcttgacagtaagctcacatagagaccatacccagtaacgatcacacatatacattaccacctaactaggttcatatagagtcacccatcaccccggtcaaaaacattatatccgcccattgttcattacatggtgcaacaaatgctacccaaaagggcacacaaccacaaagttcttatcaaagtaatgataaataaaatgatgcatgtattcaacacaaaacattttataaactgggtccaatatgttcaaagaatgcacttgccttgctacaaaaactgtccttgcactgcgtcttctgtagcgaacaactcctctactccaacgtctacacgatggcaaacaagaatcaaataaacataaggaaagactaaatagataacgttaaatgaaataacaaacttaacaaggcggtagagctcacttttggaacaatttaggaagaagaataggtcgaatcggcattcgaacgaatgagttatgaccttcgaaagtgtgaattcgaagaaaacccatggataaaaataaaaggaatattccaagatgacggagcgtggggctcctcaccgggagaccgcgctggcccccctttgccggtttggccggggaccctgggtgagactctaagctcccaatctgtggaaggttcgcgagacaggaagcacacaagacgccggcaatgtatacaggttcaggccgctgagaagcgtaataccctactcctgtgttttggtggattcgcgtatgaagaagctacaaagtatgagccagcctcttccttgttctgggttcctaatctggaaaagtccagtcccccccttctctaagtgggcaaggtccttcttttatatcttaaggggataccacatgcaccatttccctcttttttgtggggacttcccctaccttttcataaatggacggagatttgtatagttgccgtccgagtcaccttctgatgggacgggccacaactaccttcacttttcgcgggagcagatgcgacgtggaatcgtggcttgttactgtcgacatgaccggagtcagaccagtcacgtcggtcattcttg

SEQ ID NO: 14933 - DNA, 15503 bp, Oryza sativa
ccatgtcacgaccagtagcccccggcgttatgccagggcgatcgccctctttaagggaagcggtcgggcgtgatgccactcctaaggcctggtgacaggtgggaccggtctccacaattgggcagaaacccatcggtcacaaatcacgcacatctgcagtggtaactcggctgtcaataatgagcggtctcttcaagactgccacattactcgagtagcacacgaatctggacatggcgatttgtttcgtctggagatatggtaacgtcgcttcggtcggcgagcgtaattaccgtgcgaacgatatgatatatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacgaggctccgctctgctcgatggtagcgtgctgccgccttcccgcatcgtgagcgagaggcaggctgggctgccgcgccgcttcatgccagaatctgccaccggccgggagatagtcacgctgggcgagggacgcccggcgccagactacccggggcggtccgtcttctttctccccttttcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagttggtggctgctacttccagccacgggggccagtgctgaaccgctacatcccctgcgccctcagcaagaagtgggacgactggaagagcgactcgttctacacccccctcgccgacgaaacgcgcctccgacttccgagccagcccccggcgcaggccttcagctggcgggcgccggtagatctgggggatggctatgacgccgtcctcgaccgtctggcgggcctgcgatcccaggggctcacaggggccatggtgtacggcgactacctccgtcgtcggattgcgccgctccagcggcgcgctcggggcgcctgggagtacaccgggtccgaagacttcatgaggacctaccagggagtgagatgggactgggctcctgaggacttcaagatattggtccaacgggtgctgaatctcaactccgtggaggcgtccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgggcgggggtcgtgcttctgggtcccgcgacaggggcccggggagcagccgtcctgccgacgcccgggggaagaggaagcagggaggaacacctcccccatctcctccccgagggggcggggcggtgcgtgccagcagcaggcgcccggagggggccgcgccgacatcgcagcccgagggggagcgcaagaagaagcggttccgcaagatgggggagacagaaccatctcggggaaacctcatttcccctccaaagtggtcgtttaaccgaccccctcgcaggttcgtctctcacccatcgtggctgtattcattctctcaacatgagttttcactcacccatcttgttcgtcttctggtcttttcttttgtttcagcgagatcccgtcgcgtccctcccgccattccaagtctggccagtctgaggccgaggatccggcggccgcagaggcccggaggcgggaatctgaccggcgagaggccgcggatcgcctacgggaagctgaggaggccgcccaggaggccgcccgggctcgccaggccgaggaaaccgctcgggaggaggccgcccgagcccgccaggccgaggaagccgctcgggagaaagccggatttcgccaggacgaggcgatagcaacttccgaggcagctcgcgacgaggccgcgggcgcgtcgcttgggcccactccctcgggcgacgctcaggcgacaacttccggggcagctggcgacgaggctgcgggcacgttgcttgggcccactccctcgggcgacgctcaggaccaaccgggtccggggaacatccccgagtccggcacttccatcggcggcccgagccgcgcggcatcctctccaaggcggctcttccgcacgccttctatcgccccactgaacgcagagccccttctgcaggccttggccgccgcaaacaccacggtgttggatgggttaagtgcccaggtggaggccctgcaggcagagcgggcggagctcgacgccgcgtgggcgcgtgtcgaagaggggcgacgctcggtggaggccatggtggagatggccgtaaggctcaccgccggcacgtttcggagcttgaaacccgtaagaaggtgctggcggaaatcgccaaggaagtggaggaggagcggggggctgccctcattgccaccaccgtgatgaacgagacgcaggacaccctccgccttcaatacgggagctgggaggcggagctaaggaagaagctcgacgccgcccagggggtgcttgacgctgccgctgcccgagaacagcgggcggcggagaccgaagcggcgtcccggcggcgcgaagtggcccttgaggcgcgcgccatggcgctggaagagcgcgcctgcgttgtggagagggatctggcggaccgcgaggccgccgtcaccatccgggaagcaacgctggcggcgcacgaggctgcctgcgccgaagaagagttcgcgctccgcctccgcgaggacgcgctcaccgagcgggagcgatctctcgagggggccgagtccgcggcgcaacagctggcggacagcctgtccctccgcgaggcagcgcaggaggagcaggcgcgccgtaatctggaaggtgcccgcgccgagagggccgcactgaaccaacgggccgctgagcttgaggcgcgggcgaaggagctggacgcgagggcgcgcagcggcggggcggccgcgggcgaaagcgacttagccgcccgcctcgcagctgccgaacacaccatcgccgatctgcagtgcgcgctagactcgtccgccgggaaggtcgaagccctccgcttggcaggcgaggtagggcccggcatgctttgggacgccgtctcgcgcctagattgcgccggtcggcaagtgggcctctgaagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagagaccccaatttctctccatggatggcgctggatgagttccctcctgggaccgaggacagcgtgcgcgcgcaggtccgggatgccgccgaccagatcgtcgacagcttcgagggctcggcccctcggctcgtgttcgcccccaactccgacgaggagggcaatgccggtggtgcagacgacagtgacgacgaggccggcgacccaggcgcttcggattgagcccccagacccccgccattcttcagttttttcttcttttctttcttctaaggcctttgggcctcttttttgtatagatcaacttaatctgtaatcaaaaatgaagaaatttttgtgtcaatttcatcttgctgtgtgtatgagatgaggatgatctgtgccgtagtccttttgtgtcttagcttgactaagggctcgcgcccaggttctagtcctcaaaaggcgcgggtcggagctagtgcctggggagatccacatgtcgagactggccaggccaggaacgtggtgaccgagggttatgggtgacccgattgtgggtttttgccgattcccccccggagttcaccacgccccggggcacggctcggttctgtgccccgtttggcgattttagccgacccgagcccccgagggcaggattgagcgcgagtgacctatttcaagtcaagattcttcaaaaggaaaaaacagcacagatacagcctttaggaaattgaaactgcttttattgaaatactgaaaaaaaaaaagaaataagaatgtgcatgtgtggcagcccccggccaaccctgcacgcccgagggggtgcggggttggcccgagcccgaaacctgacacccgacccccccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttagacgcggcgtaggacgaggtcgtcgacgcagagtgatcgggcccggacgtgacgctgatggtagcgccgcaggctctgctggtagcgcgcggctcggagggccgcgcgccgccttcgttcttccaagtagtcgaggtcatctctgcgaagctgatcttgatcagcctcgcagtacatggtggcccgaggagacctcagggtgagctcggatgggagaaccgcttccgcgccgtagacgaggaagaaaggcatttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttgtcgatcgcgacatacagatactcaaacccgcccggggtccgcctaaacggtcccaggatatcgagtccccagacagcaaatggccacgaaagtggtatggtctgcagggtctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggaactgggagcactcccctcgggtcccgaggcctggactccgacaggcctcgggggccggttaggcgtatccgtctcccctaaggggtcgggtcgcgccgacggctgggcaagcctttcttcaaaggcgcccggtggggtctgggctcgcgaggatgcgagccgtgagagttcgtcggcaatcatgttatcccgtctgggcacatgccgaagctcaatcccgtcaaaatggcgctccatacgccgtacttggcgcacgtaggcgtctatctgcgggtcagagcaacggtactctttacagacttggttaacgaccagctgtgagtcgcctaacaccaggaggcggcggatccccagtccagctgccactctgagtccggcaaggagtccctcatactctgccatattattggtcgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggatcgcgacgggctcgtgagccggggtccactctgccacaaaatcggcgagggcctggctcttgatagcatggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggcttcggggccgtcctgggggtcgggggctcctggcgtcgtcggacaagcgggcaaagggccaactccggtcgtcaggggccttatgcctccgttcggctcgggggcctcttctccctgctctttcccgggtcgagtcagcacagggttagcctcggggtcaaagggcgataggtgcggccttcccacagtggcctcagggccttcctgggggtcgggggctcctagcaccatctgacaagcgggcagagggccaactccggtcgtcgggggccttgggccaccgttcggctcgggggcctctcctccctgctctctcccgggccaagtctgtacagggtggggtgcgcagaatgaggattgtcctcatcgcgctccacgaccaacgccgcactaaccacttgcggggtcgccgctaagtagagtagtaagggttcatttggctccggggcaaccagaaccgggggagagctgagatacgccttcaactgagtgagggcgcgctcagcttcctccgtccaagtaaacggcccggagcgtttgaggagcttaaataagggtagcgccttctcccccagcctcgatatgaaccgacttagggcggccatgcaatcggtgacgcattgcacatccttaagcttgctgggggggcgcatccgctctatagctcgtatcttctcggggttggcttcgatgcctcgggcagagaccaaaaacccaagaagcttgcccgcaggtacaccgaacacgcacttatcggggttcagttttatgcgggcggagcggagactttcaaaagtttccgctagatccgagagtaaggtttcttggttgcgcgtctttacaaccaagtcatcgacataagcctcaacattacgtcctatttggctacccaaagaaattcgagtagtacgttgaaaagtaggacctgcattttttaacccgaagggcattgttgtataacaataagttcctatgggggtaatgaacgcagttttttcctcatcctccttagccatgcgaatctgatggtaaccagagtatgcatctagaaaacacaaaaggtcgcaccccgctgtggagtcgacaatctgatctatgcgaggcagggggtaaggatccttaggacatgccttgttaaagtcggtgtagtcgatgcacacccgaagcttgccgttcgccttgggaacgaccaccgggttcgccagccactccggatggatgacctcgcggatgaatccggcctccagaagtcgcgtcacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaactttaccaacgcgggcctccccaagagcgcgttgtagggcagactgaggtccgccacatcaaagttcacccgctccgtgcggaagttggcgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgatagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggtgcgccctcgacggcgaggacatgaccctcgtcgtcggtatgggctgacctcttcttcctcctcctgtcacgccgccctgtctgagcggcggatccgggggcggccgaagctgccacaccggaaccggaggggttccaggtccatgcctcctccttacgagccactcgatccgcgagctgaaaaagctccgcggtagtctggggctctttggaggcgatcttttcgagcatgcggttgtgccgcacacctcccctgaacgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatacgtgccttgaaagttcatggtgaactgttggcacaaatcctcccaagagtggacagatgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggtgatggtgggccggaaccttgggggccaacggacattccgaaggctcgccacaaaggctctacagccgacaccaccaaccgggggcacggagggctgatccccgcgtccgtggtgaggtgacactccggacgaggaggtgccctccgttgcgtggggagcacgtcggccattacgccggcgctcgatactgacgcgggcatccggttccccacgcagatcatcccgggtcggaggcgttgacgaaggaatggcggccgaatggcgaacagcggctgccgctcgccgcgccctccgtctcgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcatcaccgctcatactcggggagaggtcgtgcgcctttgctggctcggccattgggctgaacaggaaaagcttggcgcacacgaaggagtgcgagagctcagaagatcactcgcagagtcccctacctggcgcgccagatgacggagcgtggggctcctcaccgggagaccgcgctggcccccctttgccggttcggccggggaccctgggtgagactctaagctcccaatctgtggaaggttcgcgagacaggaagcacacaagacgccggcaatgtatacaggttcaggccgctgagaagcgtaataccctactcctgtgttttggtggattcgcatatgaagaagctacaaagtatgagccagcctctcccttgttctgggttcctaatctggaaaagtccagtcccccccttctctaagtgggcaaggtcctccttttatatcttaaggggataccacatgcaccatttccctcttttttgtggggacttcccctaccttttcataaatggacggagatttgtatagttgccgtccgagtcaccttctgatgggacggcccacaactacctccactttcgccgggagcagatgcgacgtggaatcgtggctgtctgctgtcgacatgaccggagtcagaccagtcacgtcggtcattcttgtccaccacgtgtcagcttagcaatctacatgttcgcccttcttcacataacatcttgcctgtaatggttaggatgaagcctggcatatatctgactaggactaacgtgccatctctgggaggtaacacgctagctccagctggggacgagcgcctagaagccctcgtcctgacgggatggggcgaggcgtgcgtcagatcgcctgtcgccacctaacccgcaatctgaccggtctgtgactggtcacagaccggataaatgagtgcactgcactgcgttacatgcggcgtgacacgctcagccaaatcgcaataaatgtggttaggtgagccccactgtgctcacctaacccatacacgcggagcgaaaacccacgaggggtcggggcgcctcggccctcggggctgaggcgggtgcggcccgaccccctcggggggactaagaggagggcgaacacatcaccctcaggcccgacgttccccgagggtgccaggccacgtgggcgattgtgtctgcctcaaacctctagtcatgatactcctgatcccatgtcaccgacacaagaatattctatgggtatttaatatcgggaattgaattattttgtaacagaaaaatatatgtgggacccatggtcagcggctttgagtatggtggactcgatgtatgatggactgctgccatgtggactaagatggataaaatggagataatgtggatggatctagggctaacgtggcaatggaaagagttatggaaatccgacagtggagattggatctaggggatcggacggctgagatcggcaaagaggcttcggcctcagggctcaccatcggcggcttccggaggaggtggtggtggcagcttctagaggaggtggagccacaacggcgtggctcttgatggtagaagaaacaatggtggtggcttctcgtggcagagatggcggcaacgatgtaagttcaagtgccttcatttggttttgttgattaaggtcaaatataattacatcaaactaatgtttttatgagcctttgtttgactagtctcacttggatatggaaatgaaaatggtgagagttatcaactaggtttttctccataatgagatgtggaagatacacattctttggtgatggaccttaatcatgataaggatgaaatacatggcgataaagcgatatgtatcatttcttatttcttactttttgatagggtcatcaagtggaggttgacaaccgatttgttgggactaatgttttcctttaagctatgcaaagcaataggtcccaccatgatgagactaatagattaaactatgagttgatggtcaccaagtcaaggacatcgctatgttgacaagaatgaagtcaagcttgtgatgaaaataaagtgttgacaaaggttggtcaagacttcgacataaagatggtaaaaccgaatgatcacaaagaattgagcccgagttcagtcaaaaagaaaaagaattgagcctgagttggatggccacaaggcaaaggtatagtgaaactaagaatgcttttattagttttttaccagtctcggtgtttagagtaaagaccgggctactagataggcgtcgtactattaagagggctcaatgagtattggcttgatttgaaccatgtccaaatcgctcaatctgaaatgcatgatctctttccctcggcatgcacactaaggtttaggtctagtttggagtgaggaatccgggttggatcttgatccttttgagactcaactagagcctctgacatgcatgtgatgaggttggttagatgtgtatgatgcatggcttttatatcatgtccacctgtaattctcattagagttggttttgtggacaaagagagaaaggaacatgtctaggggtgtctagtcaagtgtgatgagttttctcaagtttcaaacaaagagagaagtgggcatctccaataggagtgagtgacttgtgcgtatgtctagtggagtatcgttgggagtgtgagccatttatccttaagaaaaagttgtgattctaggaaggattgttcatgtgttggatagacctttgaataagctttccatacagtccaagaacgtcaaaattccgacacccaagtcataagatatcatcgttttactatcagcgtccgtgctgaaaagtgggtcttgatttgttactcttggtgtttagcgcttgtgcatgatattaagctttggcacttggtaagagtcaagtggtcttgatttgttactcttggtgtttgccgagacctagacagcttggtggcggttgactcggtgacctctccaaagaagtttgtagagaaggcccgatggttaattgtgaaggtttggagctcacctatctggagattagagtagcgctaccactagtgatcgagacttgggagaccacttctagacaggctcccagcttgcccatccattgacgaaggggttcgaaggctcggtagtttgagcggtgaagttgggctcgtctcaacggtgaagtagtaagccgacaactttccaacatcggttgaaaaaaatccttttctcttatcttctttattttgggcaacttacatttgtgccaatttactttgagcatgtttacatactagaaattatttgtgctattatcaccctaggcttgcaaacctcaacgtaggctaacttctttgtgcacttagttgagactagttgattcaagctttggattgtggaaaaccattttgatttaccttgcccatatataactcggttttatccaaaagttttaaaaccacttatgcacccccccctctagtcggcctcgtcgatcctacaagagcagcttcggaaaaaaggggagaagggcgatggccggtagtatttataggggaggaaggggactaggtttagggtggcgcacgacaccgatttttgggaggtggcaccggttcttgcaggagttcagcaatagcacagtgctgcacgcacgggctcgtgacagcgatggtgtggtctggtgacacgggcctacaccacggctcgggttggcggctgtgtgggctaggccgagggtgcagaggggacagcgggagcagtggctcgggctctcccgggctgagcggctcaaagtagaagggagcttaagctccatatataactgaaggttgaagaaaaaggagagaaaaagaaacaggaaggaagaagtagaaggggcaaaatgcaaaagggaacattagagaaaagaaggaagggaataggtacggacttttctagaaattccaactttagattatttggatcttttggaggatttaggatatttggaatggactagaaattgagcaccacttccgaaatacaacttaaatccaagtaactccaattaagaacaagccaatggtgtaattaattaattaatcacattaaactattttgatttcatgaaattttcataaagctatttaaggagaataaaccaaaactaaattttcataaacacgtgcaaaaaacagaaagagaaaaatcaggacatgacactattcaaccacatctccgtgctcctcaacaaggaagccgtcggaacaccctaatccagattgcagatgaagctaggctggagacttgtcgatgctaaaggttttcatatattcattttgcaatctagtagtaggatatggtcacctgtgatgtttgctttggtcaatgaaatatgttattgtaattggacacgtggctagttttgtgtgtaaattgggctagctataagtttttcactgtattgatgttcactgggttgttttgaatgttagtgggctatacaggttgctatcgcattggtcctatgtgggctttcaaaatggtctttgcccatttgttatgtaacatactagattttttaggggtaaactttttgcaaaagtctttaaagttgatgttcttcattctttcgaattggagcctcctaatcctttactttcctttaatttgtttcctctaggtttcctcctcctgcttaacattgtttagtttcttctccaaaacatatccaagatattatagagaaagattcccaaaaccatcagaagagttcatgtttattttaagttatcccggagtcatcatgcaaatattccaacatcccaaatcccatcaattagtattcggaaatatcctaccaaagatccattgaaaaatctcttgaaaaattcaaatggatcattatctctcctgggccgaaatctacct

SEQ ID NO: 14934 - DNA, 3015 bp, Oryza sativa
aattacactgtaacttgcatgtaattacactgtaactatcatgtaacttgtatgaactttcaaaaatctctctgtacatgttatttcggtaaaatggaggtcgtgggaacaaattctttcacatttatgtgtgctatgatttgttttcttcctcaccaaaacaaatcttgtaatagatctaacgattcaaaattatgtgaaacttacatataagttacactgtagttacatggaagttacagtgtaattatatataagttacagtgtaattacactacgattgtattataattacatctgtcaaatttttggggaaaaatttgtcgacaaatatatatgtagtccatttcttttcacttcttccacccatctccctcagtttgggccgttccggcccacggctgccgttggcccagccgaggcagcagccgctcgcgccgccctgcaccctgcccgcgttcgcacgcgctagtcgggtcgcgtgcagcctcgctcctgcctgcgctgctccatgtgccgccccgagctcgtaaccgcgcagctgctcgttgccaatccctcctttgttttccctccttttccaatcctcctcttcctcaaagcaaatgagcacagaagtctgaatcacttctggtttcctctctagacctctaagcgctaaactcgttctattccaaaattttctccagccatagccaagaccggccgtgcgaccaatccgccgtcgtcgaccttctgccgccgcaccacagcactagcaggaccacctctcgtcgaccttctttccctgcttgtatcgagttcctagcatgtttctgtccgccgccatggctgccatcgtggtcggcttcttcggcacctcatctctatcaacaaaccacaaaaatagtatccgctcgtccgggatcatgttttgacgtgctcacccggccacgttcatgttaggaaaccaaagaatcaacaggatcttgaacgaacactctgtgggtgtactatagcgatccggcaaatgtggagaaacgtcatatatttcaagtttcttgtagtgcgtcatctatcataaaatttgttgtagcacgtatatgaattcggagctattgtagatttatatatttcaagttttgaataatttgccttttgctatttactccgccctctagttggtttggtaattttgtcttttgctattagtctctttcgattctgatgctctgcagaacgccacacatcatatgagaaaaattatactccctctgccccaaaatataaaggatgttaggaggatatgacacattctactactatgaatctaatgtgaccatcaagtataggcatacaaccaagcataagaaatataagcattgccaaagaatacatttgatgaacaaaggacctataagatattcaagtccaacgagttttggaatccagttcggcctccgaacacagtactgacttcaacctgacctagctccttgcgtgatgttggacttgttggaaagcttatcttgtcacctttcaaactcatccagtctcatatccaaaattatccgaagtcaacgggaatcgacaaaacaagacagtgttgttgctaaaaccgaacttgggccctagaccttgtaatagactagggctatcttggaagtgtctctctccacctccatgaaccaacacctaatcctagctctattttcctttataaatgtctatgtacaccctctagaataattgggttttgtttagttgaattttactaagtgccattcatcttgtctctagtcctcgctcgattagtcggcgactatagatccagaccccaaatagttggtgcattgatttgttgggtcgattagttcttccacattaattgcaactatttctttgtgcataattacctattcgcaatatttagattgcatcttatcttgttcttgcaatgttctctcgtttgcattgcaagaatcatcaatcgtgcatcatggttggtacgacattgtttgtggtgtagcgattgcacaacgtccttgtcacgcccataaatttagcccaaatttccagactattttgtgtataaatcccgatccaggaatcaagctagggtacacaaaacaacaatttaatatacagatccaaacgtaaataaagcgtaaatacttacagaagaggcacttagtcctcacaccgaatgaaaacagcggcataggcaaatattcagctgttctctaacttcatcttcagctcaaaagcactacacttctgaaaaggaggaataatagcaaggttgggtacaaccaccgtactcagcaaaccacaacaacgttgcattcgtgcagtgggatataaagggaggtttgtgggcatttgcataaggcggttgtaaacatttaaagttgaaaacaataaaaccattgattaattacggcaacattaaatatccactgaacaatgctacaccacgttgaacaggcccaaccaaatcacctgaactacactggtttattaagtcaaattaataataaagtgggactaatcacggtgaatctggttgatcgcccataaccactgttggtaattcttatggtcacagataaaatccgcaaagcacggatataccgatgtagcacttcacccggtgttggtaatttcagctttctttgattttcccgtagtggtatgtactttgacaccatgtagtttactatgttggcataccatgggttggagtcgcgcaccatcattagcatgtcatctctcaagaaatcatttattggctgttcctgtgcatcagtaattcgtagctagacaaatgatccgctacggaattttctactccctttttatccttaatttctaaatcaaattcttggagcagcaaaatccatcttcatagacgtggtttagcatctttcttagtgagcaggtattttagaccagcatgatcagtataaattattaccttagctcccactaagtaagacctaaacttatcgatagaaaaacaaccgcgagcagctc

SEQ ID NO: 14935 - DNA, 13049 bp, Oryza sativa
cccaaatccttcaatgatatttccgtttgggtgcttgaagaatttgtttgtcggggttactgccttattgcttaggtaagcgaatgcaaaagactcagagataagattaaccacgatagttggactgtattgaatgacaacgtcgttcccttctaggtgacaaggaagaactcggggagcggtatttatccgagttacttcggatgaaagctctgcctctcttagacattcatcactcattatagaagtcagctcccgtacagtttctattaggaacccaagttccataggatcgggaggtggcaaggggacgagtggtttctttttactgaagtagttcagggtgttaccatagtcttcgtcaaaaccatccctgaacatgatagcggcatgatccggagtctgaatttcttcattctcaacggctggtggctcgggaactttttcaacaatcgagtaggtagaggtggaaggttcagattgtgactcgattgttgaaggttcctctatcttggacacggatgcttccaataggggttcattgcatggcgtcacgaaggaagtattttctagaatgtggtctagaattacttttccttctgacggcattttgtgcatgaatgatcatccggcagttatgtccagatagaatgcagactccttatttagacccatatgaaaatgttgcaaaagcacatagtcaggtaaggataagggttgtccggactgcactaaattagtgaatctggaccaggctgcaccgatgggttcattttcaatctgccagaaactgagaatttctacttgaagggcagtaatacgagtaactgggaagaaggcaagacataatctgtcttgcaacttttcccaactaccgtttacacatccaacggtagatgtgtaccattgcttcgctctctcatgaagggagaacgaaaacaatttccaccatacagtttcttgcttcatgccatgaatcttaaggcatgagcagacttgctcaaagtcccacagatgatggtagggattttctagatcaatgacagaaaaagagttttccctaaccatactaattagttcagggccaatttcatagccagttgtataaattggctccgatgaaggaggtggctcatagaattcgcacctaggagcagacagctcgaagagaggttgctccatagtcgagaagagtttgatgggaatacttctacaggtagtaggggtaaaggtagaataaaaaatgaaaagagatacaaggatgaactgggtttggaaatgatcagcaactggtccccggcaatggcgccagaaatgcttgttgataatttttacggtcacagtcaaaatccgcaagcgcatggatataccgaagtagcacttcccctacggagtattccaagggtatcgaatcctaacgcaatactttaggcactggcaacccgctgttcccagatgtcgctctactacgtacccggactgggaggatgcggggatggagagtgggatgctcaccgagtgcacccggtgggagaggcgacgtgggaggaggccgatggcgtgtcacaccctgaaaaatcaaaatatataaattgttgtttaaatggaatttttagaaataatttttaaaagcctagaagagaagatctaatttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaaacctttctctctctcctcggcccagtccggcccaatccgccgcgcgcgcgcgcgtccgcccgctgacaggtggggcccacctgtcagggtcgtcgtcaaccttcggccgccgccgccgaaaccctagtttcgcgccgccgccgttcctttccaaattcgattgatcctttccgtttccgaccgaattgatagaggggaaatgatcctcgggatctcctctaccttttctcttttggaaacatcggctaattcgttttggaagttcgtggaatcgagttcgattcggatcggcctctttcctccgaaccccgaactttccttctcgtcgccggccgccgtgggccttcgtcgtcgccctccaacccctttaaaaggacccccgggctcttctctacccgtcgcctccctcgccttcgcctctcgtcgtccgtagcgccctagcgccgtgtagccttgagccgtcgtcgccgccgtcgcttcagccgtgcgccgccgccgttccagccgtcgccgtcgctcgggaagaccgccgttgtggtcgccaagtcgctgccgtcctcgtccgccgcttcgccgtcgccgaagatcgccggagcaccgccgtcaccgtcgacccgaagaccgccgccgcttcaacctcgtcgccatcgccgtccgttgatcttccgccgctcctttggtcaccggtgagttcgccgtgccgtccgctaccgttggtgtcctccgttcgtaccgaagcgccgtcgttcgccggcgggcttgcgcatccgagctgccgagccgccgccgtcggtggtgacgtcatcgccgaagtcatcgtccccgtctcccgtgagccggtcgtggaccgttcgatctcggccgtccgttttggatcaagtcgatctcggccgtccgttcgcgtgaaccgtcgcccgtgcgcccggtccaccgaaaccctagccgctgacgcaataaacattcttttccttttcaaaaataattcattattgcgtcataattcaattaaaatctatataagtgttttaatccgattaaatcttcaaaaattcataattaattcatcttagctccgatttagttggttcaagtctctaaatttttctaaaattgagatcgacatgtactgttcatgcttgcttatgtgttgttttggtgattttgcttctttctgtttagattccgtcgtttccggagagtccgttttcgtcggagaagagtttgaagagttccaaggccagcaaggcaagtcacacagatcccaaagaaccctttgagcatgttgatcctatttaaagctattgtttctattcaactattgcatttattttcgaatgtcattgggtggaattaacctattctttgttatagcccttttgttcttgattactttattccttgataccttgggttattataacttgactagttgagctttatttattggttcagctagatattagatgtgattgcttagccatgcttagaaacattagcacactattggaataacttatgactcactattatttcatgatggtttactgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaaacatttaccgtgccaaccacaagctagggtgggcaacggctttaccttttgtatagcgtggttcattgcggagcaccagactgagaagtggcggagataagcccacgggggttcgctggggagtccataccttgtttataagggggtgactatgatccgggagtggtgcactgtggtagattgtgttgtacgagaggtaatgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccataataaatgatgctataactggtaataatttgattagctcctggtttggaatggtatattcctggtttggagatagatctgtacagccgggtatggttgttcagaatggttgggcctatacaacagggtacgttgtatagtgttggattaatattgtttaattattactcaactgttttattaaattctcaaatgtttgctaaatgctgcttttggaaatgaaaacctattatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctgcgccgtttattttattttccgctgcttagatctttattgattgagaggaactatctacctctgtaatgactttttattcgcctcttaattagagtaataattgtactctattatcaatttgttattgtgtgcctcggctgattcctggacaagggttcacacacatgtaagcgtttggaattttggatagaaattccgggcgtgacatggcggcaccccaatggggtcacggtgatggctggttccaggagctcgcgacaaagtaggagtggcagccagggatcagcttggtgatgcggagccggaagaggaggcggagtggtccaacgtggtcccaaccgttggcgacgaatggctggagacagcaatggcgagccgtggcacgagagtgtggtggaagtggcggagccgatggattttggagaagcggagcggtgctcggagtgtggcactgagcggcagagccagcggtgctggcagagtggagcggaggtggctagggcggcggcaagcggcggtcgcagcgctctggcaagcagcggcgcatgagaacggtgcggggagagtgggagagggctcgggaagctcggacaaggtaggaaaaatgtagacagaggtgcggggaagggttttataggtttaacagggtgaaagggagccgggtgaggcaaatttggctggcaacggccagtgaggcgggctggcgatgtggggctacgcggcgccaaatccacgccggatttttaggaaaaagttggttagatgagcggctgttgcgggcgagtgggttgttgacaggtcacctgccgaatttgggccaggccagcccagcccatggttcggtcgaacccaccgtggctctgttcgatgcagggtttggatggatggtcaggattgctcccctatggcggttggagggtattaccgacctttccaaccgtcataaccattattctcaagctatataaagccctctcattctccatttcaagacacacctcaagcaagaagtctatttcatctctcaagtttagtatattttctagagtatagtggaatagaattagaatagaatcttctatcctcggagtcttcggaagaattcgggtatggctctagtagcttttccttcttgtgtaagacttgtactttatttagaatactgttctttatactattatggtattgtattactttccgagtatatgaataccaactttactatatgtttgagttatatttattatgatactagcttatttgggagatacaatggtgtgggtataataattgtatttacgatgactctatgtcatgacgatgatattagagtagtattcggtaatttaagtgtggtgtttagattactggatatcattatttggggttatatgctgcggaagcgaggtaggccgctgatggtgacagctcagtacaggtattcctccgcacatgtatatagtcctaagttaatttcctggggagggtactcctccgtatttagcccgattgtatggtcaggacagattgtcgtaaggaactcagcacggattaggggtactcctccgtaattaggggtggcttctcaaagcaccaggagagcatcagatagagtgtattagctaagtaataatataactaggatgtatatataatatgtatgtatactagaagtgtagaaataggatctttctatattctttccacttagtttagatatcatgagcaagaggatgaatgcttctacttagtgtcactctacccatttgaattatattaccccctacttagactttgattattacaagtaatatataaattatttgtatggttctctctattataatattcccacaggattaaacaaatacaatacccttggaatactctcgggtgaaatgctattatggtatatccgtgcgcttgcggataaactctgtaaccataatataccaggagtagttctacactattgctggaattatatttctagtaatatcgttaagaaataccaacatgagtggagtggggcggagggttcccgtgcacgcggagtgggcaacgacgtgtggctggctgggataggaggccggaggctggggatgacaagtgcggccgccggtcccacctgtcgaagggaggaggaggggagactggttgggggaggtaaagtagacttcaagggagagggggctgggggaggttggaggtaaagcgaactttgggctggaacgtcccaaagggaaggcggggagtttaatttgtttttcattttatttaattgatcaaataaactttgtattattaaaattacttatttagctccaaaaattcacaggaaatttcagagaatattttagggcacggagaatattaaaaaatatttttggccattatttttaaaggaaatttaatttcccacattaattccacttgagaacttgttttaacttttaatataatttctagaaatgcattatttaatgattgttaatcccaaaaaaaatcaaggcgtgacagtcctagacttgttctgtttgatagccatgccgcaaacatcgcatttgattaaaacaagagttattccctaactagaagatcgggtctagaaaagcatgtccagattttgtaagatatgtcaaattcatcaaaagacacttatattttagaatgaacggcctcattaattctgcaatacgtggacaagactatcactgcaggcgagccaatggaggagactagcttaccaatgcctttcctaagtcaagcctacgctgcgtgtttgtttcccctttccagggttacgctccaccactcccgcaagtccacagtacgtaacgcgcgccatacacccttgacccttcatcgaaactaagttcattgtttaatgtttgactatccacgctccttacttggtaaaattataaaaaaaattgaaaaactaagtcatgtataaaatactattcaaattttaccattttatgataataaaaatattaattataaaaataatttaaataagacggaaacattgaacgatgattaaacattgaacacagtaacccattattttgggacggacgatgtacactcctagtaattaatatgccaaccaggcaacggccggaatgatttactatatatcttctgcaacaattctgatatcccccattgctatcgcgtccgagttcagaacacacaaaaacacatgccatgccgtgtccgtcctgtcgctgcaacagcggcagcatcgtcttcctcctcgtcgaggtggtggcgatccttttcaccggagcgacgtccaaagacaccacgaatccattcacttcgctcgactgcccctcgccgccaccctcggcttcgccgtcgccaccctcatcagcgatcaacagcacgttccaatccaacgtgttggcgctcctcgacgacctcccttccgccgccggccccaccgggttcgcctccctgtcccgcggcgaaggcgccgaccgcgcgttcgtccgcggcatgtgccgcggcgactccacgccggacgactgcgccacctacctccgcagcgccgtgctggacatcaacggccactgcaactccaaccgccgagccgccatctggtacgacaagtgcttcctcagctacgccgacaccaacgcatccaccgcctacgagaacagctaccacgcggagctctacaacgtcaacaacgtcaccgacaaggtcggcttcgagaggacgtactacgcgctgatgagccgcctcagggcgcgggccgcgaacgacacggcgcggatgttcgccgcgggagaggcggtgtacgaccccggcgccgacaacgggacgatgtacgggctggtgcagtgtatgagggaccgcacggcggcggagtgcgaccggtgcttgaacgactcggtgcagcagctgccgagctgctgctggggacaccagggtggggtggtgctcggctacaactactacgtacgcgtcgaaatatacacctactacgatctcaccgtcgatgcgcagccgccgtctcccggcccgtcggcctccagctcgaagccgtctatcggagaagggcagggtgagccagcttcgattctccagttaactgcacttgtacactagtgcatgcatgttaatttatcatatactaggacttaaagagttaagaccttctgctgaaaaagcttttattttcttagaaaaaaatattttactaattgctatgcgaactattttcgaaattcttttcatagaactatattcattatatctgtaaactactgacaccggttttgagtgttttaacgggtccttcctcccagtacaatgtgaaacttgacctagtcaaatcaactccatgcttcacgctaattaagtactctctccgaattgataatacttgttgataagggcacggtcaccaaaaaaacaactttgaccattattttctattataatatatataaagtgttaacaaatatatgattttattaaagtactttttaaaactaatctatacatttagtcgccatatttgaaagtcaaatattttaaatatgattcataataaagattctaaagtttgacctctccctagtttaaacgacaagtattatcagcccgaagggagtactactactactgcttggcaaaaccgtgttgtaaaataaattagtttgggataaaaattgtagtaccggaataattgattttctagatatatatatatatatatgctcttttttctcgattttttttttttgcaaatcttggttaaaaacctgtaatttcaaagagttttggtcatgtcttgctctgcccattgctaaattagcaagaatatagctgacagcttgattcatatacattagcagttaaacaaggtagcaggataattaaaccctattatggcaaagttttttttggtcaagtcttgctttatgaaagtgagctagcttaggcagctgtccaatcctaaattagctacaccatgttcctttgtctcaggataacttaatctaagatgtgatgtgacccatcctagctaatattttcttcgtcccagaaaaatcgtattttgtggaagacccatatttcttgcatttgttcgagataaaaaaaaatctatcttacacagttagaactgatctattagtatgtggtcccacctgtcatacacacattgcgtcttggagtccgtgctacaactagctacagatctgtagcccactgctcttctttctcatcttttatctcattaaaatatattttgtagctgactaatagtctgctattgtacctactctaagccacatgctccacagtacacggtagccaatagtgggtcccactgggtctcttttccatatcccaatctctctctccgctattacttttttcaccagggaatccaaggcagctcacgaaggcgccgagcgtccaggcggcccgagtagcgacggtgctgggtggcggggtggtcaagcggcgactgcaccggcgaagcggcctgagcggtcgagcggcgtggcccaagcggcgccggcggcgaggagcgagcggcaactctcccgccccttcctctcctcgtcggcgccggaatgcgccggcgcaaccctccccctaccctcctcggcagcgatggatgctcgatgatgacgaacttggtccctctcggcagcgacggatgctcgacggtggcgggcatggagctcagtcggaggcggacttggacctcctcttcttgtgcgccgccgccgcttccatcttcttcgtggagttcgcccgcgacctcatcttcctcgtggacgacgagcggcggcgcggtcatcctcgcaaaggtcgccgccgaccggagccccgtcgccgtcttcgtctttcttgcggagctgggatgagcggcggcccgagcggtgacggggcagccagatctgccctgggcgtcggtgtcgggcgtcgcgcggaacggccgtgttgggagtgggggatggcgagctcggcgggggcgtcccaagcggcgaaggcaacatctcaatgccggcgccacctcaccatctctcctctcaacgcaacaccgtgcatcacctcagtcctctctcctcggccctttctcccttctctgtggtgcaggacacgaaaatgtgggcccagagttgccgattctgacgaggtacctgtggcaaaacttggctatgcattcttcctgaagcaagggaatagtccgacctggaatgaaatctttgagctggccggcttgggctgagtgtcacatcactgcattgtgaatgacctaagacaacatgctggtggtccccaatctgccatcccaccaactttattctataccactttcatcctaaaatatatttcctccgtctctcaaaatataagtatttttagactttgacacagtcttcgagatgttaatttgaccaataatatctataaaataagatgttttaaataaaaagagttgcatagtataatactttgtttaatgataaatcaagtaacatcaattttacatgattgatcttttttatttttttctattaatatttaaagataaaaaatgtttgacttgatactattctaaaaatccttatattttgggacggagtagtagcaattattagttatgtatcttttcagataaataaccaataattgttataatttggatggtggaatattatttgtataatagaatatgtatgtgatatttggcatattttataattttgaacccaaatgagacctatggaatgtaaatatcttaaataaaaaaagattcatcgataggatttatttctttgacaaatagataaaatatagtattaagcaaatatctttgaatttgtttaataatttaattggacataagaaagaattgattatgggtttattttcattatctttattcaggttgatttatgttttagtttgtaaggcgtataaatgtatcttagttcaatttgggaaaataatatttatttgaaagaatataacattttatttgtaaaataatttattttagttttcgttcaaactaaaataaaagcatatatcattttgattgggttatcaattgctcagcccacagaaaaccgtcatcggtgcacaaacaaaatcaactcagcacggtctatcacattcgcctcttctctcgatctttctgctcttgttctttcttagttttccggcggttctatctctcctccaagacaaatggaatcctctcccctatgcactctctatcctcgcggtggagttctccaataccttgatcatcacctatgcccacccttgccttctcttttcgcccggtctgtcggatctgagaatgatggtgtttggggatgtccaatccactcagtggcggtggttcttggggccgacagatctatgcatgagaaggcataggcttggcagatccatattcttcctgccgcccctttcttgctctgagctcaaagcctgcaggaatgcaggatgaggatgccaccgaggcaacttctgtaggggatcatgggctcatggcggtggcagatctggtgggtagaggacattgtggaataggagaaatagaatagggaaccggtggccgagatggagaagggagagggggaggcacagtcgcgcagatggttgatgactgataacgcatcagtaggctggttgcttggccatggtctgcacactctctgtttttatcaacctacgtttttgttgcaactcctgtggttcggttcttgtagctttcattaagtcattataaattcaatttcctaataaatcattaatcatgacatcccaatcttgttttatgtttattatacagatatatccagaggaattgtttcgaaatatcacaattaatctgttcaaaacaatattaccatatgtacaactcatatttacccatagcaaatcacaggtaattagctagtatttccaaagttaaaatgactaatctaaggtatagattggaaaacaagttttctatctgtatctcaaattattgtattaaagttttgttgatcaaatgctccactgatattcagggaggattcaaagaattttgtcgtgtatatttctctttcaaataatagctttcaagctttcactccaactaatcatgcaggaaagaaggggacaaatgtgattgttgccaccacagtttctattggaacaatactactagtggctgtctttattgccgttttcatctacaggagaaagacaacgaagacaatgataccaccaggtatgacatgcactaaaaaaaaatccattttggaagacgaacccattttactttacagacggtacataagaacgtctgttctatacatctgggcccgtagtcatggaacgcttctacacattgatttttcgttttctgctgccagattactagtataccgatattaccataagataagtctaaatctagaatctgtcaaaataattatctcgtactcaaactcatatataattcgcattagatccgctcgaaagaatttacataagcttacataaacataacataagtttacataagctgacgttatttaaatttaaatagtatgtagaatgatgattcaaatgtaaaagtaatatgatgtggtttatgagagaataaaagaaggaagataatttagatcatacatctacgggctaaaaaaattaaaatgatatggcttaatgagagaagaaaaaaa

SEQ ID NO: 14936 - DNA, 1464 bp, Oryza sativa
atgtcgccggagtatgcctactgcgggcatgtctccactaagtcagatatgttcagttttggggtcattgttcttgagatggtgaccggtagaaggagcaacgggatgtatgcttccaccaagtcagatacttatgaatctgccgactccacgtctctactgagctacgtgagtacatattgaggactaatagctttagtttctaactatgtttagagaaaaacgtacgtacatgctctagcttccagttcatgaacaacgagctccatcattgtgcaggtatgggagaaatggaggacacgatccctagctgacgcagtggacgcgtcgttgggtggccgataccctgaaaacgaggtcttcagctgcgtgcagattgggctactgtgtgtccaagagaatccagccgacaggccggacatttcagctgtggtgctaatgttgagcagcaattccacgtcgctgcagactccttctaagccggcgttcttcttcggctctggcagcatcgcaagcttggatgctgctggtggacatgcatttttcggtggccggggttcagaagttgcggccatcagcagtaacaagatgtccagtaaccccgtttcagagaatgaggtcacgatttcagagcttcaaccgaggtagaagaacaaatgcgtctgcatcaattgtcagtattcaggacacttgatgtcccccgaatatcggtggtaatatggcaataatgtccaacagataagttagtgttcagcgtataaattattacactaaagcctctccaaatctctctaagaatgcattcccggtatgaaactaatggaaaagctataatgatatcgattagatcgcacattttgatattggaactactgaaatccttcaaatgatctgagtcgcaaatctcctcgtacgggacatagatgtcatgtccataaattaagccaatttttagactgtcttgtgtatgtctctattcaggaatcaaattaagataaacaaaatgataaattaatatatagatttaaacataaataaaacataaatactttacaaaagaaacatttagtcctcatccaaaagaaaacaacagtacaaaagggacgatttaagcgggcttcagctctactctacattaaaaaaaaaaaactcaaatagggtataaacattggtcctctaaatccttctatagcttagaagcacaagtcttctgaaataagaattaatagtaagattgattacaaccatcatacttatcaagcaacactaatgatgcatacatgcaagggaaggcaaaggttggttatcactatttgcgtaaaggccgttgtgaacatcttttagtttaaaatagtaaaatagttgattatttaaggcaagattaatcttcactaaacaatgctacaccacgttgaacattccaaccaaaccacctgaactacaccagttcactaagtcaaatta

SEQ ID NO: 14937 - DNA, 5700 bp, Oryza sativa
  unsure (1)..(5700): unsure at all n locations
atttgcttttatgcatgaattgaatgttgtacgaaaggactgtcaacaatgttaccatgtctggttggacacgtcatgatgcaagtgattctgacaaaaccctttgcataaccctgcgctaaccatccacaccacgccgatgtttcacctacacccctaaaccagggtgggcaacccccgtatgccgcccttaaaccaaggccaacccaactcaatcacgcccatccttgcctagatgtctatgatagggttgaattatactacaggtccagttgttgtccactcttgcttgttgttgatagtcgtgaagtaccaattttgaccaccaaatatcataataaataacaggagaattaacatttcttacacgtatatcagtaatgaataatgtagttgtactagacctggagaattaacacgaattaacatggatgcgtaattcatccaatgggacacgcttagatcgagggattgggatagatcagtggctgcaccgagacagtataaatcactctatatctaaatgcgccctgaagcagggattacgcatgctgacagcgtagatgatggagcaaaccaaacctgcatcagctaatactccgatactacctcatgctaagataccagcacagataaaatatataaaactgaaaccaatctagcaagcacaatgaactagcagatcgataggaagcttaacatactttaaaaggatgggatcttggtatgaggggcagatttagacgatccatgaccaaatatggaagtaaaatgactaaatcaagtaagatcggctgaaactctgatactatctctattagtagtcaaagaaataactagataaaatgtttcaaaacagtacttaacagatcgaacctaaccgatgcagcattaagcgtggggagaaacataagacctaattaaatcaatgaaaactcattcaagatggtggatataccgtgtaatctatcctaatatcaaagcctaagcctatcggccttctccgatgatggaggctagctaatgaagcttagataacgagatcaatctagattacgtgatatatatgataactcggcggtttgcgtggacaagattagagtgtcacgaagatgtaagcactaatcccgagaacgtaagccgtcatgacaagatttacctcttcgtcggagatcgaacttgatgcagcccaactcgaaagcaaaaactcgtcgaaacaatgaaagtagaaaaaatggtggtgatgcgccgaagtgtattaaactgtcgtcccttgattacatggggatgggtcatatttatacccggagtacatgataggtccttgctagacatgactcttatctctaacgcaaattaaaatgcgaatgagtccttcaggtggacccttaccaaaatatctctaaggaaactagaaaatgtcctattaatagatacaattgcctcttttaggacgcctatcctttgtggcaatagctatgaatggcttcaactaaccggacgacggtcatagggccaactttcccgatactggttgcatcggtttggcttcatcggatccggtgcttagccgatatgtcgcagtcgataccattgtagccgattcgcgtggcagctgatgctgtttgtaaccgatgtgtactctgctttctcgaacgtactttttcaaatcggctttgttcccaatttcgaatccaatccatggtattaccaaatttggtcgttaacagtctggtagtccgggaggtggaagatgatcctgtcaatagcggcagcccttgtaacggactaaaatttttagggaaaattttttgcgaaatattttaagtcatgctcttctcgattcttcctttgagtaatttcacttttgatcttttctttgacttgagtctaaactttatttgctaagttaaaagctttatttaaaatcccttggtaattttacaaaacctttgcatttattttttttaatctctaactttggctctagaatatatttcctttgactccttttccgaacatctccaacatccacaaatacccatttaatttccgctcaaccatctctagagcacatgaaatatcaatctctttagtgttaatacctttcatttagagcttgccacaccaccatcaaatctagttttatctctcaccaaataccctccttttgatctctaaccaaacacatgaaataccaatttttattttttttcccagaatcaatacttttcttttggatctccacctaaatattcccatagtccataaaatatccttttcaatctccntgagtcaatatacctatcctttagaagtatatcaatctaccacaaatttcgttcttgtagaaattcccatccacatatacttctgaatccagttctacactcccacaaatatttcccctttgaaatccccatttttcttctttatacaatacctttcataaacccctttaatattcccaaactctcctattttaatcaagccacccatttaattcttatggcttgatttcctcctcggcacaagaataatattatcacaatatttagagtgattgctcttgtgctaagaaacctatttccaatccttttcattcagacaatataaatttcctttagccacaaataattcactgagaatccataccacatattttggaggctaaaatcctagttatttacctccatctatttttgccaccatcccaaattcatccaaagttagaaattaaattattgcctttccttcccatttgattatttttgtgacaagttttatatttggttcttattgaattttataaaattggagcatctttatttttaccccttatcaaattttatatctcaaaataaatatctttgattttattttaaaaatatttcaaacccccttttgcttcaaaaaccttatattcaaattccttttataaaagttcaaaagaccctcaaacatccctcttttaaattttatctcctttaaaacctatttaaagccttccattcaaaatttccctagttttcaattcctttgaatcctattcaaattccttgaccaagattcaaaaagtccacatccatctatcctttagttttcatctcctttaaattccattccaaatcctctatacaaaattatcaaaacttcctttttattttgggccaatttccctttcttttggcccattccccttttcttctcctccctccttcttgggctgccggcccaactgagccgaagcccgccgagccggctcacagccgtgccgcctccttcctctctctctcgatgggcgccgccaccgctcgccccttcccgatgcgccgccgtcgacgccgtgccgtgcctttcctcctccgccgcaaagccaatccgccgccgccaccttgctgcaccaatccgctgccgccacgagccgccgcgagccgttgccgaccaccgagccgccattacagcaaattaaacgccgacacgcgtcgccgcctttttctcgacgacgagccgcgccgtcgccggccatccttcctccaccgcctctccggcctataaaaggcgaggccatcccttctgtttttgccctatccgagcttcgagctccctctctctctctctctctctccaccatgaacggtcaccaccaagtcactggccgatctcctcccccgtagcctatcttccaattcccttgcaccactagcttcccctcactccggcgaatccattttacccgttttccccttccttttcctcttgaatccagccacaccgaagctctctttctcctgaccggatcacgcaatatcttcgccgttccggccatcttacccttcctctctaccagccactacccctcctaggtgcgcgatactcgggaacacgcttggacagcgccgtcgaggccgttcaaccaccggagcaccgacgccctgtctccctctctctctgttgttgctcgggaagaagaaacagaaagagagaaggaagccggaagaaaggaagaagaaaacgagaaaggagaagacactgacagcggggcccactgcacagtaactttctttttcttttatttgatttttaatctttaggagcccatatctcttcaaccattgatccaattccaaaaaaaaaattctgtgacctaaattcatctaatttcaaaccctctcttttgataccaaattttctatttttaaaattttatttaaatttgtttatttaaataccttttcttatttatttatttaatttctaattttgaactattttgattaacctttaaaaattattttattcaaatacctttacatccctttaattttaaatttcttgttttatttaaaaactttaaattatcctttaatttctttaaatgcccttttctttattttaaaataccattttaaattttaatctatttttgaattcaaattcctttaatttatttttaaactatccatataccatcttttagcagttatgctaccaaccttagcatcggttaaccacttcaaatatctaaccgtcgtgctactccattctagcaccggctagaaaaccaaatccaccaaataaaccccacctatccaaaattatcctttcttcgtttttattcaatttccaacctatagaaaccatcacctctcttttattttcaaattaaaacttattttgaacccattcctttttcctctcgcctcgctccaattttatttattccttagtttttatcgtttctttgtagcaatttacttataggctttatttgctatctttttcgtattcgtacgttagaccgtacagcaagttctatcggcatcctaggaactgacgtggacccagatggctacgctgaagccgcgggaaatcttaaggcgcaaggcaagacataactaaaattttgatcatatagaaaccttgatataatcttcatatttaaatttgatgcatggttttcactcttttaacatctcataggtagatgttatacttcagaataacattgtgataattattaatgctttctagcattattacatgaggttattgaaaaggtgcatttaagatcattttatgtggtttattattcaaacaacttttcaaacttaggaatctggttaaaatgggcatttatgtaggggcgaagccagaatagatggtcaccggggtcactattaattaacgatcctaacaattggctatagcttctaataattttaagtctattgttgtagtagtagttaccttttacatatcagggggtgtttagatctaggggtgtaaagttttagcgtgtcacatcgtatattatatagggtatcacatggggtgatcgggcactaataaaaaaaactaattatataatccgtcagtaaacaacgagacgaatttattaagcctaattaatctgtcattagaaagtgtctaccgtagcacaacattattaaatcatggagcaattaggcttaaaagattcgtcttacaaattagtcgcaatctatgcaattagctaattttttagcctatatttaatacttcatgcaggtgttaaacgttcgatgtgatatggcgtaaattttttgtgtgggaactaaacagggcttcaattacaaccacatcattattgtactaggttacactatttgggaaaagaatataacaacctcttatatggtgaaaatcacctttgttata

SEQ ID NO: 14938 - DNA, 2951 bp, Oryza sativa
agccctgcaagtagtcatttgttgtattaaaattaattgatatgtataattaatttgttagttaaacatatggattatgcagtgaaataaactttgaggcagcaattgttatacgagcaagatggttaaaaaggagtaggcggaatctgataaacgcaggtaaatattttgtcatatttatgtacgatatggtttggttgtattgttttaagtattacatactcttttacttaaattaattgccatagttatgtttaattacgtgttttaattaattaatatgtattaattttattgtcatgtgtttatttttttggtcaaagttgtagtaaaattataaataataaattgcgttgtcatgtattcataagtaaataatttatgtttacataattatttatttataaatttttttattacaagtacatgaattttttataaataatatggaaatataaataattagttattgataaagatttttttatcaaaaaaacagtatgcgtgtaaactaatttttgtcgtgaataggacacgtttgttctgtaagacttccttacggagtagtccgtgttgactgcaatggtaggaatgtcggcatttagagtgtatttcggtgaaggtgaaattatgaaaatgaaagtggtctcgatctgagcaactttaggcaatgcacgctataccatccaaatcctgacacccttactatgcccgaagtttggtactggttaacatgcacattttctttagatccgggtatatatagtgttaacgtgagggttatgtggagccgatcggctaacaacataagataggagttaaaaaatgtgacacggagtaaggcctggcaggattggctcgctggctgtaggagacggggatatgaatatgtcatgctggtgctagcatgtcaaggaagagtccctacggagagcgctgcagggcaatccagcaaccgtgaggtgttggggtctagttcacacgaagaagatgaagttgtagctccccatcgtggtggcgatgttggtcctgacattcaaaatctatccatacaaggagatgaagtggtcaaccgccatcctactggtgaagccgatgaaggggaggacatacctgctatagttgaagaaattgagagggtggaccgacatgcagtcgaagatgaggaaaacctcactgctgaagagaatgatgatgaagatgaacaagaagttgatgaactacctatgcttgcttcgtggaaccttgaagaccctggttatattgcagaaagctcttgtcatgattcaatatggttatacggggatggccaaatcaatctgggtgcaatgttccgtgacaaaactaggttgcaagacacagtgaagtcatggtcattccaaatgcaaaggcagttcagggttgtgaagtctaacaagactgagtacacggtcgtctgtgagatggaaggttgcaccttccgtcttcatggtcacgtgccaaagtacgagtcttactggattgtgtccaaactgcaggaacactcctgtctgattcggaacactagggagtcgcatcgcaacctgaccgcggcatatgtcacgaacaagtactacaaggaaattattgaaggtgatgacctgcctgtgcggcacataataaaactggtggagaaaggtgaacaatacacaattagttaccacaaggcttggagggcgaagcagaaggccatggagaaaagatatgggacatttgaggaagcatatgacacactgccacagatgcttaacattctaaagagcaggaaccctgggacctatgttgctgtgcagaatcgggagtcaattcgtcctccaaattattttgtgatgcaatgggcattctttgcattcggagcatgcattcatgcgttccagtgctcgaggccgatgctgtgtgtcgacggtactttcctaactgggaagtacagaggctagatattaacagccgttggtgcggatccgaagataattccagtagcttttggttttgttgaaagcgagaactacgaaagctggttgtggttcttgcaacatctaaagtggggagtggtgcaaaaacacacattgatatgcatcatacatgaccagaatgctggtctgttgaaggcaatcaaagagctccaggaggatggtgatggtgcatactactggcctgacatgcacagccattggtgcatgcggcacatgggagccaagtttttcaaacaattcaatagccgacagctgatgaacatgttcaagcggttgtgcaaggcaaatcaacctacaaagttcgatgagctttggaaacaacttgacgaggggacaaagacacatatccggtcaaagcagaccaaccacaccccgaaggatgtacatgtcacccaggccctggaaccaatggatgatcttattccatcaaatggaaagaagcgtaggtcatcaaagaatatcaaatgttttacccattggattgagtgcgagccgaatgataagtgggcactcctgcatgacactaatggggctaggcatggcataatgaccactaatcttgcagaggcgtacaatgcggttcttcacaaattaaggcctttacctctaactgcttttgttgaaggcattatgcacaggacaacgatgtggatgaggacgaggcgggccgcggcgttgcaacaaatgtctaacgcacaaacacctttctgcaaaaagatggcagagtacctccaagagaaggctaacaaggcaagatttctcacggtcattaccaatgggaacgtcagacgaaggtgggaagtcacatgtcgcactaaggggggttttggatcttctactggggtcatcactcatgaagttactctagggcacgaatctgataacaaatgttcgtgctcttgcaataagccgaagcttcttcataagccatgtagccatgtccccggccgcgtgcgctaa

SEQ ID NO: 14939 - DNA, 8026 bp, Oryza sativa
ttcgcagcacaaccggaacgagtacccccacatagctctacgcccatcacctctcaatggtagggtgggtttacgtcgtttgctggtacaggatagctcatcaatatgctaattttttcccaattgtttatgtgaaatgactaaatgatgttttccaattgatgacagagggaatgtgaatggtccgtcttgtgcctcatatgcctcctgcaaggccacatatgattcctcaaatggctcacgatgtgccaacctcactctggcaaggaggatttgcaccatttgcaggtccgtgtacattcagtaccatattggcatgcatatgtccactcgtaattttactttttgctaattaattgcatatacagggactagccaaggtatccctaccataccccaattgtctgcagattttatcagttaaggagggtttacgtcgttaggcggtcagtctccacttacatctaatttcatatttttattatttcaatttattaattttgcatgtatatgaatcttattgacaatttacttcctgatattaacagggcctactcagtcggttccactgcatgcacctacatatggcaccaacccatggcaaggacaatccatggattacggtggtacgctcagccatcattctccatacacatatatcgatggcactttcatgccatacatgactcccacttcaacttaagacaataactccgtgacattttatatggatgcaaggcacgtcgtttggtggtggagtacagggttatatggacttcttgcaacaaggtgattggctatttggtcaatattcctcgcatcctaatgaaattccatatatgcaagcactgtcaacaggtttggattttttttgtgttattgttgtgtgctccagctttgataatttcattgatatctacattgcttctgtagggtcatttcgccctaaactaatgtcagggtttaggccttacactgcatcataaggcgacatgtccagcttcggtggagggtcgtcatcggtacccaacgagcttcggacttcacaaattgatgatgcgccccatgtgacacagcccacacaacaagaggttggcgaaggaaacgacaatgacccgcgtagatctaaccgtgagctccatgagccaaaccgtctgtcactctcaggccctcgacatgccgcacgagcaagaaaaaaaactacaaaaaagcgagctggaacatctaggactacgactgaccatgatgatgatgacgagtagaagtgaacattacgtctttcagttcacctggcaaacctatctgaaccttgctgtgattttggctttctattactagcaatgaacattatttttttggactgcttattcttcatgttatgtaccatgtttcgtaggtcataaatatctcatatttttatgccctattttgtatccagttaacacatatgatttttggtaactaataatttttcgtacgagagcttacaaaaaataatagtctcacaaactaaattaatagtgcagtttcgatgttactcgtgcggtaaaaattgcatattacttttactttttactaatatgacttaaattacccacttatgacttaaattacccagtaatttcttttcacagagatgcaatgatacgcacctaaaatggcatcctctctttccaatcacgggacatgccacagagaataaaatcattcacaattaaactttgaagattccgttgcgctgcgccgaaagtgacttcgtcgctttgtaattaataaagcaaacagttatgcagcatgtgccgccgaaagtgatgctgttgctttgtaattattaacttcacgagtgaaacagtccgacgctattgaattgattagtctgaagctagcagtccgacgcgccgtcgttctctttctaataattgagattgcgcagcttcttgccatcccctataaataacaaccaaacgtagcacacaactacatctcttcttcataaacgttctgctggttccaacttcgtgttgcatattcttaggcctggtcttgaggcaggaactgagtagttggtgaactcgctctatgttgttcgttcactcgcgacgcggttcctgtcccaagaccgagtctgtgaatatacaaatgtgatttttttaatacattcttacacccactctttttttcaagttctagcatccgtttgtgaatatgacctactcctgcaaattcataaactcggtgttgcatattcttaggcccggtcttgtggcaagaactgagtagttcgttaactcgctacgcggttcttgtcacaagaccgagtctgtgaatatgcaaaggtggttttctctgtgaatatgacatattctaaattcctattctttgtcaactttataaaaattgctcccgaatgatctctctactcctttatatatttttaataaatatattatcaatttatatttttctataggtaatatattgtttctttctctgatatcattattttgcaaattccaagatatttatttttcttctcgtagctgtgtacacaatctttgcctattttcaatataaacatatttctcatattcatttatgtatatatatgttgcacacataataaaaaaaatatgaaaaaaagttatactttctactccctccatcccaaaaaaaacgaatctagtactacgttggttttttatgggacggagggaaaaaaattatgaaaaaaattatactttttactctcttcgtcccgaaaaaaacaaatctagtacaaggttggttttttttgggacggagggagtacgtaccaatggcgacatgaaatattagcgatttgcacaatggattaatgtaattagctgatcgctctcgcgcgcggggagagccatatcgctcgcggtctcgctctttcaaagagcgagaccgaaggcgtcgctgtcgcactgccgtctcccaggattagcagatgaattaggggacgtgggccacgccgcaacggtatcgcggttggaaagagcgatatcgctggcgctctcattgacacgtaccgcgagactgactcgctctcgctatcgcgtagcgcgagaccgctcctgtcattcctcgggccccacatgtgtcagtcagcacacgccgctacggtctcgcgcagcccgactgtgataccgcacgcgctatcgcgcccttgaagagcgagaccgcttcgtgccccacgtacgtcaggcggcgtcggacggaccacggtatcgctttacaaaagcgcgagatcgcctcgctctcgtgctttcggagcgcgataccgatgcattagtgctccctcactccaaattagtgatagcgccaccgctttcgcgcacgcattacgcgatgccggtatatttccacaaatcccgccctaatcagcttattcttgcaattccattcaagaaaacgattactttcaaaaaattttctgtgtgggaagttgtcagctagggactaatgtcagctcatgcccagagtttttccatttaggccctgtttatatccactgagaaaatttaacaccttgtcatgttgaatgtttggacatatgcatgaagtattaaatatagatgaaaaaatagctatttacatagattgcgtgtaaattgcgagacgaatcttttaagcctaattgcgccataatttgacaatgtggtgctacagtaaacatttgctaatgacggataaattaagcttaataaattcatctcgcggtttacaggaggattctgtattttgttttgttattagactacgtttgatacttcaaatgtgtgtccatatatccgatatgacatgccaaacttcacacccctggatctgaacacagcaacaaaaagctataaatcgaatgtctgatattttgcaaaacatcgaacaatgttgcattgtattgtttaaaatgtttcacatgttgcactcctcaatgaaaaatgtttcagatgtttcatcaatcagggaaaatgtttcaggtgtttcatcaatcagggaaaaatgtttcatcatttcaacaaaagtgtttcaatcaaatgcaatcgaaacatatcatttgcaagatgaagaatcaatatatgcaacatcgaatcaaaacaaaatgaaacaccttaatacaaaaaagtgcaacacaaagctaaacccacctctatcttatttttcaactccggtcgccgcccccggacgattagttgcacaaagtgggcgacctcagctaggactagccgcaacagcatcaaccccccatcggtggccatgtccagtgccatcgctaccgtgtcgctgggatgacgctaagtttttgtgtgggcaccagctgcaaggctgttggtatttcttaacgacattactagaaatataattcccagcaatggcgcataaatactcctggtatattatggttacagagttcatccgcaagcgcatagatataccattataacatttcacccgagagtactccaagggtatcgtatttatttaatcctgtgggaagatcatagtagagagaaccgtactaacaatttatatgttacttgtaataatcagtctaagcaggggttaagataaatcaaagggtagagtgacacacaagcatggagctactcgttctcatactaaaatatctaagctaagtggaaagaaaatagaaagagaatctactcctatacttctagtatacatattatacacacactctagttatatgattatctagctaataccctctatccgatgccctcctggtacttcaagaagccacccctggttgccgagttccttacaacagcccgtcatgaccatacaaccggggctaaatacggaggagtaccctccccaggaaattaacttatgattatatacacgcgcggagtaatacccatactaagctatcaccatcagcggcccacctctcatccacagcatataaccccaaataatgatatcccgtaatctagacaccacgcctaaactaccagatactactctaatatcatcatcatgacatagagtaattgcataagtaaacattatacccgtacctatgcatctcctagataagctagcagtataatcagtataacatgaatataatgtaaagttggtattcatatacttggaaagtatttcaatactagaaatgtataaagaagagtattctaaataaagtacaaaggttacaaaagaggaaatgaaagctactagagccatacccgaactcttccggactctgatttctattctattcctactcctctagcttaagaacactaaactaaatttgagagaatatgagagagctttgcttggagtgtgtgagtgaagtaagaaggtgaagtccttatatagaggtaggtatgaaggttgtgggaggggaaatgtccgaagtgccctccaaccatcattgggatgcaatcctggacgtccacgccaaaccctgacatcaacggtttagatgggggttcggccgaaccccctggttcggccgaaccatgggctggcccaatccagcccattttcggctggtgacctcctggactttttctctttacagacttgtgaattttggcccaattgatcatgacatttttaagttgtcggcccattctacataagtctaattctcgacatcgtccaattgatttatcgtttgatttgatgtcgattctccttcactttataattattctatgcaaaaaggttagtaaacctaatactagtggaatattattattctaacacaaatatgcattgcaagcataactagttctcctctattttggtaatattggcggtcgaaattgatcgccaatgaccgtcaccaaagggctagccacatgtcaaggatgtagaggccaaatcggtcgacgaggccgtccgccgccaggtcgatgctgatgagtgccttgcagaggaagcggaagatgcactattggagcgggataaggtagctggtgaaggccggctgggtcagtcgccttgtcttcctcgacggcggcgcggagctcggtggcccagttgtgtgcggcacgatgaggaggttggtgctgaaggccttggtgcgcgtgtggtcaggctcctaggtatcgtggtagacaccgatgtgggtgccttgggtgaaggcgacgttgggaacgcatgggctgatgaggacgtcgcacttgtcgatgagcgtcgggtcaaagagcatgtgaaggcagcggtgccgaaggcggtgggtcaacgccgagaaagaaaaggaaggtgctcgggatagagataggagggagagatggaggagtttgcgtgagaggataaagttgatgtgtgcggtggataaatgctgactcgagacgcgtcgtccgatattaactcagcgtaagacgatcgatcataagcattttcgtttaaattagggttggcaactgggcaggtgggggtgggttagataggaacaaccctgccttcgatcctcgatttctccacctggccccggcctctaagcgacgaacatggcaaaatagccccctaccatgcccctgatacccgacgtcttactagggcctcgcatggtcagctggcctattgagaagactcagaattgggtggcttgggttgcagtgagaaggttccctatggacagtgacaacgaagaaggccaatgagtgttggtgccgcaagatggtgtaggccacctagatgcgtcgggccatcggcaaggagcagctcgtggtgctcctacatcgatgacgtcggccgctaagatgtgctagtgtgaggtcgcaaaaggagagtgaggataggtagagtagaggaggcagtggtatagggcaaggcgagacgggataggcggttgtggctaggccggggtcggccgatccctggctagctcccctggctgtggcctttctcctaggccttggcaaaatactccttggcccagtggtgtattgattgggcacaatttttggtattcgatgagtttgtgagcccaagactcaatgggtgaaattatccttcattttctatatgtatttcgtctcaactttggtagtttgtcacctgcatacacatatagaccaacactcgtggaaattgttagaattaaaccctaccactatgttgggtgtttcatattttctgatttatgcaagtattggcggaataaaattggcatttaccagccgccaattctccactccgcgtaaatgaactagataagtcacgcataacttatgcagactccacgccgctctactcaccggattgtttggcaccaatgagctattggcactagtacatactgatgtatgtggaccaatgagctcaactgccagaggtggttttaggtactttattacctttaccgatgactttagtagatatggttatgtctacttaatgaggcataagtctgaatactttgaaaagttcaaggaatttcataatgaggtacaaaatcatttggacaagacaatcaagtatctacgatctgatcgtggtggagaatacttgacccttgaatttggcaatcatctaaaggagggtggaattgttccacaactcactccgccaggaatgcctcaatggaatggagtgtctgaacggaggaatcgtacattgttggacatggtgcgatcaatgatgagccaaactgatctcccgttaagcttctggtgttacactctagagacagttgtgttcacactaaatagggttccatcaaaatccgtggataagataccatatgagatatggacagggaaccgtcccagtatgtctttcctaaagatttggggctgtgaggcttttgtaaaacgtttgcaatcggtcaaactcacacttaaataagataaatgcttctttgtggggtatcctaaggaaacgaaagtgtttgtcgcccgacagtgttttcttggagaaagagtttatctcaagaaaggatagtgggagcatagtgcgacttgaagaaattcaggaatcaccggaaaacgcttcaacgtccacacaatcacaataaatt

SEQ ID NO: 14940 - DNA, 341 bp, Oryza sativa
tgcttgttcatcgagaaaaaggatcgctactgcaggtgctccaacgcctgcgtcagaaacggcctaaaccgctcaatgttgacccgcacgtcctgcttcccgaggtaccactcggccacgtttccccacccgctcaagtgcacggcgacggggtccttgatcatggggtggtccttgccgaacacgtccatcagcgagctctcgtcggcggcgatgtcgtactcgatgtaccggagccccatgtctcgcgccggctcgccgaagtccgtctgcgcgatgctctcgagccggccgtacggcacgatctgcagcagcacggcccccgtggggaggaacacgca

SEQ ID NO: 14941 - DNA, 24771 bp, Oryza sativa
  unsure (1)..(24771): unsure at all n locations
acctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaggagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacattccataaccacggaatccggcagggtttaccttcctccaggctgctacactctctcgaaaagagagaagattgatttgctaacatgtttgagtggtataaaggttccatcttgttactcattaaaaatcagagggtcgtttacttgcaggactaagttggttggaatgaagtcgcatgattgccacgttcttatcacacagctgttgcccgttgcaataaggaatattttgcctcctaaggtgcgacacccgatccagcggttgtgttccttcttccatgcaatcggccagaagatcattgatcccgagggactagataaactacaggcataacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctaaagaaccgaattgccaggttgtagaacttgcctagtgaaacacttcagtggttgtcacagggtcctgaatggagtgccaccacctggcaaggatatgacataaatggatacacctttcacacggtcaagcaagatagcaaatgcacagtgcagaacagtgggttacgcatcgaggctgctagtgacagtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaagtacatgttgttcgtgaagggaaaaggagaattgttggattagacaatattgcagacgaggatgattacaaccagcacgtccacggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattagaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaagtgacttcacctgtgacggcccaaagtgttgggcccgtcacaggtggtcttacctgtgacggctccacggttggcgcccgcacaagtgaggccacatagttggagcccgtcacaggtgaatttgactagggttgacctagggttggacatcttctagatcgatccagatccggtgcccactctcactcactcactctctcgaccgccgcctcgcctctctcgacctctctgccgccctctacgccctcctctccaccgccgcctcgacctctccaccgccgtcctcgccgccgacaaatccgccgccctctccgccaccctctacgccctcctctccaccgcctcgacctcgacctctccgccaccatctctgccgccgccctctacgccgccctccccaccgccgcctagacctctctgccggcctctccaccgccgccgactctcgaccgccgccgtccatctccatcgacctctccgccgccatctccgccgccctctctaccgccatctccgccctctacgccgccctccccaccgccgcctcgacctctccaccgctgccgcctcactcactctctcgacggccgccgggacctcctctcagtcgccacgccaggaccgtcgtcgccgccaccgggatctcctctccgccgcctcctcctctcgaccgggactcgtcgtcgccgtgtgccgcctcctctgctcgtcgtctcctctccaggtacccctctctctctgatgcccatgaatggaagaattgattctttgataattaaggaactttattaggtttagggtttgaaatttagttcaaatggaagaattgattgattggccgcagatttaatgttgttccgagggtatcaaaccatcacataatacaaaatgcatggggaattttggtggattggtcagtgtagtccatggacggaaccgacctagacaccaaaattctccatgcattttgttttctgttattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctccttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggctagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgcacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccccggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttatgcttggttactgaacaagctttacaaagcgaggttgagtccacgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgatgtgcaaccaactcttcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgttctactagcgagagtccacccaactttcgctcctggagacgctgaaggcatggctttcaagcgcccggttacagacaaggtccacggcgcagacctgctagctgggtatgccaaggtgtccatcgatacaagaaagaacacctggtcaggctatccgctgcccgtgcccccaaatgatgaaatcatgactttgggcgatgcgcgcaagacgttcatataatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggtagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttattagtactaacgctacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaggttgtgtaggtcgatgacattatggctttaatccatttggtaagtatatatgcggttctatgagcaacgaccgaaattgtggctttcaaggggtgtgaattgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatgctgaggctagccaatatttagcatttattttttttctggaattaactcatcagtgaccgggtcggaacaaaaatccgtcaaaggtaacataacctgtgatggactagcaaataattgcccttcagatgtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttaggtccgtcacaggtgaccttggccagtgtagtgactacagggtgagtgatactcgtaactcgtgaatctcactgtctcatcatgggcagtgtcgggccggctttctatttccgcactgtatttttcacgtatggagatttcctgggagtaaatgctgtactgtgcatagagatggcaagttggcaacaacattgacacgatggctgataaaaagtttctatcgtgtcacatcagatatacagacacacatttaaagtattaaatatagactaataataaaacaaattacagatttcgtctgtaagctgcgagacgaattttattaagcctaattaatcagttagcaaatgcttactgtagcaccatattgtcaaatcatggagcaattaggcttaaaagattcgtctcgtaatttacacgcaatctgtgtaattagttttttttatatttaatactctatgtatgtgtctaaacattcgatgtgatagtgtaaaaatttttgtcaggggatctaaataggcccgatatttcatcccctgttgtctgatggggctagtgatattcggccaattggcactggtagcagcttctatcgtactcggtgtactgattctcaaaatttaaggagtcctaccaaatataacgagttctacactgatttctaggatttttatcattttaatgatttcatggccacaataatattccaaatttaagaatttctaccacgatatatcactactacacaaacaattttcgctgacggtccaaatgagatttcgttggcggctataccacctgtgacctaaggccagtgaaaataaggcatttatgctaccgggcagtcggtggccaagctaagacaaccaccagcgaaaataggatttcgctagcggcactattaagatacccccagcgaaatattttttggagcaaaaagaaattgaaaatccagtcaaaaacagcttgcacagaatcaaaaattcaaatcagaaatccctaatcctcaagtcgccggttgccatcatgtagctgcgtcggtgattgagggagctcgatgcagacgtcaccatggctgccgtggttgccatcatcgctgccccaccgaagcccatgctcgagccgagccgcaaccaccaggtggccccgacccgcccgcctgtcggatctgggagaggggagggagttggaggagcccgtccgtcgtcatcgttgtgccagccaccgccggatccaccttcttgactgtctcgaggatcgcccacgccccagccagccgagcatcgcccaccgctggatccacccccacggtacctcccaccgccgtggagaagtcgatgccatcgacggcggcgtcgccgaagaggtggaagccaccgaggtcattgctgcccttcccgccgtcctcagccgagccgttgagaggaggaaggagccgagtcttgttctccccaccaccaaccaccgttgccaccggatctaatgctatcgaagacagccaccaccggatctggagctctcgatgcacgccgtctctagatctgccaccacagttatcctcctctttatcgctggctcgcctcgagtagggtttgaggatggaggcggccctccccttcaccgacgttaatgagcccgctgccaccggatcggacgggctccgcctcctccactaccacaacccaccgccaccatcgtcgtccttctcttcatcgccatggaagatgagctcgcctcgagtaggatttgagggcggaggaggcactccccttcaccaccgcccttcgcttcaccaccaccaccgcactacacttcaccgccaccgccgcatcggaccatcaagaatggagagaggagaggaaggaaagattcggaggaaattaaggaagggaagagttggggaggagactgggtgattggcgcgcatgacttactctgctatttaatgtcgtgatttttttcactgtcggtgctctttaggtgcaccagcgaagatagattttcgcaggccgtcacttaagatgtccgctagtagaaataactctttctgttggcggatgaagatcgattttcgttggcggtttgtgaccagaatccctctaatatatttatataaatatttatttatttaatccgtcagaaaaataaaatggtaacgccataaaaaaccctttttctaggaatgtatcttgcactgatttgccgtctatcattttaatgattccacggccaatcagatatttggaaaataaaatcaacaaggtatagctggtttcatatcaatttaagcatgtgttagatgatgaattcataagtgtacgagtgtgatgttgcaggtgtacataatctaaggaaccagtttttgctaacattaatgaggctactactgtccagatggcaacaagccaacagaactgacactattggctagctaccacaaatcacaacaacctaagcatatgctggacatccatggcccgtgggctagctaccacaaatcacaacaacctatatgctagacatcgcatctgctgacttatcgcattacggtaaaataagataaatatgaccatattagatggagaaaatatatgagtaaaacagaaagggaaatgttggggagtgggagtacgtgactttgcatttgttgttagatttcttatacgcagaagagtatgtatgttaacaaagatgaataacttacgatcatcgttttaacgaaatgataaattgtaaattaaacattatttataatgaatttgtatcctataatgtattctgagtgagcttccactttatccgaaaaatccagttgttgattaggttgatcgtagtaagcagtctgagtgaatttattgagagttgatgttcaataaaacatcacattgcaaatatctttgactgaaaaataattgtcagtcctaaatttcaaattaattaacaaaagttgtatccatgtagggccacaattaaaaattttataaacttcattccggaattatgaattaataatacaaagttgtaattaatggtcttttgcaatgaatgttgtaattaacactagcacagaacactacagccgtaatggctgataactcacatttataacggttaaaccaactgttacaacctaacctaacagttacagatatggagacgcatctgtaacgactaaagtgccattacagatgaaagttatctgtaacggcacgtgaaaattcaggtttaaaaaaaaggtgaatattcacaataaaaaaataaaaaatcaccccgtcttcatcctcactcctagcatgctaccatggatggccgctgcacggtggctcgaaggagtcatccgtttatctgggcttcctgccgccacccgttgaagccggatacagtgatcttgtagccagcctccgccggatctgaaggacccgtgccttgcagccgccgaatctggtggtccaaaggcatgcacgccaccacccgcgccagccaccaccgcctgcaccatcgtcaaccgttgccaccagccacgaccgccaccacctgcacagcctcggcggccacccgcgccaaccccaccgagccaccagccgcgaccgccgccacacatgccagccccgctagccattgagtcgggagaagagaggatagagataaggacagagacgaggagagattgagggggaaaatggtggggagatgggggaaaaaggagaggaagtgagggagttaagggttttggctaggatttttattttttatttaagttagtagacctagaaattatctgtaacggctctaaatgtggagctgttacaaatgagtgacatatctataacagttttaagttgagagccattatagctaagggaccgatatttgtaacggctcttaatggagaaccattatagatgagtgggtcatctgcaacggctcctagtgagataatggagcttacatctgtaactgccctcggttaggagcagttacagatacgggggcttcagtaatggctcaaggttgttttggtcatcggtaacggttgtctatatcagccattacagatgacataatctgtaacagttttattggacccgtcacaaatgacctgttacacatgtaagaatatgtactagtgtaatattgactattcttttattcttaggaaaaagttcgaattaccaccctgaactatcatgggcgatcgaattaccccctaaactcaaataccggatattttacacccttaactacacaaacctgacaaataacccccctagctcaatctggggtggtttcagtcctacgtggcagtccagtcagcaattttttattttaaaaaatagtgtgggccccacctgtaagactctcctctctctctttcctctcaatccctctctactcgctcttcctaaatcccatcccccctctctctctctccttcctcccttgctgcagcgagcggcggcggccggccaacaaggcacgatggcggcacgccctttctcttctccctccccttgctgcggcgagcggtgccgaccagccggcaaggcacgacggcggcacgccctctctgtcctccctcctcttgctgcagcgagtagcagcggacggccgtgggcggaagcgcaagacgcggaggtggaggtcggagctgggtagcgagtggccggcgacgagctatggcgagcgtgacggggagggcgaaccggtggggagcctcaccgccgccaatactgccccctacacctcggccttctccacctccgcctcggccgtgactgtggtagctgacgtcctgcctctgctttgcgcgccaccgcccatcgtcggccctgcacgtcaccgtgcgtgacgaccaccgccaccgctcgacctgtgccagcccccgcgcgtcgctgtgcgcgttgactaccggcgccacacgacctccaatcggcagatggagaggatgccggcgacgggtgcttgttgccgacgagcagcccagtggacggaaaggttgaagatggcggaggcgatgtcgacgaagaggcaggggactgtggtggtcgcggaaaactggtagggcggcagcctgttccaagcgtgttgacgaaaaaatcgaatacaccggcctgggagatctgcttaactcctgtgcaggtccaaaaattggtgagatacgagcgtgccagtcagtttgatcctgcaactgacaagatatgcaaatagtagatcaaaacagacgatcgactgacaagccgatggagtagttccagccgatagccgataatagccgatgccgataccagccgatagcgatagggtttaagcaatcggctatatgtccaatgtagatactgatataaaggcaatcggctgacgacgatgtaataaaataacaatataatccagtataaaccaatcagcaaataatgatatgataaataagcatcgatccgaaggtcaaagcacacatcggctggaggtccgatgtcatgaaatccacaagattagattaaacagtgaagcctttgttgtcatcggctaaatccaacttatatgtatatgcaatccttatgagccgatgcaacgtccagataactcaccggttgaaaccccgatgaaacccttattgacaatcaagaagcaggctagagattatggttctaagcatgacttagtagatcaaacttaactgatgcagcactaagtatgaaaacaaacataatatctagacaatcaagccgttgactgagttttcagggtgttagatgtctaagctaatctaatctagcaacgcgatttagccgataccggcagaaaccctaaaacgagaagcagccgatagagctaaattgacatgctaagactagattaacagagacatatgataaataggtaggcaaatatatcatcaaaaccagagcaatccaagaggtcgaatgtactgatacagccttgaacgacaccgatgtagatgagacaattgcctgggccgacggaacattggacttatcccttcgccggagatcgaagacgatgcagccccgcgtcgggtgtcaagttctgccgaaatgtaaaaaacaaaagtagaagtaaaaagggtggcgatgcgccgaattgtattgatcgtagcgatagattacatagacctcgggtgtacatatttatacccatgggttgatacaagtccttgtcggccaagaaagaaactttcctaaagataaaaggaaaagttaaagtccttataggacactaaacacactttcctaaagataaaaggaaactaacaaactattcctaattaatagataaactgccatgccgtatcctctttgaactcggtcgtttatgggtaagcttcctttagtagattgatttccttaaccgaatatagcaggaatccgactattggcgacttgataactcccatcggctgattccgagatgccatagccgatagtgactctaagccgatgatgactttggccttaccaaatttcactgtcaacaaggcggtagtctgccagatcggcgaggaatttgggcggtggcgacgagcaagctccggcggatggtggaggtcgatggcgtccatggaggagtccctggaggggacgagcgacggggtggagctccagtgtcaccacgcatccccctgtgccactgcccaccgcacgtcctcgacggcgccgctcgtcctctgccggcgcgccgccgctcatcacccacagccgcacgccgccgtccaccggtcgcccccgcgtgccgccgtgcacgccttgccagccggccgccgccgctcgctgcaacaggggagggaggagagagagagaggggatggggatttaggaatagagagtagtgtgagatttagaggaaagagaatgaggagtcttacaggtgggacccacactattttttttaaaaaaattgctgactggactaccacgtaggactgaaaccaccccggattgagccggagggttatttgtccagtttgtatagttaagggtgtaaaatatccggtattcgagtttaggggtaattcgatcgtctatgatagttcagggggtaattcgtactttttccttattcttaagctaccactccctcgtttcaggttataagatgttttgactttagttaaagtcaaagtgcttcaagtttgactaagtttacagagaaatataataatatttacattaccaaattagttttattaaatttgtaactaaatatgtttttataataaatttatcttaggtcgaaaatatttcttttttttataaacttggtcaaacttgaaaaagtcaaaacatcttataacttgaaatggaggaagtatattttttctgaaaaataatcaacacgttttaaaaaaacattacttattgattatatatgtagtacagggttagtgactagtatccttgatctttgcgggtactgttgcctatttatatgaccatactgtttgctagatatctggtccctctgtgtcatcaaacaaattaaccagcccactcaggccaagccctgggcaagtagaacatcatgtcgtgtaccgagcaagagctgagcacccaggacatgcttcaagggccacatcgatctccaccaccacctgtacggctaccacaaatccatggcgcttctctgcgccactgatcttggaatccctggcgccatccaccgccgtggaggcgccgccacaatctccgatatcgtcgccgacaccatgatccccccggccaagctcccgcaccttcgccggctcatgcgcgtgctctccgtctccggcatatttgccgttgaagaagacgtctacaagctcaccccggcatctcgcatcctcgtcggtgataaggcctcgtgcaacttctcccctctggttcacctcgtggtgagccctgcgatgctcaccacattctccagcctaagtccgtggttcagggatggacgaaacgccagcccaacggcgctcttcgagatggctcatggcatgccaccgtgggagatgatgaagagggacgacacgatgaactcggccctcaacgacgcgtgcgtcgccgacagcagcttcctcatggagatcgcgctaagagagcgcggtgatgtcgtcttccgagggcttagatcgctggtcgatgtcggcggcggccatggaggagccgcgatggccatcgccaaggcgtttccggacatcaagtgcagcgtgcttgacctcccacatgtgatcagccaggcacccgacgatggcacggtgtgttttatcgctggcgacatgtttgaggatattcctccagccgatgcggttttactcaaggtatacattacactggaaaacttaatttatctatccccttatttttcatgtcacttaaaaagtcataaaaaatttgaaaaaaatattagtttagatcaatatgtgatatgtcactttacaaacatgcaaattcaaattcaacttatacaagtagaaacaaaaataacaaatttgactatgaagaggacgtttaattcgcggttaaatttgttatttttttcgaattgtataagttgaattttaacttgcatgtttgcgaaaagataaatcatatattgttatatcttgacaattttttttgaatttttttgataactttttaaacggcatacgcaaaatgaggggatagatatcccctcgaaagataaaaatccatttcccattacattatgttctccgtgttttctccattttatatggtactccctacgtcctaaaatatagtaaccttatattggttgggatacattctagtacaacgaatttagacatactgctgttcagattcgttgtactaggatattttccatctagtactaggacgtttcccatccagtacaaggttattatattttgggatggagggagtagcatatatatattgatggataattagtttgtatgtacggctttcagcatgttttgcattgctgggatgcggatgactgcgttaagatagttgggcagtgtaagaaagcaattcctgtaagaggtgatggagggaaagtgatactgataaatccggtaattgggtatggggtgaaacaggacagtactctcaaagagacaagtgctggctgatatgaacatgatagctataggaggggcggagcgagaggagcatgaatttaaaaagattttcttggacgctggtttcagtgattaccgaatcatgcccgtcttaggtttgatgtccatcattgaagtctatccgtgaaactattacactccggaaatgggctcaattaaaataagcatgaagatcatatcaagctaataaaaaattgtgtatcgtaaacttgagtcgacaatcatatatcatgcagctatttaccaacttcgggtaaaaattcaccaatatttcctccgtttcacaatgtaagtcattttagcatttcctatattcatattaatgttaatgaatctagatagataaatatgtctagattcattatcatcaatatgaatgtggaaaatgctaggatgacttacaatgtgaaatggagggagtagaatttagtagttgtgagggttttaccttgtttggtttttgttagtttgcttctatttttggttttgttatttttgctacatactcactgtttgagtttgcttttgtgtgaaccttataataaatggctgtgattcttgagcaagaccaggatatttaattctattattaaaaaatgatgaagatgctgtgttaaagtgtcgtgtttttgttgactcgaaagcttacatgtcggaaaatatcagtccggtggtggagttatgatgcactgcctaccaaatttcagatgtggtggcaaatttagccccacataaaaattttacaccctatcacatcgaacgtttaaacacctgcataaagtatattaaatataggctaaaaaataactaattgaacagattgcgactaattttcgagacaaattttttagacctaattgccctatgatttagtagtgctgcagtaaatatttgctaatgacgagattaattaggcttaataaattcgtctcgcggtttaatgttggattctgtaagttttttttattagtacctgaataccctatgcgacactctatataatactcgatgtgatacgcataaacttcacatctttggacttaatctaaacaccccttacatattcatgcaccactccacccataacgggtcaaattaattatggtgaataaatttgcagggacgggtgtgtacttaatagaattttaaagatattatgcttttatgttagccccagtctcactaaaagtgtcaccgcagaagggaataaaaatttatgttgagaggtagttgacctctttctctctctgtcggcgatagctctttcaggcgaaaacgaaggtgttcgctaccgctccgtctgacccccttccacaacttcgacggcttcggtcgctttggattgaagtaactaagacacatctagcaggcaaaccatcactttacccagtaatccacactagatatttattttttaggcggatataactctggaagccaaatagccgcctacaaaaatataaaatagggtgaaactcgttgtccgcctgcgaaaattaagcagtccgcctgcaaagatacccttcatttttacaagcggacctcttatatggtccgcctacgaaaatagatttgaaatataaatagagcaacctaggggctattttttctaagtcctccacttcccctccactcctctcccacgtccctctcctccacacctctcccctcccctcccctcccctcacctctcttcctctccccggccgccggcggcggcgtctcccggcggcgggcagcaggtggctcccggcccctccctcccagatttggccagagggcggttgggggagggcggcggggcgcggtggggcggtcggcagcatggcgcggcggggcggtcggcggcgttatgcggtgggtggaaggcggtggggcggacggcggctcccctccgtccctccctcccagatctggccggaggggggaggggggaggaggccggtggccagcgtctcggggtggatggcgggcggacggcagcggctcccctccctccctccctcccagatctggccggagagcggaggggggagattggtggccggccagcggcccgggggcagaaggcggcggcgactaccggcggtgacggcaaactccctccctacttgcctctcaccccggccctgagggggttcagagagaggctggcggcggctcggcgacaagtaagctcgactgctctctcacctcttctcttcttatcctcacttctctctaatcccggtggtggtggtttaggtgctgcatccaggatggggcagtggtgatggagtagcacccttggatgatttttatttgaattttgttcatgtatggaggattgtgttgatgaatgaattttgttcatgtatggaggattgtgttggattttgttggaggatttgtaatttgggggtgaaaccgagggcacggccgggggctgggttggggggggggggcgagggtttggcgccagaccctatcttcgcaggtggactactgtaccacatgggaagattgatgatcttcgtaggcgtttaggtacgggaggacgatatgtccgcctacgaaaatttgttctgaccgcctgcaaaaagtgtttttctagtagtgccatgtcgaactcatccaaccattttcggatagccgagcaggtgaagagtacgtgacaaatctccaatatctaacttttctaaaatcaattacttagaatgaatcatcagacagaaaagcctccgagcgaacacttgaaaataaaatgaatttgtttgtgataataaaagagtactctcgccagagccaccctcggctaaatagagtttgttttacccttcctagtctctagctgtcttgatggaaaaggcgggtttccacaagtgcagctctaatcatataacaaattatgccaaagcagcgaattcgtagccccagccgtgaagttaggaagaccaattaacgattacacagcttggtttgaattaatgtttaagtagtgtcgggtcccaaaattaaataattggaaatcgacaagtattactatatcaaccctggatcattaacattgatacagatattacaaccggatgttcattacacatgtacaaattacaagaggtataatattacatagagagttttagctagataatatttgatacaaaccatgatggatgaggttctactttattttgactagggaagtagaaatctttagtagtcataagggtcctcctcttgactcacatctgaaaaagtaatatagagcaagggtgagtatacacaacacccagcaagttattgcaataaatataagatagttatttgcataaagctaatttggaaatattgaatctggtatgctcatagagaatttagcaaagaataaatcttaatttctaaccaagataccaatgtgagtctcgctgctcaattcccatgagtacggctatctgagtagattcaataatactcttactgtagtagatgtacgatgtacccgcaatccatgacgtaccaattaaattgtagttttgtcatggcctagtttttcagctatttatcagtagtggtacctgctccatgaaccaaacttccacatacaccttgaatgtgtattggagctcctggggtctcagaagaactgattgtatgcatgccaccatgttatcgcaatcagggttcacaaataattcgtgacatcacaatttatcaatttatctcaaataaatatttacccgctctcagtaaatattacgattgccttgctcgacaaaaatttgcctcctcttcaaggtcctccttgaggactttaaaaatagaaccagtatgcagaagtaccacttttgttaaataacgtaatccactaggtttatacccacgtgagagttgcggccgtactcattcgttcttcacatgtacttgataatatcttatatcgatcgaaacaatactagccacccggaaattattcttttctagcgtaatgttccaatctaagtttatttcattcaaccatatttctgagcactgcaaaagctcaccgggatttggtcggagaatgaaatgcaactggtggcagcactcgaactccgaaacagagcaagttggtagcgatgaaggatcaaaacagagcatgtaagcgatgttcaacttgttctcggggctgggaaaggattggagcggcggcagcgtgatcgcacactaagaccagtgctccacagcaaccttagcaatgtatggagatgtagagctttggtgtgatggtgtggtgatggttggtggataacggcactcggctgccattagtgccgtggatgagtttagtgccattaggaacagagggctgagagagggaggagaaggtgaaattggatgacgaatgatctattttaagtggtggcggaagggatttaaatcacggcctagaaggcggcggcgaggtggcgctctcctagtgtgacgtgcaatggcggcattgaggaaaacggccggctcatcggcgccatgtttggggatgtgagagggaaaagttatgtttctttgagctctgaaaggtgatggtttggttgggcttctcgctgggatgtctccatgtcgaaggatggcggccagcggaggaggagtggcgggcacggcacgcacatgagatcgctccgcgattggcttgccggttccatcgcgggaagattagtgcttagaaagtagggtatccaaggcgcggtggatagatggatgttgcgccattgtggttgcacgcgcgtgatggaggagggtgtcgatgcgcgttggcgtggtgtgggcacgacacggcgcaccgtggcccacaaaatccttcgccggtttagggagcaaaggaggacttgaacaagctgatttaggtctctagagattaaatttagttaaaaaaaggttttggatcaaaatttgggccactcaggtactctttctcgtttttgacaaaaactagttgggaaaatagtggttatatccaagattggataggttaagggtagaaaaaggtttctaaacctatttgaggtacttaagagtgcactcatagaactagttcagaaaatatttgaatttgcaaaggatttagaataacacctaaattagaaggagtttggattttataaaggaaatttagatttccccccaagaaggaaaaaanacctttgagatggatgaatagaattgatatttttgcaataccaccaggcaggtttggtaatacgattgaaagggagatacttgaactatataattcaattcaaaccctcttttctctttttaaggtaaaagcttttaaaaggatttttttattaaataaaagattatgaataaaactcagcatgatgcattcaatttttacattaaaaatcgaggatgttaatggtaggcctctgacatgaccaatctgacatggacgtttgaccatgcgtggcccgacaagctttatcagtgccaagcgtccccggccaaggtcaatgagaccccgaagcttgtcagactaatgtaatgggacattaggatcaacttcgaaacgtagtgatataagaagagaggatcaacggataaatattgcacatttgatatatacaaacacttatagaattgatacggcggatgctgaggcaacaaccaccctggtcaaaaaccaagtgtgcagtcatactcaacaaattgtagaggtggtgatgacgctctctctcgtggcctgattttctggtgaggtggataactctcgctttgattgagtgcaacgtttacgacgtgggtaccaaccagaacaagtccaggacgccgtgcaatcgctacaccacaaacgatgtcatactaaccgtgacgcgcggttgatgatccctgcaatgcaaacgagagaacactgcaagaacaagatacgatgtaataaaagtattgtgaatacatgattaatgtaccccaaaaagaaatagttgcgattgaagtggtagatctaatcgactcggtaaatcaacacaccaactattgggggctctaaatctatagtcactgactaatcgaacaaggactagagacaaggtgaatggcacttggtaaaatttaactaaacaaaacccatttgttttacagggtgtacatagacatttatagaggaaaatagatctagggttaagtgcagggagatacttctgagatgggcctagtctatttcaaggctcaaggcccaagttcggtttcagcaacaacactgtattgttttgacgattcccgtcgatccggaatgaatttgaatatgagaagggatgcgtttgaaaggtagtgagataagccttccatcaagtccaagatcacccaaatcagagttggcatgaaggcgctaggtctgtttcaatttagtgctgtctcgggaggtcgaattggattctaaaactcattggactttaatatcatgtagatcctccattcatccgatgtattttttggcaatggtttatatttctcatacttggttgtatgcatatacttaatgcatatcaggtggtggaagaatcgttacaaccgctagtcgaatgaccaggtgtagacatacctcgaccactcgtaaatctggtaggaggaccgctacgactgctaatcgagtaccatatgtagatatacctcgaccacctatagatgttctagaagaatcactacacccgctggtcaagcactaggtgtagccatacatcgaccacctgtagaggattccgagaggtaaggagaggatcgctacgacagctggttgagtaccaggtgtagccataccttgaccacttgtagtgaactcggagaagtggtgagaggatcgctacgaccgctagtccaggactaggtgtagccatacctcaaccactcgtagagaactcggagaagtggtgaaaggatcgctaagaccattggtcgaggaccatgtgtagccatacatcgaccactcatagaggcgcttgagttggttgttacatgtgcatctcacgtggccaacatgactcacatacctaacttataagcatatcac

SEQ ID NO: 14942 - DNA, 1581 bp, Oryza sativa
tagatatcatataaaaaatatgctttagataaccacaataaatcattaagttggaaaatgtataataaatcagatataaaatcttgggcgtacctttgtagatatatgccagatatttatatatcaaaattagtagccaatttaaaaatcaatttttactaattaccttagataatggtttttccattataaaaaaaattaccgtagataaggttgcactgtacatcacatatcacggatatgtgcacgtggctgttgatttgattctccgctgtcatcttttctggttcctttgattagagttgcacttcacccgaggcagagcgcaagtgctccgagcagagccatatactccttatttaagggacttgcttgcgctgaatgctccggttcgttatgtccgagtagaaattggaccaagaggcagcttgtcggcggtgtgggctgatgatatcggactcgatcaacgacgacagctagtaccctatcgcagatcaatggattggttggtacgccgcgtcatggtcgatcagtttgaggtagtagaactcatgacgcgacgatgcatgtctcgaagctttattgatcttaatagattgaattgttggcggcgatgtactctgtcggatcatatatcatactatattccaaagctgttgaagtattcttcgtggaaaaaaatccacagtggtgatgtcatgatagagatggagatgacaagggtcccgcttcataggagaacgcactccggtcggatcgtatctcccaaagccgaagtcatcaaggaggttgttgtcagaaatccgtcttcttgaaacccatctcgcctaaagcaccaaggctcctatctaacgcgtcactatcgacgttggatatcccaaccatagtatttgtagagcacggggatcgttggtgcccgggtgtatgtgaaattaagctaaaagagatggaagacaaatatttttatatagatttaggtcccttaactgataggtaatagctctactcttgttgaccaaagccggtgttgctcttatatatcagtaccacacgagtacaatacttaggataacctaatctagtcggcgtcggcttgacggcatggatcgccaacacgcaatcgactactagtgtagtcttctttctcgaatatgaactcagaagattagagatagtactagatcccttatatcggtaactgtggctctggattaagtatgtctaggcttgtcttttattggtgtgtattggcttctatttagcttgttcgcgtgttgtaacgccccacaaataattatagaaaagagaaagagaaagaagagagagaaaagaagagagagcaagctaccagcccagcagcagcagctgcaggccttgggccttggccagcccatgcaagcaaaacagcagaagagtgtagtagtagcagtgcggcagcagccgcgctacagtactagctagaataatcccacgccgctaatttgagaagagagggagcagcttaaatataaaaggttgaccggtcactgtaactcctattctggatttttttttgtagagcgaggacgaaaaacacagtga

SEQ ID NO: 14943 - DNA, 2521 bp, Oryza sativa
ccgtaaatattaaccagatatagagaatctgcattcagctttgagatgaagtgtaagactattgcatgatccgtttgaaggaagattttgccatcaaacatagagccattccaaccttagaaaacacctcctaaggcaccacttgaaggagactacacaaatttatcataacatctaggtgcaattttttcgacaaagccatatcaaagccctcttttttggtttgttgaagagaaaaaactgaggttagggcatgtttggtagagctccaactcctaaagttagctccaggagttatgtctggagtggagttgtggagcagccaaaacccagctccacctctctagttcattgccctcatctggattgaaaaaactagggggaagaggacgcagggaagagattataccactttgttcagcaattaactttagtatttttgcactcttcccccttgccttgccaattgcaacattgggattaggagacaagaaacccttagtcaacttgtttaggcgagcactcctttatctgtgtcaggtatgacaacatttgctcccttggatttcttgcactttttgagcgaaggtatacttggaatattatctggaggaaaaggatcagctggcagttcaattagggtggcataaggagggatgcatgagattggatccaccagcataacaccttcaaattgttgggtctccactcccaactgggccgaggttgtcactgggcgtatatgtcggctttccccatgcctttcaatcttagccaccagtagcagaacaacaacccaacaaagcaaatgaacaatgtgtgtcaccagtagcgagtaggaaacattctgcatattagattctggtccttgagcttgtgtccattgggaagagtgagcaagcatagcaaagtgacaatgaggtagtcccccaagaacaccagttaggattacagaatcccataacacaagcacattctgaacagctataagaaacttccaaaaattaggattgactaggaatctggtctatagaatcaactcaaaatcttctacccccatctgatggaccaccacgtgatgcgaaccagaaatctctgagaccttactatgagactgagattgttgctgctggttgtctttcatatcttcctgcatgttatccccatgctgctctcctggctattcaggttgatgtggaggcttaggaaattctggctcagaaatgtggttaacatgcgggaggtcctcatcccaaggcatgacagcaggcaaatctctattgttgttgtttgatgatgatcatgatgttgttgttgttgtggacggtacccgttgttgttgttgttgttgttgttgttgttgttgttgttgttcatgaagaacacttcctcataggactcagggcagtcattccccgagtgcagtatcgtggcatgtttcacatgtcatttgaacttcaaattcttgtgcagtaccggacacctccaccttatcacaagcacgttcatccaagcgcttcatgaggagatccattttagcgacgagcatgtctgtttcattaactgtgttcatgccctagtgatgaggtgggagtcgttattcgctcctcccttggttggagaccatcctctcaatcaaatctgtagcacaagcaacaatcagtgagaagaaggctccttcaacagcactgtcgatgtgatcataggctgcaggaatcatcctgttgtagaagttctggacaatgagccaatcatccatcccatggtgcagataagccaggatgtactcatgaagtgtttcccatgcctctggaattgactcatttgctacttgctagaaggtcgaaatatttccccgaaggacgttggatttgcccatcggaaagaactacatgaggaacgttgttgatgacttctctcatgtggccacgacacttctcttggagtagaactaatgtttcgatgtaccaagtagagagttgaaataattggagtcggatagcattctgagtaactaccctgatgacaatggtatcgtagagttccaagaattgctggagatgagcgtatacgtcctcatcggcttttccacaggatgagctagcctgcatcagtatgatgagacccgtcttgatctgaaagtttgcatctccagtgtttgaaaatgggtctgatgggcacgttggcaacatatggagccaagtaatcacggaggaccgcctgagccattggcttggggcttgacgctgcaaatttgaccggattaggtgtcgagagcttcatttgcaaaggaacaacacgaggctggactcttctcgcaagttattctggattatcggtaaaattttctggcaggttgaaaccagtcatacatatcgttttcaaatgaagggaaaacaatcaatgttaaccagtttctttcttgacaatgatatcaaaaatgtttggtgttatttgatgatcatagatgacttgtattgatagaccgcaaaattagctcgtcatcgacgaggggtcatca

SEQ ID NO: 14944 - DNA, 3744 bp, Oryza sativa
taatactaatttactgtgcattccaaaagaatcgtagcgaatatatcttgtaaacttacagtgacattcaagcgcaatgttttgttcacggatgaataacatcaattatttttgtcactcgtgctcctcatcttccattcccgcttacggtgttttcatagatagctcggacactcatcgtcaaagtcaggaacgaaccttctagtgcctagtatccatgttcatgggcagaaacaatgaattagcatgtattatttttctctttcttccccatgactctagattcttcttttaatttaagattttcttagatttcttttacctcagaaaatcatggatttgtctgcaagctcattgaagccacgtggcccaataaaattctggccaaacggccagctttagataagtagatattgatacatattacgcaaccctcctactatacgaagtagtccaagagggtcccgtaattcgacaaaagtggagacacaagatttaggggtgagactctcttctcattcatcattctatcctcctcaagcacaagtgtacaatatgagcacccctctcctccttatataaccttcctccacatatggaaggtttcagtgtgggcctaattagtgtatatgggctgggccttcatgggcccaagcccataggtttcctaacactcccccttgggcactcaccgcgtgatgtctatgcttcatcaaaactccacaaaaacccagtggaaaaaaattggagaaagagtacatagcatacgcgtgcaatgtcgcacggattgcctcattaaaaaccttgataagaaactactaggaaaacttatccaagggaaaaagagtacaattcacctaattcttcgttcaatctttctagattgattttgggtacttgattttctatatcaagattctgaaatgagttagcgaaattctccccctgaattttgcatttctctaagtttcattattccgatttctcgggcacacctattcaagggaagatgtaaataatgagttagtggatgaatctgcaagacttccacatgacttagttcgttgcttctatgcaattcatgtacatagaagagcttgggggttcatatgcttagtgagtttgcttctcacataactcaattgcatatgtgcgacatatgctgctttaatttcataaatggtgggggttgagatagttttcaaatcgcgattgctgtcgcgggtaaccatctctcaaaactatgccgaggctctgaacagttaacgatgcttagtttggtttagttcatttagccaagttttcatgtgctgctatgacactcgtgtttaggaattccgtcccattttggcgataatagactattgcaaaagctatgcaccatgaacattcctaagtgcagttggactgatgtactagacttccatctgtcgcatgcctttagctgcaagtgtaagcatgatttggattcggccaaatatttcaaatcaaactcaaattcaaaacgaacgagtttgttttcttcaattcttttctggtttattctattcttttatgttggttcgggacctagtatttattcatgtactattatgcaagtgtccgatccaaactcctgaaatgcgttcattgattctatcttcaatgcttatcaattattcaggttgaattcttcatttcaacttctagttcattaattccattcaactcctggttgactgccaatgagttttgttgtctaaaagagacattgcccatgataggtctcattgccaatttctactggttgtatgagactttatgcgagtatccatggatatacgaggagatgcacttttcatatgcttcttcttctttttcttgcttaatacttcttgatgtgggcatgtaccagcggtagtgtgcactccaacagctagttttcttccttgatgggaaggtgcagtacgcctattcggaggttccgtaccgtttgccagatctcaaccggctccccttctattcggtggggtaccttttgtgactttgagtatgatagtccctcttgccctgttttcaccagacgtctccggttactttaggggtgtgagaagcccaagtttcttgtccaattttttttgttcgaggcctctagacaatacgaggggtacctttactttcttcggtatcaccctcccccggtgcatttcattcatgcaacttagtcaaactcttcgaaatcacaaaagtatttacaatgtgatttggcagttttaattctttgtgcaaactgcattcactagtgcggtgtaacatgcattagtccctttctgctgtaatattttctgacatttcctatctagtggttcattctctccccctaaatgactagaaataattcttatttgtcaaggaatttaggcttcataatcatctccgtaaaaagttccccaccttcggagagagccttttgcaacgcattagtgggatatgcacataaaccacacggatgcaatagcactagttgcaggatgcatgtttatgccgatggtctgaattttctttcagagtccgcagctttggggactacatgtccttttctactacgggtattacaacaatgatatagcatatattgcaattcatagcttatacttggtccattcatgcggatatttggtacttgtgctaccaattcaccaatcatcaaatgcaatgctagtattgtcctcgcggacttctaaagatgatttagtgagttcaattgatgttcacgtgatcttgctggatcagtcttggtagagacacggtgtctaagagacactagatgtttgctgctttggaagcgcatttatccatatagtaccaaatgggagcccagatattcctcacaatccagttcagggatgctaaaaactatatgcgggttatgcactaattttctatcggggcatactgtgacacaaatcttcatgatttaagaaaattatgcatatatgtgccacgatcatacgagttgtaatatttattcttataattctaagaccggaaatggctgaaaatccattgctaaaagggtgtagcctaaatcatcacactttttagagagttcaacggggttgacggacaatagatgcttctataaagtgcaaaattgttccataggtaatatgactgtggcgcattctaggccgacaaattcagttgttgctgttagcaacagtcataataatattttcagttctatgggtctggaaaatacatttttctcttaaagtgttatttgtggttatgcggaccacaattcattctttttctcttatgtttgggcgctacacacaattcaaagcattataactatgtgctagaaaagagcaacaaaatagtaaatgccttaaatatgcaattttataccgaaaataattctctattgcagggaaaatgcgtgctctacttgggcaaggaccatttttcgatgcaatgctctattcaaagattgcaacaagtgatgacgaagtatattgattcaacgaggtatctcggtacttcggattcaattaacttcatagcgagcttcttgctcgacagctatggcaattatttactatcctgacatcaattttagggccgatccgatatagcataggagattcttcgtccatagccatgcaaataggctaggagctctcctcctcaaatcatgatgagtgtgctattaggattgccattttcttttaatgttcatagttctagattgtttctcct

SEQ ID NO: 14945 - DNA, 1280 bp, Oryza sativa
gcgattttcatggggtgtccacttttggtcatgttgtggtcgtacgagctcttctcgttcggacgtccatacatgagtgtggccgtggcccacaaggacgattacactgacgcagttgatgatcgtcctaccttcggtactcgctggtgctacggaccggtacgtatgcttgcattaaaggaatatttctatcatttcaatgatactgcattactaaatctacaatctctgatcgtgcagccatagtgggcgagaatctaggtgcacaatgtgtatgagtacttcaccgaggcgttcgaaagccttagggaaaacgaagttcgatggattccgtacacgaacgaagaggccattttgcgtgcaccacatggagtaagcatcttatgctaccgcgatgaagcgtactggatgacacgaaaaatactggtgtacgacatattcttcgaggggtataatgttcaaagggtaatgcgtcaaatgggattgtaccaacaagtcccagttcctgttgggcttcaccttctaccagatgtgcacacgtatgttgttatttcaatcctgtctaatttctgtgctctccaaaattgtcagatataactaacaactaattgttgtatttttgttgcagggaaaagaggcaagctgacaacaggtatcatcgatctatgcactcagggatgatcccatggatagaggcgtggtcacaggccttgaatgatgtcgtccaggagaccaaggcatacgaccacaacacttgcgaacaatacatggcctagtactcatcgcagactcgcatccggctgcttgcacccgaggatcccgacgagcgaggtccaccaacaattgatcaaatatatgatatgcagctagcaccccccgctcacttgacggtactactagcatttaaatattttgttgcatctgtgtgtccttatacatagggttccactttctaacattgttgctacgcttcatgcagaccgacattgcaggggagttagtaagggatgcgaaaactttgtgggagaagtttagagatggaatcgtgagtaccaaccaggaagttatggccgcggttgactccctccgtagaaaaggtaagcgaatcatgtggctcgcgtcgtgccgacattcctcggacgtctatactccggcaacatcaagaaggacgttcaagccaatgctggagcgtccctcttacctcttccctgccgtccacctcagcccgcccttcagcctccgcgcgacgatccagcgacggtcgtgctgcagtaaggtca

SEQ ID NO: 14946 - DNA, 14049 bp, Oryza sativa
ccttcgaggacaaccggctgtggctgcgccacctgcagaccctcgtcgtgcaggtgatgggtgcttcgtatgttctctacaagtacatgcccggcaaggagaccctggtcatggcggccgccgtgctcatcttcgtggtgggcattctgaagtatggcgagaggatatgggccctccgggaagccaccttcgacaatatagccaggtgtttggaccagcaggaggattatgccagcgctcgcgaacgcgaaagcgacgatcttctccagcatgttctacaaggaaggagctctatggacgaggagaacgttctgattggagcacatggcctgctcgacatttgccgagggctgttcatcgggtcacgcggtgggaggcgcggctacctcaggcatgtcctgctgtccttccaaatgtatggccgtcttgataagctgatggagttggagctgtccctcatgtatgacatcctctacaccaaggccaccgtgatccacacatggatcgggtgctgcatccgtgtcatcgcgcttgccgccacggtgaccgccacgttcctcttcctgctcagcagcaaacacgggcacagcaggaaagatctcgccgtgacatacgtcttgttggccggggccttgctcctggaaatgatatccatggtgagggcagtcttttccacctggacggtcgtcttcttgtacaagctgaaatggtattggctctatggcgaggttctctccatccgccgtgttttcagggtggctacgcacaggaggtggtccggcacagttggccagcacaacttcctctgggccagcgccaatgccgtcgacgccagcgccgccgcggaagcgaaagaggaaccgccggccagcgaacccacgggttactactgcttggacacaatggaccgttgctgctgtcaccgcaccaagctatcagactctaccaaggagcagataatgaggaagatactagagatgcacgagaacagacaggaaatcgggtctcaacctggcgtgcgcgcgttcaaagctctcggcctggacggcagcctcggctggaggaccatccaagacatcggcttcgaggatagtatcatggcgtggcatctcgccagtgacatctgcctcttcagtgaccgcagcaacaagctggatttgcacgagggggtggcggttctgtccaactacatgatgttcctcctcgtgcaccgccggtacatgctgccaggccccgtgcgtcgcacgcggtacgagcaggtgcgcgacgatctcaacaagtttatgcatcgaaagggccgcgctcgctcgccgcaggacttgttcgtgtgggctcttcgcaggggcctccatgatcatctcaactccgacgatcctccggcgcagtacgacaccggagtaagacttgccgccgtgctctaccaccggttggacaggcttgatatcatctttggggtgtgggtggagatgctgtcttacgttgcttgcaactgcagcagagagtctcatgccaggcagcttagcagcggtggtgaactcgtcaccatcgtctggcttatggcgaggctcgtcgacatgtcttgaaacttttcatcctcataggctcagactatattcatcgtacatagagataattatgaatccttctgtttctagcaccagcagcttcatctctcctgtgtttaagtatacggtagttgagatgtattaggataggatttatttagatcgtagctttccttatctatgatctttaattatctctactcatgtaatttctataacatactagctctatgtgactataaaattgtgtatgttgcgctctcttcaacttacactattcagcatgatattacagcgggcgacctagggccaccgctcacgcttccaccaccgttgcccccgggagggttctaatctccaaggggcggccactcatttattttttttctttgtcaatgtcttcgtgttttcttcgtcatcttagcatcgtcatatagcagcaggagcacttacctctggttgtcaccacgggactcattccgtcattctatccaatttcctcaccgataaagaagctgtccttaaaataaataacggtaatcgaataaatgccaaaacatgtaaaaaaatgaaaatgctctaaaatgctttaccctgagatgaggatttccagctacttttccctccctttccactaccatagagggtgccatacgagtgttagacttgatgatataagatagcgctatggagctttgtttcaggagctctgcctcttcctcactgcaccgcgcacagttcattgcatgcaaggtgtttgttagagcctgttttatttccgttttttgtggcttggttgttacagaatgagtcgtgtcttgtaaagctggattcgtgcaagttcacgacgaggcgtagtgtagcgagtcgtacgctcacgttctccgccatgtgggatggcacatgcacaactggaggaagtgggagtgcaaagagttggagacacgatcgcatgatctcgttttcgctttccataaaaagagatgaaatatacagaaaagctgcgcaagtttggtggcacaaaaacttctctcgtgtgttcttctcttccaccattcatcatcaagtattgttgatttctagggattagcgaataggttgattctgagtttttgccaacatctggtatcagagccatgtcgcctccgacgccacacgtctcgcattcgccgcatcgtcaatcccgctcgcctcctccgcgccgtggtcgctgttggcctggcgccgcttgggacttgggtccggacaggcgcgttgtcaaggaggtggggggtgatgctgcaggcgcgcggcctctaggaagctatcgacacgggtgacgtcgacttccaggaggacaggatggtgttggaggccgtcctcaaggcggtccccgctgatctgctgccggtgctcgctgtcaaggagatgacgaaagacgcctgggatgccatcaagacgatgcgcgtcggcgtcaaccgtgtccgcaagtcaaaagcgcaggagctgcgcaagcagttcgatgcgatcgagttcaaggaaggggagtccgtggaggaattctccatccggctgagctggctcgtcaacaaccttgccgtactcgggatccagcttgaggaatcaaaggtctgtgaaaattttcatcttgttgttcctgaacatcttgagcagattgccttgtccattgagactctgctcgatctcgataccctgtcgcttgagcagctgacggggtgtctgaggaatgccaaggagcgccgtcccaagaagaagtccggcgatgagagcgacaaactgtatctcacggaagaacagtgggccactcgtgccgaggaacggcagtccggcgagggatcgtcgggcaagaaggcgggcaacaaccgccgccgccgcggtgggcagaaaaaaaccgagggcgctgccaatggcgagcggggcgcgcgcgatcaagggcgcgacaagtgcaaaaactgtggtcgtctcggtcattgggagaaagactgtcgccagcccaagaaacaagccgaggcacacgccgtccagggtgaggaggaagatgacgagccggttttgctaatggctcacgctgttgagctggcgcaacctccaccatcgccaccaccaactgaaccgttcgacctcgttgagcccaaggtgttcacactgttatgaaaatagatgcacaacggagacacgaattttacgtggaaaacccttgcgggaaaaaaccacgggcgccgaccggcaatgatcactatagaggagttgattacaaacgtagcggaatcacaatgggaacgtcaccccttcccatacagcttacaagagtatatataggggataaaagaaagacacctaataggaactcctactaggaaactaaaccgaatatattgtggggcccaaaattcggatcacatatttaacaatctccaccttgagacgaatttcctcttgtagcatgaaaaacatcaaacaccaaaaatacctcatgtaggtaaaatcaccgtgcgccaaatagtctctaggactatactgtaacaccaaccaagcttgagcaaatctcaaacttagtagcaggattcatatcagctgggttatcatgagtacttatcttgcataccttaacatcaccttcagcaatcacacctcgaataaagtgatatctcatatcaatgtgctttgttctctcatggaacatctgattctttgtaaggcatattgcactttgactatcacaaaatatatttatgcaagacgtaactccacaaagttcagtgtacaaacctttaagccaaatagattctttacaaactttagaaatagccatatagtctgcttcagtggtagataaggcaacagttgcttgcagacttgccttccaactaacagcacatcctccaatagtgaaaacataacttgtgagcgatcttctcctatccaagtctccagcaaaatctgaatccacataaccaatgagtccatttctagatctcccaaactgcaaacaagcactagatgtaccacgttggtatctgaaaatcaattgaacagctttccaatgctctttgccaggattagccatgtatctactgacaacacttaatgcatgtgataagtcaggacgagaacataccatggcatacataattgaaccaactgcacttgaataatgaactctagacatgtactcaatatcacaatctgactgtggacataaatctgaagataatctgaaatgtgcagctaaaggagtactcactggttttgcatcatgcatattgaaacgacaaagaactttttcaatataacttttctgactaggatataacttgcgtcagaatgtctttctctagtaatttccataccgagaattttcttcactgcacccaaatccttcatctcaaattcactactcaattgtgccttcaactttgctatctctgatttgtcttttgcagcaatcaacatatcatcgacataaagaagcaaatatatagctgaaccatcagcaactttgacataaacacagctatcataattggatcttctaaacttttgagaaagcataaaagagtcaaatctcttataccactgtctaggtgactgcttcaacccataaagagatttcttcaacctgcatactaggttctcttttccaggaacaacaaaaccttcaggttgctccatataaatgtcctcttctaactccccatgtaaaaatgcagtcttaacatccatttgctctagttcataatcatgcattgcaacaatactgagtaaagtgcgaattgaactatgcttcacaaccggggaaaagacatcattgaaatcaatacctggaatctggctataacctttagcaactaaccttgctttgtacattgcctcatcacttggagatatacattcctttcttttgaagatccatttgcaacggataggtttcttctcctttggcaacttcaccaattcccaagtatgattcttttcaagtgactccatctcatcatgcatagcagttatccatctattgcaatcatcagaaacaatagcctcagaatatgtagaaggttctgcattaccttcaatttcttctgccacactcaaagcataagcaactatgttcgcttcttcaatatatctttgaggaggtttagtacttcttttgggcttttcttttgcaatagaacgttttggagactgctgaacagtagaagaatttgtatcttcaataacaggtgcatcttggtgaacagtagtgaacccttttccatagactttggaggcgaatcctcgtcaaagctgcaccttgtgatcttcccatggctcgcgttcggccacgtgctcccttacctagagctcgcagagcgcgtggcatcgcgtggccaccgcgtgtccttcgtctctacaccacgcaacatcgcgcgcctcctgccggtgagccccgccgtggcaccgcgtgtcgacctcgtggtgctgccgctcccgcacgtcgatggtctctcggttggtgccgagtgcaccaacgacgttccctccgacaagttcgagcttctctggaaggccttcgacgccctggcgccgccgttcgccgagttcttgggcgccgcatgtgtgggaacccgagcccttccggcaggtggtgacgttcatgaaaaagccgcttgtccccctcggccttctgctgccgtcgcccgacggaggacgccgccgcaccgccgagatggtcgacgacgccaccatgcagtggctggacgcgcagccgccagattcagtggtgtacgtcgcgctggggagcgaggtgccgctgcgcgtggagctggtgcacgagctggctctcaggctagagctcgccgggacacgttttctcttggcgctgagaaagccctgtggcgttgatgactcggatgtgcttcctctcggctttctagagcagacgcatggccatggacatgtcgccatggggtgggttcctcagaccaccatactggcacatgccgcggtgggtgcattcttgacgcactgtggacgcaactcgcttgtcgaggggctcctgtttgggaaacctctcatcatgttgcccatcgttggggaccaagggccgaatgcatggtcaatggagggtaatatggtaggattgcaggtgagacgagatgagaatgacgggtcattcgatcgccatggtgtcactgctgcagtccgagccgtcatggttgaggaagaaaccaggagtgtgtttgttacaaatgccctcaagatgcaagagattgtagctgacagggaactccatgagaggtacattgacgggtttatacagcagcttattttccacgtcgctgatggcaactctgatactgctgccccagatccttccagctgagacttagtttgctggttgtattatatgtctcagttactgtaattcatgtggtaatagcaacggctgcatcacttgtttatgtaaagaatgggggtttatacttcctttgtccaatcacgttgttctatcttccttatccccacgcattgtttatactttattagagtatcacggggataaatggctaaaatttagctccaacatacactggtggagaaaccatctttgcccggtcaaccaaaaaccacaatagtcccggttgcaataaaaaccgggactaataatggtttttagtcccggtttataagcagaatgggactacatgatctttagtctcagttggtaacaccaaccgggactaaagatctaaagatcatctttagtcccggttcacatgctgtcaggggttgtcagggccctccttgatctttagtcccggttggtaactccaaccgggactaaagatcagatctttagtcccggttggtgttactaaccgggactaaagatcaaaacgcactatataatccctattacttatcctcttttcccgtccacacaaactcctctatcccttcatctctaatccttatctcttccttcctccttatttcttctcttctctttccgtcccgaagggctgaactgcgcagcagttcctccttatctcttctcttctctttcagttatgcacgctgagattaactgcatcaccatgcagttgcgcctaaggatagggagaaaaatctgcatgcgagtagatcacgacaacaactgcaagcgggatgggtgtgggtttatgcagccagaggagggcgggccgaacgccggagggcgccgcggcggcgcggagggccgcgcggtggcgtggcgaagcggcagccagggaggaggggaggcggcagcggctgagccagccggcggctttgctttgtttcttttttttttaagaatttgtgatccatgtatagattgagatgaagaatttgtgatgtatatgatttgtgtatttgggatgtttctttgatttgggatgtataatctgtggtgtatatgattgatttgtgtatttgggatgttacgttgatttgaggatatgcatcccacctaatttgggagaaaataaattagagattttgatttgaggatatgcatcccacctaatttgggagaaaataaattagagattaagcggtgagtagcaataaatgaaaaaaaaaactaaccggtactgccgctgaatctttagtcccgaaataaggatctttaatcccggtttaaaatccgggacaataggggggttacaaaccgggactaaaaacgatctctccaccagtgatattctcttgtcagttgctaaaaatttggagttcctttctctaggtatttcgctctccatttgtagcggcgcgcaagcccgtgttagtgatatgccctagaggcaatcatagagatgattgtatcacacactatgtttacatatttatccgactttgttccttgaaagagataaactcattattggttaatgaatatgtgattctttcatgagactctttatgttatgtgttgctatttctaaaggatccctgatcaaatatcatatgtagaacaaatatgtttagatgatcagcacatatattaattgatgatcatgtcttatggatcatggtatagagataccaaattactaatgtggacacatgttggtgaatatgttgttggatagacccaacatgagacactgcaagagccatatgtgttgtgtcatcagtgatcccatttagtgttggtgttgaatccttagacctgagattatcatggttcccaacatgtgtaatagcttacttagggactgctaaacgctacttcgtaattgggttgttataaaagtagttttcgggtatgctatgaaacatgtagtgggatatgaataatcaagatgggatttgcccctcctatggagagatatctctgggcccctcgatgttgtagattatggaagtgcatgacaatgccaaaggtgattgagaagtcaatcacaagttatataatctatgaacacgttcgagtgaatgattgagctattagaggatggcgcatatctagccttgagcttaatagatatcgtgaggcaaaggggttcatacaagtatacactagaggttcagccgatatgatctttatgtatgcctggtgggtcaatacgttctgctaggggccgctgttgacgcgtggaccgaaaaggagttttcgggttatagccgagtatatatgaacctacagggccgcacgcttaatgggccggaataaggggattggatgaagatccaatatgagcttaattcggatagggatccaaataggagtcctatgggccttggaggcccgagtgatggatcctatatattcgtgaggggtgtgaccggtggaggcattccatcacgtgagaaaccctagccgtcacttccctccccgagcaaaaccctagccgcgcgcgggtgctagcacatctgcgcgtggcgttccgtccctgtacgtgtggataccggtagagtcgccgctggtttgcgatgctgatcggcgtgggagtacggcgaggagaactcacgaggaggagaaggtcgagccggtgcgatcgactacttcctctacatcgacgcgcgctacttcgcgagagttccttcgacttcttagcgttttcttccgctgcgcagcacgtcgagtggtaacgatctatgatctaatacttgcatggttcctggtttacgcgatagaaaattttgatttttgctatcgtagcctatgcgtatcccaacagcccgaacacaatccctcacaatcttcagctttccactgcttcgactcactcattcccgcggcggtgccacaaatgctcccgccaggcaagtcgtcgtgtacaaattattcgccaccgcctcgacctgctcctctgctggtggcatcttccccaaatccagccagaaatcatccgcttctccccaagcacctccgccggcctgacgaggcccccaccgccgcctatacatagccgccgttgtccagggacacacgggcgacattgcagcgaggtgaccacccaacaaccatcttggacgaccatatagagtgtcacaactcatgatgaccatgactcggccggagctgatctgtcggcagatttgtcggttgtgctgtactgaaccagatctctgtatgtaataaaccatttagaaacttcttttgctccctgtggtagtgaaggaactgttggaaactttcatgttttgaacaagtcaggacccctatcgctcagatgacaagttttagagcaccaagttagcttctggtgattgctgctgctgctgatttttgctgccgttgctgctgctagagaagttttattgttgctggtggagtttgctcctgattgctgctgttgctgctgctagagattttttgctgcggctagagtttgctgctgttgctgccgctaaagattttctgctgctgctagagtttgttaattactggtttctgctggaattgctgctgctgctgccgtgaactggtatcaatcgtgatacaagggcgcgcgacgtacagcgacgagccactcaggactcaggaagagtaataaaataatctctgttaatttctgttggtagttttgtatatagtccacttttttcgtttcagggagttgattttacccaatcaaattcccccaaagtttcaggatctgacactactagagtagcggtgaggagcaaaggccggtggtggcagggttcaacctttcagtttactgacttgtatcggctgtcaccgaaattccgaaattttagaaattttgaaaatattgtgaaaatttcagacgaaattttttgaaaaaatttgaattcaaatttagaaattacggacgatggctccggaaaatgaaaaaaaaacagatagcaacaaaagctctgttcggcaggcatacaagctgcagctgctgcatcacaaattcacaaaatacatccaaacaaacccactgacactgacagtgacagatgataaaatgtaggttcaaagtctgaacagcagcacatcaacacatcagccaaacgcacccgctgactagcagcacagcagatagtgaaaacaaacaaatgtgaagaagaggataattacgaaccccggaaagccaccgtcacccggagtgtggcagtttggctggcacaccgccacccgcgcgcagtggcgcagcttattttccacgtcgctgatggcaactcccatactgctgccccatatccttccagctgagacttagtttgcgggttatattatatgtctcagttactataattcatgtcataatagcaacgcctgcatcatctgtttatgtaaagaatgggggttttatgcttcctttgtccaatcacgttgttctatcttccttgtcctcgcacattgtttatactccattaactggtcaacttccattgggtggcctctttcctttttctagagaatagattttcattaatccataaagaatatatacaaccaaaaagatataagagcacttaggctctgttcatttgcctgggttgggaacccatccctccagcacggaaaacggagcagtccattagcacgtgattaattaattaattatttttttttcaaaaatggataatatgaattttttaagcaactttcatatataaactttttgcaaaaaatgtaccgtttaccagtttgaaaagcgtacgcgcgaaaaactagaagggggagttgggaaaaggggaaacgaacttaaccttatacacacatctcaacaagaagaagaacatgcacccataaaaaacaaaaaactacaaccccggggcctgctttccaacatcatcttctgaaatggccagatacgacgagtttaagtcacctagtcaccaccgcccctactgcgcagttgctgcgaaactctgctggtgccatcttcatccgcttcaggtgacctgacgccacacgccgccggttagcacaccttcatccgccgtccatcgtcgttcagtcataactaactgaccaaacacgagccgatgggatccacttccacttcgccggattccttcaccacccatagggctgtggggacacccaatttaggcttggtgccccgaaaatccactcgtgatcgtccaggatttcgatgacgcacagattgatatacagaacagctttcaattatttacacaaatttgtttatacaggctaattatacaattgttaaagggtgaaaagatccaaactaatacatcattatttgaaaacaaagaaattcaaaagtgctaaactactaaactcctaagctctttaactactaaaactacagctaataaactccaaagaacttcaaagaactccacagcaaaaagctcgagtgtagactagcctagaagaaaaacttgtcgttgccgtagatctcgcttccttccagacttcttgttagtttaactatatatcaatttatgcaagggggagtacttatgtactcagtaagacatattataaataattaaggtgaagagatatgaatacataaatcaataagaaagtaaatgagtaataaaatcatatatcaatcttatcctcaaaacttaaattttaaaactacttatacttcaggagtaggaatcaccctgatgacacaactccagaaccgggagtacggcacattcgaatgatttaatttacctctgcagagactgtccagctttacccacacgatgcccacagctagctaggctgagaacaacagagccgttcgaaggtcccacttactactagttactgcacgagtgggatattgatcagtcctagcagtcgggcacttgctgggcctaagcaaggctacttggtcgctgctttcatgggttccaccgttgtgaaccatgcccccaacctccttacgcatgcgttcaccccaatcctgttcctagtgagccaaccaacagtctttcatatagtgggacaatgtactaggctaagtccaattacttgatcgtgtggatggacgcaattatgtcatttccatggtataagggggtaattataatccggttaaaccacccaaaacattccaacctccccacaccaataaacttcatcatatatcaacattcataatcacaacattcacaatctcaattcataaatgcaggggcgaagctatagcaagttactggggtcagtagaccccgatgatttcttctgagtcccttatactcctttttattttacagctatgaccccggtcaaagaaaacactagaccccggtgattgtttcgttaaagctcaactggtggcaaggaacgataccattatcagctagcaaatagaaaattagttagcaattgtgattatatatcagtctacatagatatacatatacgttttagactggcgctcataaagtggcccttatttaggattaattgctccagtagccaactaatcctattattatttcttgattatcatcacaatttggttgaacctagtctctcaagtctgaatttgaggaaattagagttttgcaatataaacgtctgatttttcaagttcagttacatgatcatgaggcatgagcctgggggaattgttgacgaaaaaatcgaacacaccggcctgggagatctgcttagctcttgtgcaggtccaaaaattaatgaggtgcgggcgtgccagtcagtttgatcctgcaactgacaagatatgtaaatggtagatcaaaacagccgatcggctgacaagccgatggaatagttccagccgatagccgataatagccgatgccgataccagccgatagcgatagagtttaagcaatcggctatatgtccaatgtagataatgatataaaggcaaacggctgatgatgatgtaataaaataacaatacaatccaatataaaccaatcggctatcaatgatatgataaataagcatcgatccgaaagttaaagcatacatcggctgcaggtccgatgtcataaaatccacaagattatattaaacaattaaatcttattgcgatcggctaaatccaatatgtatgcagggggatcc

SEQ ID NO: 14947 - DNA, 738 bp, Oryza sativa
cttggctattccctccaagatctcatagggattaaccccgtgctttgcactcatcgtatccctattgaccccgagagtaccccctccaagacggctcaataatgcgatgcgtgaagttgtaatgaaagaggtcctgaaactcctatatgccgagattatttatcctgtaccatacagtgagtgggttagcccaatccaggttgtgccaaagaagagaagaatgacggtcgttgcaaatgctcaaaatgaacttatcccacaacgaatcgtaaccggatggaggatgtgcatagactaacaatgctacgaaaaaggatcattttccgctaccattcattgacgaaatattggaacgcctagaaaatcattcctttttctgttttctttatgggtattccgggtatcatcaaattcccatccatccggaagaccaaagtaagatgacgttcacatgtctgtacgacacctaagcttatcgtaggatgtccttcggactatgcaacgctcccgcatcttttcaaagatgtatgatgtctattttttcggacatgatcgaggatattatggaagtcttcatggatgacttctctgtctatggaaatgatgtgaccatggctactacggatacatccgttgctcaacgtctcgtacggttgtagtcggatcgtcaacgtttctccgaaatcgtagttatcatcaactcacagaaagatcaggccaacaacagccttgagtgtc

SEQ ID NO: 14948 - DNA, 165 bp, Oryza sativa
ccctggtttcgaatcgagcgccgggctcttcggtgctattttttacgccaccataaactcgaagacggtggtcactcccccagggacgaaaaagacggcgttcgagatcatgaacttcaatgttcgccccgagcgctctgatctatgcccgatcaacggcaccat

SEQ ID NO: 14949 - DNA, 342 bp, Oryza sativa
cctacttcctgttgaggcgagcccaactccaccactcaaccacgaagctaccgcacgcccccttcgtcaaggggtgggcaaggcgggagccggcccacggagaggactacccaagcctcgatcactagggtagttcttccttcactccgaaggtggtgaactccaaaccactcacaaaccggcgccgggccttctccacaatcttttcagagaggtcaccgggcaactcctccacaagccgtctagaaggcggcaacttccaagagtaataagcaatgacccggcatggagatgatcaatcaagtgccacactagctctacaatggaagcaatgcacttgac

SEQ ID NO: 14950 - DNA, 907 bp, Oryza sativa
ctaaagatggtactgaaagggaatcttggacaataatgtctgctgaagcatcacggataattagttaagcaggccttccggtgatggtgctgctctaatctcaccaccagtcgtatctccacttgccaatacatggttctactatgtttgatacagggagggaaaaaaatggatttgctgcttggactaagattgaaaacccatttttttacaaggtagaaaatggcaccacggaatccccgaagtccaatatgatgttcaactcagttgacaatagttctgcccatggaagtactaacaatggcaatggaaataaagcacctcttgacgaagagaatgaagaccttcttgcagattttattgatgaagatagtcagttgcctagtaggttagcaaaaacaaaaattgtgaaaggcaattcttcccattggaaggatggggacatttcatcacagacaggatcatcgctttctttattaaggtatcaaatatgccataactttcagattgttcctgtaacataacttcctatgctaaggtgtgatttcttcactggaatcaggatgatggataaatatgccagattaatgcaaaagctggaaattgtcaatgttgagctttttaaggttagtttaagtcacccatcggaagatattcgacatgttagatatttcctattgttcatggctcacaaaattttcagggtatatgccaacgtgttggcatcttttatcactacatatacgagacatttgggaaccaggacaggggtcaaagtggcaagtctttacctgatcattaatcgtgtaagaattaggtttgctctgtgcagttttttatgattcttttctattgctgcacaaatgcaattatacttttgagtcttaaatatcctttgtgacgcttg

SEQ ID NO: 14951 - DNA, 629 bp, Oryza sativa
aagcatcctatttctaggtaaaccttttctgttcaataactccaaatgcatcaacataggtacctgtatcctatgttcaaagcttccaatgggaaacaaacctttggtccaaaaatccatttatcactaacaaatcaaaatgccatgcagctagatttgcaatcacccactaaatctatccacaacatatccatccatcactagcaacaaatccaaatacttgccaagtcaacacaatgctgtgcacatcgttagacttatattacgtgataaattatgcatcctccaaacaatccaaagaaggggggaagtacaaagtttccttacccgctgtgtgtctctatggcctccatctggcggagtacaatccagagccagaaggtgatcatgtgaccaggtgcaagcgctggcccgacaaaggaggggatgccgaggatgagcacctcagcccagtgtgcatatggcgcggcgaatccaatgggtgccgtgaactcatggtggacacggtggatcttctcatagccccactccccatgtagcaaccgatggatccagtagttgaggtagtcctcaaccaggaagtacaccagcagctgcgccgccatctcccccagcgacggcagtggcag

SEQ ID NO: 14952 - DNA, 2278 bp, Oryza sativa
ttgtatatagagtatagatatagacaaaagacatgaagacaaaccaacttctcctttaaagatttttatttactaactgttgccttagcctagaggacagcaatgggttgaccacatgtagtgtcgccctatccatattacatactggagcaacataggtcatggattcatggccttagatcaagaggctatacaaatactacatgcataagtaattattgtggaagaaaaacagagaatatatacatccaaacagaaatgacaattatggttatcctgccaacatgatcaagagaggttgatagcaagcggcaacattaggatatacggtgccagatactcattttctttatttatttaaacaagacaactcaaacctgctaggaccacggcggctgtctctcctgtatggcgcatcacggtatgaggtacgctcagtacgaatcctgcggtcctttggtggcgggctgcggctgctcatcgtcaaaccttccttctaaatctccaagctccaaccaaactgcgaacaccacaccacaaaaccagcacctccaagactcccacaacctgttaggctgttacaaccctcccttcttccttccttcctgtccacaacaaaaccacaggctgaattccagctccatgagcccaaacaacagcaaccatcctttcctaagcacaggcccgaattccaacagtagggcaaacgactctccgaatgccccaccttcctccatccttgattactacaaacaaggaccatcgagccatttgctcaattgctcatacacaagatttccctcctagtccccccaacacaaccgcccaatctacaacaaatcatcatatctttaccataggattcaagttcaacaaccatactacctatgctcccatattcctactgcttcgactattccacaacctatgctcccatcctactgcttcgactactccacaacctacgctcccatcctacaaacatgcacgcgcgctgaaccacgagtccacgaccaatttgcgagagcagcgaacgaaaccctacctgacgagcgagcgaccaaaccagtaacagcgagcggatttacagatactaccgagcaaatcgatcgatcccacactaaccgcacgaaacctcgtcgatagatttgatttcggctcgcacatcagcggcagattagggacagacgaaaaccaaccccaggtccagggcttaccacgggggtcggggggcggatctccagcaggcgcgaggcggacgaggagacgagctagctagccgcggagcggcgagggctgctgctcccgtggcgctcgccggcgcagcgcggcgacggcgaggggggtcgccgagtggattgggataggaagaggaggaaaagcgtggcgtgcgaggtgccgaggtctcgaggaggaggaagaagaggacgcgtcagatccagagctccaccgaagcgagagcacgtgcgttttatggctgtccgatctcgaatggacggtggagattactcgtaggtgttggggattgccggatttggatttgggccgtgagaagaaaggtcggcgttgctgcagccgacacgagccatacatcccacggcccaacaaggaccaagcccaatacgccaaaattggtatctaagtactccctccagtccaaagtgatgaggttatcctgatcctccatatcatctggtatccacggtattaaatatatttttacataagaaaaaaaattgatgtggcaagagagttaacaagacaaagtaaacagatgaataaaccagttctcatgcaagaaaccatctctaagtaaaaaccaaaaatgaatgagatatatagataaaaggagatagaaaaaatgttattggatgattatttaatttgaagagatcatcttttagatatatatagtttctatacatataaaaactaattgatggtttctgggttgcatgtaacatatttattagggtgatacaaactagtgatctttgagttaagagttgtcgtggcttaggccatccctaactctgaaactatcaaataattattatacttgtcatgtcatataaactatatagaatatatattcaatagatggtgtttttaaattaaattcctatctaatcatctctcttctactactatcttctttcattcaactatcttcttattttattcttggttcttgtgtagagataatttcttgcatgagaaatggttattcatcttttttacgcctctcctcgctaaattctcttgtcaagacactaac

SEQ ID NO: 14953 - DNA, 423 bp, Oryza sativa
aatgaacttggtgcttttaaaattatttcttgagctccgaaaattcacggaaaattctagagagtacattagggcacaaagaatattacagaatattctcggccaatgatttttaaaggaaattttaatttactccataattccacttgattaaattggtttaacttttatttaatttctagaaaatgcattattaaatgatttttaatcccgaacgaaaatcggggcgttacagcacgccacgtggacgatgacatggatttttattttattttttctcctttcttccttctttttttctctttcttccttgtcgaaaagatgaaaatgcctcatacacgtcatcgtcctttcataaaagagaaaagagaaggaagaagggagaaaaataaaaaaaatccatgtaatcgtccacgtggcatg

SEQ ID NO: 14954 - DNA, 629 bp, Oryza sativa
tgtgtataagaggtgccgtgatattttgtttagactgctgcgttcccacagcacatcttacgtggtgtgatggtgtgttccagataacaagatccattggagatgtgtatctgaagaaaccggagttcaacagagaacctttgcatagcaaatttcggcttcaagaaactttcaggaggcctcttcttagttctgaaccagctattgttgtacaccaattacagacaactgatcagttcatcatttttgcatctgatggactatgggagcatattagtaatcaggaagcagttgatcttgtccaacataatccccgcaatgtatgtgttcttatcttatgtaaattaattatttcaatggcgaagtgcttgttcatattattgcttgtccaataaaagaaatcttgatacgtttttgtaatagttacatgctttgattgttattatcattagggtaaatagatgattggatgtcaattgtctgagaaagtaagaagatcatgttgaatatctttagaacttgctgttctaagtttcttttaaatgtaccaaatattcagaaagaccttgttaggtatatgttaatacgatcccatatgaaattatgaaggcacctttacattgtgagtt

SEQ ID NO: 14955 - DNA, 1896 bp, Oryza sativa
  unsure (1)..(1896): unsure at all n locations
ggtgctgacttcccacaaacaaaagaaaaagaagtcaatttgcatcctcatctccagagtataaatcactcgaagccccgaaccaagcccaaattgtagaccataaaaaaaaaagaaacttctacctttactgcactctttggtctgtttttttgtggcttgctttggttacctactgaggtgctaatcattgagaataagactcttctttggtcgctaaattgcttgctttggaaaggcctcattgctctgacagcagccagctgacattgcccaacattctcatgctctgaatagatggctatgatacagcaaagtaagcgccaccatagtatatttgaccagttgtcagtactccatattaaccttacttagccttgaattggttttgtagcttgacgtagtactttcatctattcactgaaacagagatgcatgtagtatggtcattgtataacaagacattagccatgtgaataatgcaacagaaaaaaatcaaatacatgagaataactagaaaatatgcatgttgtattaatgaagaagaaaagaacaaaaaattgcacttattgtcatctttgatctttagtgttagtttggcatgaatgaactattggatgccataccataccctatacacctagtgttagtttggcatgaatgaactattggatgccataccctaccctatacaccagaagaagcataaaacatacccaaaacaccccagttgctacttgaatcagataaggcttacatatatatggaggaaggattaaaagtttaaaacaaggtgggggtcaaggtgtataatatgagctcccctttcaggcaatgagtgtacacaaattaaatactacgacaacaaacagagtaaaagcaaacaagtctgggaagtatataacatcagtataaaacctaaagcaaaatgactaactcagcaaaattcagtatcagcctcttacagtaactcagctaatttaataggtccacagatcgtcagaccgtcactacaataacatgaatattaggccatagaataccgcttacagttagcataatggaaagcaagtaaactaactaaataaactatagcatttcaatcgagtattgaatatgaaatggactattgaatatgcaggactgctgaatgaaatagtataacacaagtttatgcagacaatacagagtgactgaactgttgtgctctgctcaactaatgattaacttgngaagtaaaaaatagatgtaattacgatagcaagtaatctgttaaaaaatatagggcgtattttgtttcgttgggataaggcattaactagtaggtactttcaatgtgaatatctaataacatcaattttgtgtcacaaagattatatcctaatagagtaattgttggtcaaagtcttgtcttaacaaaacagaatacgccttatatttttttaactgagcaagtaattaactaaatggtaagtgacaattcagaaaatataatataagcttgattccgatcgcatcaaatcaccattcctcatcacataatagagaataaatccaaaaaggaaaaaggacaatgagcaagagggcataaaacctctctctagcttcatctctatgacactcttgacattgacgttccgggcttccaaaagaccaaaacccacaagcatcacacttttttcataattctgaacatcatagaaaccaattgataatactccctccgtactcgtaaaggaagtcgtttaggagcaacgacacggtctccaaaatacagcattgactccttgtttctataaaaatatttattgaaaattgatatatgtatacttttatgaaagtatttttcaagacaaatatattcatataatttttacattttcaaactcaacaact

SEQ ID NO: 14956 - DNA, 4767 bp, Oryza sativa
ttccaatggttttggtcccacgtccaaattctttccgagtcaatgggaattgaccgaacaagttggcgtcaagaatctgtcccagtgctgcgtcacggtatttgggcctttggcccgggtatcgtgttggaacccattagggttgcgtcgagaggggtttgcacgaccctatgctctatatgtcggttccccgccaccatctttaggtttttgggttttgcttaaattaatctgtcgagaacagtttcgcagctagttcggtttgtaagaccccaactcgtgagcttaatcattcatctgcaattttggttgttttctatctcgttcttgtttgtgttcttcgattggcaaacagggattagccttctcggcgaggtcatctgcgtttcgacacgggtgataaccagaggagacatggtgctgcgattgcggggctcaagagcgtgcgcgttcaagaagccggatcgatttgtgtcgctactccgcccaaatcgttgtttatcagaacctttcggaagatcgggaaccctagtgcacatcagtatgttatactagttctagagcacaacataaaacactattctggtgcagaatctggatcataattcaagaagggctacttacaaccttggaggagatactcaaaagaagcggtactatattaccaaatactaaaacaacacaaaatcaaatcatattagacaaggccactgcataatcctttgaatgtatgaatgaaaatttctttagcaaacagaatgttgtaaaactactccaaatagctttaaacaacccaagtagtcccaaatagagtaaaactgttaatcaccaaatgacagaaatttcaccgcagataaaaatttctcactttcaattgaagaccagtggtaaactctatctggtgcgcatttccaaaacactagaaatttcttgtctagagatggtgcaatcaacatctcacacaaacagataccaaaacaagtgtaagttcaagaagaaattaatgattagtcgatagcacataaaaaggaacaagaaaaaacaaggaattgtaagaaaacggctagccatgtgaattatacaagaagatttcagaagccacaacaagcgttggtttgttttcataattattaagaagcctagagatcagtagttaatctgcaaggaaagcggtagttaatctgttatactagttccagctacacaacatggaatactactccaatatggaatcatgatcctcggcactttgatttgaaaagtggcatctgtaatctgtttactccttccgagaagctacacaacgagaagtatactagtactcctatacaacactaatactaaatactaaacacaaaatctattgacattgctttgcaagacagtaccgttgtacaatcctatccaaatcaaaacgcaaaaaagcttgcttcacgaatatgagaaactaaataacgacttcaaacagcttaaaacaaccaaatcacaaaactacagaaaattcaccccaaatgtatgtttctacaacttttaagtaaagatcagaggcattttttgggtgggcgtcaaagtatcttgtttatctccaaaaccctagaaatccatgataccctatgaaactaagtacataagaatatcttatccctaactcaaaattaccgcttaacacatgattgaatggtccatatccttcagaaaactctaaaacacaagcacataattcacatgaaaatttgcaggctaaatccaataccgatgatttcaccgaactatagaatactcactttgccattcgctcaggaaacaccgtaaaatccacagatcctgaattgagagagagggcgaggggaggtagagcaccttccagagcgcgtcctaggcggtggaaaacccggaaccgaagaggaactcggatacctcggcgacgagcccctttctcgcatagcacgtgcctggaaacggcgtggtcgcggacgacgacgaaaccgcgcggccccactcgaggagagggaggagggagaacgcgccgccgaggaggtcaccgcacgccgtcgagctcgaccgacgcgatgtcacccccacaccttatgcggccgtccaccgacaggagaagcgccatgatccggtcgccgccgccgccgcctctggcactggcacaccgctcctcggtgggggaggcatgcaaggggcggaggcggccgtcgccgccgcagccgcgtggaggtggccatcgcggtggcccccgcgggctagggtttggttgatttgggattttttttgggactcgcccgatttgggggaagagacgaggcaagaagagattgagagaggaagcggaagggaagggattgcagtgcggagtgggacccacctgtaagcggcggaagcgcatggcacagggcgcgagttttgaatgctacggggggcaacgcggaatcccgttctagaagctaggaagcatatgggccgaaacctatctaaagggctaaagggaggtgttatttcggcccatagatatgttagttgaaagtttttgggattttggattgaatgaactttttatagttcaatatgaatgtttgaggacgcaattgaaagtttcatatgatcttgagttaaaagttgtatgatttgattataaagttttgtagctttcaagttaaagtttcgaattttgaattgaaccttttgtaaattgtaattcaagatgaaagttttttaggctatggcgtgtatgatgtgagttgaaagttctgtgaaaatactactaaaagaaagaccaaaaaaaagtgtgcgctacgaggtgagtgtagctcaactgattaggtttcttgtgatggaaccagcctatcagagtatgcgaggtgtgcgtgtgtgcattcataggggtaagtgcgtgcgatttgtgggccctacgtttgtattgtgtttcaaaaaaagagtgcgcgctaaggtaacatgtgcattagtttgcaatctccgatatcatgaggccataatgaatagagtatataataaagtctttcttgtaggggtgtatttacattaagatggacaagagtaaaacaacagagaaaacatatgtatagagagaaaaaaaagaaaacaagctggagaagatcatgaaagtgccttctggaccatatataaaaaaaagattcaaaggatttagtattaaaccttagcactccactactcttctctatagaattctgagattccatacgtccactggagtattttagatatgccagcgacaacgacatgtcagttcatcatgatcacgcataaaagtagagtcagagtcaagagaaaaatgtcttaagttatcaattgttgaatgcctaatggaatctccacttcaagtaaccaagatcaagttaattagaccaagatgttaacataaactttgttttagtttacgatgtgcagagaccagaagttatcacttccatcgcgtcaaaaggaaattgaactggcctttcgaaaaataaatttgaacgtctcattcaggtgtgcgtgcggccgtgtaaagtccttgtccagcttgtgaacacatcatcgaaaaaaggaggaggaaaagaaccacgtcgcattcgaacgatggattttttacatcaaaatacaaaaacttgacatggaagctgatgtgtatgtcagagtttctacctccttttttttcttctttttgttctttgttctaactagaaccaatgcagcaaagcttgtgtatatatccatcgccttcgcgtttttgatttgtaggtggggtggcaacgtttcattccattgcagaggtcataggtggataaaggcacgccgctgttgacagtgctacctgggcccagtggcagtcgcacacccatggctctccattgcttgggcccacagagaacgcgagtgaaggctgatgccctagttttttggttgataaagtgatagccagggtttacaatcccgaccaaaaccagtcgaattctacgaattttcgatgtttcaacatggctcggtattaagtttcgattgtaatttcgaatgttaaatagtagatttgggttgtgtttagtttccttcaaacttccaaaaattctgtcacatcaaatgtttggacacatacatgtagcattaaatgtggacaaaaaaccaattgcacaatttacatgtaaattgcgagatgaatcttttgagcctaattacgccatgatttgacaatgtggtgctatagtaaacatttgctaatgacgaattaattaggcttaatagattcgtcttgcagtttacgggcggaatctgtaatttgttttgttattagtctacatttaatacttcaaatgtgtgtccgtatacttcaaaatttttacacctaaacaactaaacacggcattggtcaaaattcagtcgaaatttatcgaaaaccgtgataccgatggagctcgaaatttagtggtcaaccgataatgtaaaccctggtgatagctatgccaagatttacaagcaagctaataaatagcgttagcggccttttgtaggatcgagatgtcaactagagggggggggggtgaataggcgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacacttctatgtcaatgtttagcaatcctagggtgatatgatctcaagtttgtctctag

SEQ ID NO: 14957 - DNA, 1768 bp, Oryza sativa
ctgaccgaatacggctccgtcggctttgtatcggccactccgagcagcaccatcccggcctccagggggccggtctgaccgcgcatgtgccgccggtcagatcggctttatgcgccggtcagaccgccgttgtggcgccggtcagaccgccacaatgtggccggtctgaccgcccttggtcaggccgagcccagtgaaagggcaaatgattgtgtgtgtgtgatgaaaaagatagcaaagtgaaaatgcaatgacctaatgtggcaatttaatcatctctttgctaggtcattaccccccttgatagtacggcgaaactaacaaataaactagcaaatttgatcgccctacacctcgatcaattctaaattaaagcactagttttaccgtcttctttctctttgctttgcgccgtcaattttaatccattgataatcatccatgcgcacatatgacttggtcctaacttaaaatatatagctcaaagacaatagttaatccccaattagtgcttgtcattaattaccaaaattaacaatgggggcctaaatgcttcacctttgccgctaccgctacaagagagcagatcgaagatagcgtgttcgaacttagaggctgttacaacgtttcaccactgcaatagcatctcgctatagcgcttcagtataaattataaatttttagttaaacttgatgtacaatgtaaatttatagttatttgaaaaaaatccgctattggaatttagtgcccgctatccgcaatccgctaactagacactaattcgctactaaccggctatatgctagtatttatcacaagatatttcaattttatttcaaatcagtacaagttaatattcaacacgtgaactggcatcacaattcgtaatacaaagtcaattattagatcctggatagtagacgtatagtcgaaaaccaagcagcaaagctacaaacgagttgaatttgtcgacaaactcatgcacaccgacattggttaaaaagatttggaaatttggaaaataaattacacatgtaattattttagtattttcttgtctaccctacaacagtatcctacgttgaatttcataccaattgacttatggccagctggtaacgtaaacttcttcatgcaagtcatgtcactacctccaatagtatctacaatgccttgataagttgcaaaacttgccgtttgatcttccgttaacaagttagaaagtcaaatttgatgattcgtgtctctttgctactactacatgccatcccctgacaataacacgtaggatcctcgagtgaacgacatcaaaatcagaatgacagatcatcaaatctccgtagtgagtgacaaatcatcaaattgagacgattttcacgttaagacgaaaactagaccaagatcattattgagcgatataatatggaacttttccgaatatgaaacaatatttttacgagaaatagtctcttcagtagttttgtcgttgtaatcaagccgtgaatatatattccgcattcattcgtcctgtaacttttgtgataactgggtataacttctttgaaacaaaagtcggaataagtttcattatctaagaaaaatatatcgctataacttctttaaaatagaggccaagataagtttcattatctaaaaagaaattattagaattttgcttcaattcaaatttgcatggttagcaaatgccacaagcaaaacgaggctatcaactgcgcaaatgccacctatacccaagataaaaactct

SEQ ID NO: 14958 - DNA, 4171 bp, Oryza sativa
  unsure (1)..(4171): unsure at all n locations
atacgagaagaacagaggnaatagtagccggcggcgaggcgcgctccggcgagcgatggcgggggaggcgaggggttgatgacgtcatgatgacgcacgcatccctgggttgtgcaggtgcagctaacttcactaggtgagttcggtttgtagcttcggtgtggcacactgacattagagagatagaagggattaaaattaccccatgtttttgcagcatttttgtgctggtttgtgtaaattcgttttgaaatatatccaaatgctccttataatcaaaattctgcagcaagaacaacttggctctttgatcaagaaatggttgcgaggcatcttggtatttcatttctctaaaacacgccttgcacgttgttaattccagcatggtaggttaagaggcaaaattagagggaagcatcagaaaaagggatcaaatttaaagacttcgctgtaatcaagctgggggaatataatcaaccaccaactttagctggagaaattataagtccagctaagtattattcccaagtacatcatcattaggatctgtctatatatatgacacaaatatgccgttagagacagcatacctgaaattgagaaagaagtctcctcctctggtggcaaaagggggcaagaatcattgccttcttccccacttgcccctcaagattataatataatcaaattgtcaagttatttggatagagggtttggtggttgattggattactacatttccataacatcacaagtccaggtataggatttgccaatttgtcatttgcaaaatattcaagatggtggacagtgacagctccaatggaagcaaacccaatttctggggttttgggccctccctcttctccccctcgtggcagctggctctagaattggtggtcatcctccagggtatgtttacctgagcacctccgcagcggcttcgactccttggtactcctagtctcctggcagctgtggaaggaacggaactccaggattttcaactccgcgctcgctttgatcgcagtggttctggagtccatccgctcggagggccagctgtggtctttagccggcgttactttttttgggatttcttgggagtgtagcgtggctctgccccgtcccgctatttggagttgcgtttttaaccgtcgtagtagttcctagcttcaagttccccaccccctttaggcataagccagtctggctgattgctttgtgcaacaaaaactcttttcctgataatatattaacgtgcaattcttttgcgcgttcgcaaaaaaaaggaagcaaacccaatttgagccatcttatttcatctttcgtcacttacacgaccgattcatcttcagtttcatgtatttcctgtctccgtcaaaaatgatttgtgtattataaccaccatctgttaaacgtcaagcttttgcaagatcaatgctagaggctccactatttcattgcaaaatgtagcagtgggcaaagtatcaaggcttttatcatctgattattggcttatcagctgtagccaaaattcaaattttgaaacataattttagagtaagttttacccacaaattgtttcggttgcttaaatgagcctacctacagcctggaggctggagtttagcgtactaggcacgatgacacgacctaccaacaaaccaccgttccctaccttgctcgtcatgttgctgttcaatgttgatatgcaaaaggaggcaaaacatccatgtgcatttaaggtccatacaccgttaaatgtcatcaaatgtatattgaaattgaggcagactttcagaattctaaccaacaaactcaatttgtgttcattactgctacatatttgcacgaatgacaaattcccacatcctttgtacttcaaatggatcaggcaccacatggtcagccgttgacaggagcaggaatgcacaatgccaagaagggccaggcgacaacgatcgccgtcacggccatcactgacaaaattgagaaatagtactagtactagcataataaaccaaagacaaaagacaatccttttctcccagcacggtcgatattttctgcaagcaaaccaggtgacatccagtccaggcaaatacagagcattcgattccttctgcagattgcgatgttctcaacatggcaacatccacaactgtcgttgtttggcatcacaaatgatgataacaataataaaaatcgtagtttgggctatacaatgattgaactgctttgtctaaaattaccatgagaggtagaattcttgcaggaactagatattatatgtaaacttcatgctatattcatgtaaaattcctgcgtttaaacaacggtttagaaaaaacccaggcgcacatgagactgattattcatgctctccaataacggatgaaccatgctttacttgagcacaagaacaagaaaattggtagcttttattcagtcgctatatccttggccaaaagatcagtaattgctggaacaaagaatcgagtgtgtatatatacgtgaaaaaaacaatagcctacaaagtgtagagggagatgaactatatgctacctacttcttacacataattcacccaaaaaaaagctacacttatcaacaattaggatattaggttggacctgcataaaggccagggtgattccagtggtcatatgaaccaataattttactctaacttacagtgattggtcaaaaatgagttatttcttaaccttgcagtgagaatctccactgttcaccaaggcctcagccaaatttacagtcctctactctttggggtagagcctttagtacagtcaggggacatcatttagttctgcacttgcttgcaattattcagcttcttgcaatttgtagccgccaaattgatttcattcttcctgaaaattacacaaccgtgttgttaaatggacagggtcacataatactgtcttgcagtactcacctatttgggtggataagtacagaattaacagtgtttcctgcatggacaagggatttccttaccaccagcattcatgatattgttgagctgattaatggtgtaaatctatggctacgaattatttgagaaaatctactagctttccaaggtcaacataataatatgggatgaatcactaaattatgggtccatatattcatagtgctatgctacaagagtaatttgtaggggtaacttcctcatgtacagacatacagttcatgaataagttgtaagccggcctgcaaatcctgataatgacttggctcattttaggtgatgcataatacatttttgcaaaattatgtttaaattgtatcaacactgtatcatgcacccacattgatgctatccttcaaatactgcatctgctgagatatgtttgatagcacaatataaggtacatgttaaatggtggaaaatattcatcagtcataaacttacattgaacattcatgttaatgctatctttccaaattgtaattgcacatattcagatttctgagaagtgagaagctacaaaatacatggagtacctgtactgtgagggccttaccattatggcacccaccgattccctatctcactaaaaccaccgcccctttttgcattcgctgttctgagctccattactaattcttcacgctgcgcctctacttctgcatactgcaagctcacgttgagtaaccgttcttgcatatctttcagctctgactctagttgtgatatcttggcatcatcattctctttgacatccttactagcagatttcccctctggcattggactgtagatgataaagaaaaagagaaaatgatcctttggaaggtcgcaatatcactaatcgggtcattgaaacattttggtgagatattatttagatatagaagaaaatctcacaggctctgcatcaaaagatgcacaaagccataatcttattaaatcaagtctgtgcatagcagattgaaaacaagattacaacaaacaagagtttctgtaaaagattgaagcagctctcagcttattacgaaatctccatctgttgttcttaagaatcaattaaaataattcattttggtgagctataagaatttgttactaggggtagaacaatacaggagtaattaggcattagaattagtcccccaaaaagatcttcacggattggat

SEQ ID NO: 14959 - DNA, 1471 bp, Oryza sativa
ttattattaaggacgacagcccatagctctgatgagtcagaacctggggcctaaacaggactttggtatgcaagggatagcaaatgatatctggtggacaacgcattttgctagtaaaaattgtcagaaggacaaggcgtgtagatatgatgaatcactgtacctcttcagttttttttggcctctatacaatttattttcctccagtgcctcagcaagcctagtttccagtaattggatcctttttgactgaagctctgggacctcattaactggagaatctccattttcattagcatcattaccctaaaacaataagaaaacagctgattgagtttatcacatttgatgtactttaccctgttttaaaactggttctttacaggcatagagatttccacagttgattatatttaaatggctcacctgtttattggtattttcatctttgttttggcttgtcttcaggtcaagctccttctccataagctgatttctccttgtgagatcctcattttccttttgaagagaatgtattttttgttggtattcactgttagctcccctgataatacttagttcactttttagctcagcttcaagtacatctgatgtttccttaactggtggttcatctcctagcatcacaagctttgtttgtgcagagatttcaatttgttttccttcattggcagcattcaaagtgtcctgcatacatgagaccttgtctgttaacatccccttttgtgcctttagttcttcacattcttcagacaatgattgaatcagcccttccaacttccctttctcaaacttagcttcatcaagagaactttgtaatgtaagaacttcatcttggaggcctgctattttgtggacctggattttcagtacagaaatttcttcaattatctgctgtttctcataatcactggatttggatttcaattctagttcacacaaagttttccttaagttatcttcattggatctagcagcttctatcgatcttctcatattgtcaacatctgtagtgagcatttcctcattctgtttggatgcattaagtgagtcaactaggtctttaatcttggttttagactcccgcagatcttccaattgagactcgtaatgtatcatctgtgcattgacatcttcaagattagcctcaagtttagccttgtctgctcgaaggatggaaacctcacggatggtatccaatgtggaactttctcgctcctcttctgttgaagataactgtgcagtaagactaataacctccctctcaagaaagcgggggaaatgtaattcaacagtcttttctttctcaatcttgtttaaaagtaaatgtacacgatctatcctttcttcatgctccttgtgctcttggaatatattctccagctctgaaagcaacgattgctctttcaaagatatgtctttctgaagtgaagaaagttttgcctttagg

SEQ ID NO: 14960 - DNA, 1424 bp, Oryza sativa
ctagatatgcattttgagagtttagggacctatatgacacagccctataaatttaaggactgccaatgcactttactcctcaaaaaaagtacaacaagatttccttagatttgctatggtgtagtaaaaaatttgacagtctcaacttaaataaacgtggtaatttttattggtaagtggtggtgaagtgggtgagaaactatcttctgttcctcatttggaacggaggattcctagaaattttggaagaaataaactagttcatgtgaaaatcctataaattactgtatttcaaagaacccttaattgactgtagcggccaatgtagaaacacaaataatgatagatgaacccagacttatcaaatatataaaggtgtagctttttatcaaatcgtatattattattgcaattagttaaaatattagttaaaattgtagcaaaattgatagttttgataaaataatcgtagatttttaaataaaccatatacgcatttgttcgaccgatgtaagactaaaacgacagaatgacgcaatatgtgaagcgtgagatggcagtatgacttggtcctgtatatatagtcattgacatcacacacacattacggtcatcctataattaatcggacgtgttggtcgtgtgtataatattttccttttgaaatttactctttaaaatatagaataatctaggttggcataagcccattaattaaacagtgtattttctgaacaatgtgatcgatgcgatgcacagtccagccagcgtgcacgagagcagtctagcacacgaaagcttctcaaacatattccttcagtgcggagagcgaagtcgaatccctcccgccagaatcaaagcacaaaccgaaagcaaaagaagagcacgacttttcccgccaaaaaaaaaagaagccaacgacgcggcctctctagtagagtagtagtctctacaaagcagagcatgcagtagtagccgtcatagcatcgatcgccagttcgccacagcacaatgccgacgaggaggcgagggatcgcggagggggggcacgccacccgggcggccgtggtccggtgcatcgtcgccgcgatactcgccgccatcgtcgtcgccggcctcgtcgcgctcgtgttctggctcgtcgtccgccccaagcccatcgagtacaccgtcaccagcgccgccgtgcgccacctcaacgtcacgccgcgcgaccgcggcccgggctgcagcgcccccaccgtcaacgccaccttttacctcaacgtcacgccgcgcgaccgccgcccgggctgcagcggccccaccgtcaacgccacccccttctaccttgccctcgccatcgacaaccccaaccgccgcgtctccatgcgctacgaagacagcgtcgcgctccgcgtgctctacggcggctccgagctgga

SEQ ID NO: 14961 - DNA, 10251 bp, Oryza sativa
tttttttttcatatatgacacaattgatttttttctcgaactttgatcaataatatttatttatttagttgcgtacgggttccaatactaacattgcttagagatgccatagcttttctttttaagattgcctaaagttagatagtcaaatttgataccacacttttgctagcaaactacaatcttttttttagacaatgaggtgcggatttaagacgttgaaaagaaaatattgtcataaatgtgacaataaatcaaacgtatgggggggaaatttttataacttagtcaaaactacgtaagttaagatacgtcaaagtgtacccatatcccacatgtaaattggaaaagggtatgactagatcttttatcgaaagtattttaaacatatttaatatgtttgtccatttgtacaaaaacttttagaaaaatacgaatagttaaataaattagaaaaattcaagtacattgtgtattaaaaaaaaggaggtggtatatatactgtcatgctcgtttgctgagagtggcgctcccatttgggagagttgatcctcctattcaatgccttatcccaaaaaatggcattttttacatatatttattcagatcaaactcatctccttttgtttttgcttctactatattgaaggtattgcgccttttttttttgtcaatttgttctggacttctagctagccattgtccttggtcagctgaccttacagctacatatattctttgagtgtggctttcatttcctaattcctcaagtgaacagaatatatagagtaatagctagtagctctttctaatcctttccactttattaccttattacctttgtctttttggtctttttcattgaacacagtgaccaccatgctagctagctcgtcagtgggggcaaaaacaagtagcctctcttcttcatccagaatgtcctgcaggtagccgttgattcagggagacatttgatgtaatgccactaactaattattaccacaataaattatcattgcttgagtatcgtaattaacttctactttggacatgtggacacagcaaaacgtacatagatactctgtctgctgaactacgtacacagatggaagcttctagtatgcgatcatgctaattaatcaactgatcactttgctttgtgtgaagaagggagagtccatcagattatgcaaactgatgaactgatgtaataatcttcctcgaccacatgatacatggtccgtttgacattttgcagctagcattgtgatgaatatcatctctgaatcttcaatgggttcttacgcacacggcactgatgcagagttaacataactagctagctagttccatcatgctggagagtgtgtcagcactaacgtttccttctctgaccggctttctttctttcttctctgtcaactaatttctctcttgcaagataggattatatcgcgccgtcagttcagatttcagaggtcagtctatcttccattatgcttccaagagactcgaatttctttctcgcaagttgaaaatgaaataaagggcgacaagttgtcctgaagttagaataatggtcacggcctatatgaagtctagtggtatatcggtgaagtctgaactctgaagactttcagaagctacaggtaatgatgcacatggagcctgaagatgttggaatgtggcctggatagatgatggcaatcgtaactttgtttggattacgcgatgtgtgggttgagatgacagtaaagtagtgcgatgcggtgtggtgcgtttcagtgcccattcgttcagtttgaaatgatgagatgaactgacgaccatagagaaacatgaaggcgttatgcttgctttcagtctccactatgcgtttttggcaaaaggagagtttttgattctatacaccgatacgttgttcaatgtgctaaattaatctttataattatgcatttgtggagcgaattcttctgaagtagtgaatgagacgactctcctctccacacattgtgcacatacctttggatgtttgcttgtattgctaatataaattctgggacattctcagatcagtgcagctttctgaggagcctgactcgctgacatagagatgggagtcctcagcggagtattctctctgtcaggggagttctcagatcagtgtcttgttcttgggaagaattcgcttctagcacaagccaatttgaaagtctttgatgtctcctaggtgccgctactttctatggttggtcgctctgaataggtgctggatggcagaccatcttcggagccacggcctgtcgcaccctgattgttgtgttctctatgatcaatgcgagaagactatcgatcatcttttggtcgcatgtgcagagtctcatcagctgtggtggattgctcttagagcgattgggcattcagactgcttgctgatcaatgaatcctcctttcacctgtggctttgcgacagccggagaaagatgatcaaggaactccatcaggggttcgataccattgcaaccttggtagcgtggacagtttggaagaaaataaacaatagagtctttaatcagcagagcagaacttgggcggaggttgtaagggccatggcaggcgaatcagaactctggcgtttggccaaagcagtaattcctccattgatagttccaacggatggagcggggtcgccaaatttatctagagaataggcttttgatctttggttttctttatgtactctacctccctgttgttttcttttttcggtctgctttgtacataaactttattccttcttaataaaatggcacgctccttacgtattccaaaaattaaattgctaatataaattcagtctacatttcacacggaacaaaatctgtcccttaattaaaagattgcctccatttcttcaggtcagatgatgcaatctttagatgtgattttaaagttcggtttgaatcaaaatctccatgatctctcctagtatatctacctacagctacttcctcaagagtcaagccacgaccagagatcgtgcatacgttgatagctatatctgacagggttgaatctaagaggatatagatatagatgaaggtcgaacaggtggagatggaggtgttatcgcaggattggccgattgggttactgatggatgtgacggcgagcacagcccggcccggccgggtcgccgtcgccggtcgtcacaggtggttcaattctcccctgtcgcctactctctccgtgtaaaaaaaaaaaaaagacaaaccccttccgtgttcaacatttgaccgtccctcttatttaaaaaaatataaaaaagtaaaaagacaagtcacgcataaagtattaatcatgttttatcatctaataataatgaaaatactaattataaaaaaactcatataagacggacagtcaaacgttggacacaaaaatttagggtttgtttttttttttttatagaatggagggagtacgaggcgaggctacggatgatgacgcagcgcgcgtggcgcagtgggagcgattgcggcggtcacccggtgcgccccaacgcccgacactcggcgcgtcgctgagatagtatgatcttggcgtgtcatcgccggggatctgccctacctagctcgctttgccgatatggcaagtgtgggatgtaactaataactacccaattgtttcctagctagcagaagttactggctaaatgcagataatgtttttgtgttttggttacttctagatgtaagatatttttgtctgataaagtagtacatgttctcttattttcactgtttgtcctaataaaatataaaacgtgttttttttacacagtgcagggagtaaataaagcacaacatatcgagttatttgattgtttttctggcccatccgtctccagaaaaaaaaatcccattttataagaaagacaactcgtccacgtatatataatccattaagtgataaaataaacctgacctctgcatcaactaaacatatattcaaaggaaaaagaaagggaagaaacataagataatatgaatgtatcacgccctgaaacaacgccttcaataaggatccaaagtttgttcgctgatattgttcgaacctaccagaacaattggtattgaatttttatctagtgacatatctagaataacggcttcaacaaataattgacaaacgcttacattgtcaaagctagatatataaaccagataagggattgatcacctcgaagattcttgccaatggatcacgatgcaacctaccgcaaaatactccctccatcctaaatatttaacgccgttgatttttttaaacatgtttgaccattcgtcttattcaaaaaatttaagtaattattaatttttttctatcatttgattaattgttatatatacttttatgtatacatatagttttacatatttcacaaaagtttttgaataagacgaatggtcaaacatatttaaaaaagttaatgacgtcaaacatttagagaagaaggaagtatatagcaattggtcacaacatatgcccatcgtcttctgcccaccaaaatataaccagagaaggaccacacttgtgatcagtcacaattgccaagccaccttgaaccatcctcgaccgatcttctcgatcgcaacgaatgtcatcccccgtgtgactaccttcgaatgattgtcattagcttatagtaggattggagttgagtcatccatctagagaggcaccatcccttcactaacctgtcacaattggatatatgcatgaggcatgtcgttaataactactcatccctttcatattataagtctgtcagagttatgaataccacatatcaaatagtagttgactaaatttcggcaggacccaccacatatcatatcttatatgaaaacaaccttcggatatagaaggagttccacataaggaaagataaatagagttctacatggaaacgacaaggattactcagattgtatccatattggtttccctagttctacttggaaaagggaacacatatgggtataaatacaagaccctctaggaggagagggggacggaacaatagatcaagacacgaaacaataaatcaacatacaagccaacatatgccaagacaagacgccggatatcgacttcagagataagcatggctagtcccctacggtgtctatggatattgataggagagacatagtgttgtctttgatcttgccggatgcggattcgaggaggaaggctaccctgttgtcgactacgagtcagcacttcagaccgccaagtcgacaacaattaaataggctaccccaaatattgtgctggcgtgattatgatgaataagagcaacgaccggcctcggccaacaggagtagggttattacctgacaattcaggggtccgaacctatataaaaatcctcatccccatattttttattacaatctcgcatatatcctagtaccaacgatccccatactatgcaaataccggaatcgcgacatcaaacgtcgacagtggcgcgccaggtagaaaaataacaacacttataacaccaaattagtctcattacatctaacattgaacatattttgacagttttcttattatgtgataaaaatattactatgtttttctataaatttagtcaaacctaatgaaatttgaacaatattgtagattgtttgaagtagggagcagatcatagcggctaggctaaaaaatgcctttctttcaacaaactagatccactaacgtcaagtaggtgtagaaaaaaaaaggccatatcacgaataatgcctgatgcatgttatttaaaacgggaatgctagaggacgggatatcatcccccaacggaatagctcttctccagaacgcgattcttatccatacactcactcgccgccgtcgccgtcccccgccgttggcccgcgccctgtcccctgtcgccttcgcagcccgctgccaccgccaccgccgctgtgcccgtccccagtagacgccgccaccgccgccgcgcccatcccccaccgccgcggcgtccgtcccccatagacgccgccgctgccgccgtgcccatcccctatcgccgccgcacccgtcccccgctaccgccgcggtcgcggcgcccgtcctctgccgccgttgtcgccatcctcgtttgcagggggcgaccgcgcgtgtcggggtgctcctcccccaacgggatgcccagctatatccagtaggaatcacctgatacctggtaggtatcatccgttaccttgcaagtatcatgtgatacatggtagaaatcatctgatacctcgcgagtatcacgcgatacgtggtagaaatcgtctgataaatgacaggtatacctcgtgagtatcacgtgatacgtggttgaaatcatctgatacctaacaggtttcacatgatatcgagatcatcttgttgtgtagaatcgtctgatacctgataggtatcacacctgatacctactcgagatcaacccgttcgaaaacgggattccgttatatagcagccccctatttaaaaaggagagaattatgcacacaaatgtaaaacgaattgtgtttagagtcaacgggagtgattataacctttgctcattttcttttggctaagtagtaggacctgtaaaaagtactcgtaacaaaagctgtaacgcgtgtcacctagcgttgggtagaaagttgcaaacttgcaaatgcactgagacgttgtcgatgagcaaaggatccgaatattcgatcactgcgcgatatgtgtaaagagccaaagatcaaattaagagtagcacttcatagttcaggtaatggaatccaagtcctttcctaaagtttctcattgcaatttgaaaagcagaggagtggcaaatgcagtggtagtagtacatgccaaataaactggataaggcaatatcgccgaagtgaccaaacacaaccaaaactaccaaccaaaaaccaaactaactaccaaaaaaaatcaaaataaaaaaaacaaatgttaatattggaggagagagagaggggggaaaatactgcccaaaaatggggaagcgaaaacgaggagttcgcggctcatttgctaaaaaaagatgccaacatcctcaccgcctcctacgatttcctcgcctcggcgccccaattcaatcctcggctccgcctcgtctccgcattcgcagcttggcggccatgaatcgatgatccgcaccgcaccgcgccgccgcgcgcgcggaggagggcgatccgggcggccccgctttggggacggggggtgattcggtgtccgtttgggcgcgaataggtttggggaattgagagagggagggcgagatgtcgacggagctcgatcgtcgcggctcatcggatcggctccgcgagcgggtcaagttcaggttctccggcttccgcgccgttcaggtcaaatgtttttttctcttttcttttttttccgcattgagcagcgctgcattgttgagcgattcgtaggagatcagtctatccggggaatagcgatgaatgtacgaccctatgtcgtggtctgttgcgagattgagcattttactatcgataatggtcaattgttgtgtgaaatttactagaaaaaaatcaatgttgtgactggtgctaatgcgttgaacagttttattacaacacgcattgcttgtaagtaaaagaaatgtatatggaatactttccctccttagccatgctgttttgttttgattcggcaagagaatgcgacgatatttgttttagatgaaaggtcagtgtaatgatgatcgtggaaagttgggatggacctttaatctgattatgcatcatggggtgttctcaagaaaatatgtatcgcgaggttgtgggaggttaaattagtacgatgtgggaggcaagttactttatgagcattttttgcaggctccaaatatgtaaggtcatctttggtaagtggtgacaattcttttctcaaatatgatattcctaatgtaactatgatagtttgaatagaaaagggacatccaggtttcaacatttctgctaagttcatgtaactatttttctagtagcaatttcatcgagtgtgacttggtgtgcacaacaatgagtgtacttgagtaccggtgcaaaatggaagacatatgtttctttcccgatgacatttcttattcccgatttgtcagcaggttccagtagtatcagacaggctgatgctttcaatagttgcagtggacactggaaaaacaattgccaagtccactaaagccgctgcacttagtggagcctgtcaatggcctgattccatcctggaatcaatttggttttcccaagatcaagtgtctgaagaatttcaggagtgtcagtgcaggtttgttgtttccatggtatggctattgttcgcatgaacttgccttcccgatttgcatttatgcactgtactgttgttttactaataacaaatcttatgttatagggatcaacaaacagtggtatcctcggggaagttttcctaaatctgactaactatcttagttcattagaatctactgctatctctttgccactgaagagatgcgattctggaacaattctacaggtagattttagttaaccatacttgttttcttctagatatttctaattacatctttccccatatgattattttgttttattcctagtagtaacataatgccagctcatttggattttcccaaaagagaagtttttcacatgatcctctctttcagatatgctttttagtccatctaactgtaattcaaactaaaccatgtgaagttccctacagttgatagttctctaataaagctcctttcatgttctgtacttctgtttgttgacctagcatataagctatttggttgttggattttcaaaaatgggactgctattgggcagtcgtgtatgtgttgtacatacctgtgagttttcttcttttgtttctaacaagaaagttgcaatgcaaaacattttggcttttgagatgctcacttcatgtgctagctgactggtatgaaccacctattgttatatgagatgccacaagttctactgccatcggggtgctgggtttgagggactttctaatggcagcttatatactatatttcgtttcttgcttgaatcacccacccacaaccaaccccccaaaaggtggttgacaagtaattttccccatgtgtaccacttatgatgatctccaatgtttctcatgtgcagcttaacattcaatgtcttggagcaaagtctaaaacaaggtaactgaatctcttttatattcttttaggggatgttagtaatgccttttattactccagttgattcagcaaacatctgtatcttaggtctttagtggtcactaagttgatagccttaactgtcactatttcttgtttattgacagctcataaaacttgtttttctgtttcatcttggcattatatggcaatgtgaaataatggaatgaactatctcctcgttttgatgattgtagtcgaaccaatgatgatacagagtgcacatcagatggctttgacagcatgctgaataggactactcattctttgtcaggaaatgacttaggtggttcttatcaagatgaagctggaaatagggtataattcccttactcaaaactcattaatgccaattctttttaagcaatattatgttgggggacaactaaagcttacatgttttgtgtgagttagtccagatatactagaaactagaagagccacaaaatgtagtgataatgtttggatgagactctacatagcacagattgcaggagctcccggtgtggtgctcaacagcccgcatttgattctctccaaagtccaaactaagtctttatacaccaaatcaatacccttcttaaaaaagccatcgacactaagtccctccttaatgtcccactttttatacactgtttagatgccctaaaaatatattatttttttgcttgaacagtcatatccattgatgagcagcaggtttgaccaaaatagtttttttttataagctgaaaataagagctagtcttgttatagctaatatgctgctctttatctgtcccatcttcgaatgcggatagaaaggatctattacaaaatttgcatccataatcttcttacatcttacattttcaaagcacactttcattagacttagtgatagcttcgattgtcagctatcttgttattgg

SEQ ID NO: 14962 - DNA, 2407 bp, Oryza sativa
ggtttgtgcccataaaaaaatcatggattattttgtagatcttgaaacaagctctctacaacaatgttttaaaagttggtgctagctaggcatcgggtagccacacaattaggcattagatgatgcattagacggctaaactgcctttgttgatatttcgttgctattttcgtgctatatatatagtttagttgttattatatatgtgatatggttcttaatatcttaaatttaacttgtggtctggcataggtgtcacctagctagtcgtctaattagcgtctagcgtctttttgaatcatgctctacaattataatcctctcatcgtatatgatggaattctcatgttcggaacgaagcctttgtgttcatttccgaagtgactagcttgatgtgtgccgacttgtataaaatatctccaaccttagggatgaccaagcatgcattatatttcttagccgagatatgattggatcagtatatatgatcagctcaatgaaaagatttgatcgatactagcatccagattttcaagagcaaattgacatccattagcggtgcctacctcaagtaacaacgcgaaaccactacgatcaatctatatctatcaactataatagcacgtacattggttgtgatcatagtaatacccgccaagaaaagaattaaatttaaaaatatactgtttattttttctcagaaatatccgggatacatttttttttcacaaatatactgccgtcgctgtatgggagtgtaaaattgacccgatatcactgaaccgttaagaaaaacgacgacgtgttgcggttcgagcagtctcaggccttgttcggttacacaaggattcgatctgggctaggaatgacaagtatagtaagaaatttatgatagataccacgagaagagactgggatttattccagccaggaaccaatttattcatgatagggagaataagagaccggtaatcaatccactagtcaagaagtgtgggactaatccggatgttttgttatacctaatacgattaaattgattctaacctggaataaatctcggtctcttgttgaacctattataaatttcttgttatacatatcatttctgacccagaacgaatccttgtgtaaccgaacaagacctcaacagggtcaaacgatgacagtgacacccctttggaaatgattaatgattgtaattggttatcatgattagtgaataattgattactaataatgctaattaaagaaatcccaataaattaattaattgctaatgatgctaattaatctattaatgattaatcgcactagttcggatgtgaagtcgcggccttgcaccctcggtccgcgagaccgtggtgagtctcacgatctcgcggcaccatctaagacatagctgatatacatatatcaagttaattattagtactaacttcttttgaaaatgttattggttttctataacatttgatcattcatcttattaaaaatttataatataaacatgttaaatgatattaatttttttcttaatcagacctttgatcaaacgttataaaaaaatcaaacggcgtcgtacattttaaaatagagggagtaatagatatgaataatatacagttttaagttcattttccaccagactttatttgaaccaacacacttacctgctggtcttccagcagtgtaaattaacaatgacaatgcaagttgccatcaagaactaacagactgtaaaactgaagtggaaattttgcttaagctatgcatacacgaacgaaacggtgatcgaccagaagatcttagaaatttaatttcattaagtcaaaagggcggcgagaaaggaacggtgtaaccacagatatctctttggacaacttaattttttacataataatatactttatcacaaagcaaagcatcctgcaaaatgagcaaatttaattaattaatttacagggctgcaaaatgagcagattaattaattaatttacagggctgtgacctaatttatcctgctcttatatatacgtgttgatcatggaatggtagctatggtctgaagctgtcccagcagcgcacaggtgtattttataaaaagaaatggatagaaatccagcgtctagatctatatgtggatataaaacagctaaaggttgtagcaaacacttagacttaaccgaggaataacaaaagaaaataagaggctcttagaccttagatccaacgtcgcgcctcatgatcttcggcaccggcaacaagcctgacgttgttttgcgcgcgccgttaccgtcttgcttactacgcgaggtcaccggatctggccataagcaatagtagaaaaagtattttttttcaggcgaccaaaagtgatttttttacgcgggggttggaccgtctg

SEQ ID NO: 14963 - DNA, 5253 bp, Oryza sativa
  unsure (1)..(5253): unsure at all n locations
tgacacttagaaaaatatcagccgatgtgtcactgtatatataccacgctaattttcacaggcacatctcatgtggtccgcctgcgaaaatcatttttgcaggcacggcttaagtggtccgtttgcgaaaatagacagtgaacttcaccctaatttatatttttgtaggtggctatttgattctaaggatcatatccacttgtgaaaattaatacccaacatcggcgaaaatgctttttctagtcgtgaaggctagatccatcgatccaaccaggtcgccgctacgaaagcatataggtgtatggctttcatgtttaatcgaacaggaagctagctagctaattaatcatgctttatgacatatccctagtaattaaaatgtaataagcatttgccaccttttgatcagatgatcatcacttgttcatcctaatggcctcatggcggtgcacgcttaagctagcaacggcttttttctccatgcattctactttaattttatcatatttaagaaagtattaggaggtatatttttttatgtaaaccttggttactaccccatccgtttcagattagaagtcgttttgactttagtcaaagttaagctgttttaaatttgaccaaatttataaaaaaaatagttatattttatcttaagacaaatatattatgaaaatatatttaattatagatttaataaacttaatttggtgttgtaaatattattatatttgtctacaaaattagtcaaacttatagtttgactttgacaagagtcaaatcgacttataattaaaatgaacggagcaaatagcttgaggtattttcttaagccataaatttatcttcttctccttatttaaatacatatagtcgggtaaataaatccctctaaaacttgtctgacgacgttgatatgctctcctatataaagtaaaataaaggacaatttgcttagcaagttggttaatacttttaactaattaatttatacggcagtattgtttattatttagataaggcttaacctgaaattagcactcgcaacgggtaagagagagatcactgcgtgcatgtgctccgccatttttcgtacagtacattctcttcgcagacacgaaccggacaggaacatttgatgacactgacacgttgacccatggacccatatcgatgcttagctccagtcgtggctaaggatgaatcctgcacgtacacgtgtccaccctacatagatgatgtgttacacatgcatctgtgtagatgtgtagtacggaatagtagctagtagtatcacataaatgttacggaattgctgctgcacatgaatgtactcccttattcccaagacgatttcctttaaaaggagtatggagtagcagtagtagtcaaacagcatactattatgttgttttgtagtttacttaatacagtattagataataattaacattatcactaattaatgtcatcattataacaattaggttaaaaactaactactcgcaccatacaggcgaagtttatatagatatagcagaaaaaaattataagattacaatctactcccttcgtaccaaaaaagacaaacgttggttttcgtgtctaacatttaaccgtccgtcttatttaaaaaaattatgaaaaaaattaaaaagataagtcacgcataaaatattaatcatgttttatcatctaacaacaataaaaatacgaattataaaaaaatttcatataagacggacagttaaaattggacacgaaaacttagggtttgccttttttttatggagggagtagaagtttatatagatatagtagaaaaagttacaagattaccatctggaagataaaaaggaaaaaattagcaaaagaatggcatgtaaattaagtgcttagatgtacgtgcccttgcctctggatcgtaatcatctgcctacctagctggacactgacatcagctgcaactgatgccagctgttcgtcctggctgggagtacttaagcccacggggagtcgctctcttnctcactctcatcgccaccaccaccttccactccaagacgctagctgcattgtagtgagagagagaggcggccatggcgctggcgtcgctgccgaaggtggtgatggggtcggtggcgttccgtgtgttctggatgctggcggtgttcccgtcggtgccgttcctgccgatcgggcggacggcgggggcgctgctgggcgcggtgctgatgatcgtgttccacgtgatcagcggcgacgacgcctacgcctccatcgacctccccatcctgggcctcctcttcgccaccatggtcgtcggcggctacctcaagaacgccggcatgttcaggcacctgggccggctgctggcgtgncggagccagggcgggcgcgacctcatgtgccgcgtctgcgtcgtcaccgcgctcgccagcgcgctcttcaccaacgacacctgctgcgtcgtcctcaccgagttcgtgctcgagctcgccgccgagcgctacctcccggcgaagccgttcctgctcgcgctcgccaccagcgccaacatcggctccagcgcgacgcccatcggcaacccgcagaacctggtcatcgccttcaacagcaagatctcctttatttccttcctcctcggcatcctccccgccatgctcgccggcatggggatcaacatgctcatgctgctctgcatgtactggaaggagctcgacggcggcgcctgcagccccgacgaggtcgccgccggcaagcagatggaggccatcgaggagggccgccgcacggcgctcaacaacaacaagaaagacgacggcgacgccgccacccccgcatcgccggaggacgacgacggcggcgacgccgagtcgatgatgtcggagaacatctcgacgaagcaccggtggttcatgcagtgctcggagcaccggcggaagctgttcctcaagagcttcgcgtacgtggtcaccgtcggcatgctcgtcgcctacatgctcggcctcaacatgtcgtggaccgccatcacgaccgccatcgccctcgtcgtcgtcgacttccgcgacgccgagccatgcctcgacaaggtaacccatatccgtccaaatcactataactctaggccacacgagcaagtacacgtggcggccatgcggacaagaagcaatatgtgaactgggtgccacgtgtgcgtggatgtgaatggatgatgcaggtgtcgtactcgctgctggtgttcttctcggggatgttcgtgacggtgagcgggttcaacaagacggggctacccggggccatctggaacgtgatggcgccctactcaaagatcaaccacgtcaccggcgtcaccgtcctctccgtcatcatcctcctcctctccaacctcgcctccaacgtccccaccggtacgtacttactcacaacctttctcgcaccatgctattgctagtacccaatgtgtcccgactcacccagcactaacatttgtactgtacagtacatcagtttcttttaatacatgatatctgacttttttttatcgatgaatggatcttattcaatttcttttgtaaatataaaaagattaaatcagacaataaatcaagtcaaaataaaataaatgtaattatattttttaataagatgaatgattattaaaagaaaaaaattttttttgtctctcataattaaaaaagaacaactcattttttacatgttatttgagtggtaattgtaaattaatttatatatgtgggtgtagtgttgttgatgggggatgaggtggcggccgccgcctccaccatatcacccgcggcggtgacgcggtcgtggctgctgctggcgtgggtgagcacggtgcgggggaacctgtcgctgctggggtcggcggcgaacctgatcgtgtgcgaccaggcgaggcgggcgacgcgcaacgcctacgacctcaccttctggaaccacgtcatcttcggactcccatccaccctcgtcgtcaccgccatcggcatccctctcatcggcaagatcaacatctagtattcattaaattaattaattaatataatccggctagctactatctacaacgatcagaagaaggcagaatgatcgagcatgcaagaattcatgcaaattacaagggatgtgatatgatcatattaatccaaggaagctagtatgatgattaagtttgtgatcaagccgtactatgtgcatgccaatgcatgcatgtgttcaagtgtacactatgcttggtctcaagtggatcaattatattggtgccatgctctgggataattagttaattagtacttatgataagctagagaggaggatgcattatattggtgcatggtaataaggcaaatgaacagcagaatgcatgtatatatgtactgtatccctgttgccagctggtctctgtttgaatgaagttgatagcaacaaagctagcactagcgaatgagctagtgactcaagtacgcatgccggattacctcattgctccaaacttgcaatcagttttgaacttttaataaagttaatttggctttgtgcacttgtcaatttgctccctctttgtttaaccgatcttgcctagtgcgtacgtagctagattgcacatttaagttagctaggcatgttgttctctaacattattttctttcaatggttacgaaaatgggttacatcttcggcctctgccgaccgtacgtttgttaattcattcgcatattacgtctcctaattaatcttagtgagattaatgatgcatgcgtgcactcagtggagatagattgatcagattaaatcagggtcacaccaacgtaacagctctctacctcctatgctggccacttgtacgaataagaaagatatatcaaagatggcgacttatactatctagctagagtgttgtgcattggtcccctcttgattccactccctatatatttctccatgtagttatatatacacactagctagacaattagcatatgaaattgaaaagcaaatgttatatggaattgaaaagtaaatgtacttactgctctttatagtacaaaagtactcaccttatatattgaaattaaaacaaaaggtggtgaaaaaaggggcatactattttaatcccttaagaggatgtcctcttgtttcttatatgtcatctaaatagttatgaaaaaaattaaaaaatagattaatacatgatacatcactccacaaacatgcatggaagcttgcatg

SEQ ID NO: 14964 - DNA, 640 bp, Oryza sativa
cggttacataccaagaaggaaaaagtatacttaaggtccctcaactagtcatcggtataaaaaacgttctcgaaccacaaaaccagatatgcggggcccttaactatacaaaacgggtcacccgagatccttcggtggttttgaccccgattttagtctacgtgacgactgagtcagcatggaccccacatgtcagctggccacgtcatcaccctctctcctcctcaccctttctcctctctctctcactgtctcacactcttctcgtttgggtaggcagctggggaggatgtcggagggctgttgccttcaacggggctaggtgggacgagggcgtcggcggccggcgacgggcgacacgacggcggcggctggcaactggcgacgcaccgccgttgcaaaggccgcaggagcggaggtgggccgccgtcgagggaggaggtaggcaagcaaggggggcggggaggccggcgatgacctcctcaccggctgcggggggggggggggggcaaggcgtcggcggcaacgaggcggttcttaggcgcggccagctcgacccgtagtctctcaagctcctcgccgagcggcatggagggacgacacggcggggggaagccagtcgcatcgtcgggtttgattt

SEQ ID NO: 14965 - DNA, 676 bp, Oryza sativa
  unsure (1)..(676): unsure at all n locations
nnnnnnnnnnnnnnnnnnnnnnnnnnnnnnnnnnnnnnnncccaatcattttatttctctcaatataaccattattaattaaagcaagatacattaacctaaccgagaaccttccattcttattaaagttccatctaaaacaatcggaagaatgatttagctggatatgtataatagaagcacacaactcataccaaaaaataagattctgaccaactaaagttctcctaaaagaaacattaagtggaacagatctcataacactagtaattgaagaacatttccttcggacaatggcatataaagagggatacttatctttaaaggctaagttacctaaccatttatcttcccaaaatctagtttgttccccactattcacaatcatggaacccatgtttaagaaagtatccttaactttcatgagacctgaccaaaaatgagagttaccttgcttcttatcaacttgagtaatagacttattatgaagatatttcctcctcaataagtcttgccaaaccccttgttcattaattaacttaacaaccatttgctcaaaagacatttattttgtatttccaaattatgaacccctaaaccaccctgatctttgggccggcaaatgatatcccatctagtaagtctgtaccttttcttatgatcatatccttgtaaa

SEQ ID NO: 14966 - DNA, 1452 bp, Oryza sativa
aacacattaagaatattgcttcacagtagaatggtagttcagtgattgacatgtaaagtctggcgccaatcaccattcactaagattatccagtcgatgccgcaaacaataatgagacaagagaatttatttaccagcaaagcttgtttcttctttgattttacattgacaaccagatccctcgatacctcattctttgaagaggatacatgcctccgtccattctgtaatattgattaataaatcgtaaatgcaaaaatataaaaggaacagaacaatgtttgtaaataccatccagaagtttcatgagataataccatgcagatcacatttgcaacctttaaatcttgttctaactccatcactaactgcatccccttcactggccaaaacttattatcagtgatctgggatttccttaaaaggaaatcagtatagatgcatttttggtagcataacacagaacatgttattttaggaaaattgagaaaaatacttataacaggtatgtctgaaaactagaaataaaaggcatgtgattaaaatatatctaatatgacacagcaaagtaaggaaccaaaaactgaacctcttctatattctgatgggagacatacccatttcttcatgatgacccataacatgatgtgatagtcgttctgcaattttgtcgagctgcgctaatctcaaagtagactgcacagaaaaaaaggaagacgtcaattttgctacaaaagcacacactcatgtgcatggatgggcccttttgttggaacatatgttcattggcaagaacattgctcgaacacgacaagaagtactcggtttcttctacaaagggcatgcgtgttgtttgttgaaaaaaatgcttccagctatcattaacaaagctgtatgcaagtaagcatgcaaactccactcactctttatcatacccaccagcactaatgtctcagacatgaaaaaacatgtgaaggtaaaccgctgcactaacctgcttatcgaaatagctggaatcaccctctgcagggatactttgcagaatgtactttattgggtcgaactcctgcagacaattcaaaacacatcaagcccaactggctgaaagccgcgggaaaccacagctgcggaaatacaacacatacctcctgaaagaacacctcctcgagctcatccacggcatgcccctgcgggttgctcccgtagatggagaccaagtcctccgaattcgaaggcaggctgatcttctcgtgcggtggcagcccagcgatcgcacgtgcggccgccgctgccgccgcagctctagctggaacctagaccggcgaattacaaaaatgagcaacctctatcggatccaacacagggtacaccgagtgagagattgacgaaggtggaggagggaggaagtgattatggacctccgggccggaggcgggccgcggtggggtggga

SEQ ID NO: 14967 - DNA, 3294 bp, Oryza sativa
gccggtggcccccggtgggcccctcggcgcaccggcgggggaccatggaaggcagggaaggggtgaaagctcccagatccgggggccgggggaaggctagggctcgcgcgcgcgcgtcgtcgtcgtcgtcggtggcctcggcggccggtcggatcgcgcggggggaggagagagagaaaaagaggagacgagaggtggttggtctcgtggcgtggcgtgggtctggctgggcttttttttccctcgcggtcgcggcgatgtgcgtaaagcggaggagaggagaggggagggggcgagagaggagcagaccagtctcgtgctgaagatgatgatgctgagtctttttttttctttttaccttacctttgttcctctccaagttacagcgcagtttgttacaacctccgtcctataatacttatcgtcgttttgaatttaaatttttgtttgtaacatttgatcatttattttattttaaagtattatagaaaaaagctaatgtttaccattagccaccacgagtgatgataacccgaagatgatgtttgaaactaatgacaaagatgaatattccctccgtttcaggttataaaacgttttgactttggtgtttgactaaatttgtagaaaaaaatattaacattttcaacccaagataaatttattatgaaaatatattcgattattgatttgatgaaattaatttagtattataaatattattatatttatccataaatttagtcaaacttgaaacattttgattttgactaaagtcaaaacgtcttataacctgagacggaaggagtattaagttagcccacataatgtgtaaaaccagtagtacatgattaattaagatttaattattacaaacttagtaaataaatattttttatattttaaagcaacttatatttatatatagaaagttaacttaccgtttagtagtttgatgaaaaacattatagcaaaaatcgagataaaatttaaatcttaataaaaacaattgaaggctcagattattgtttgtgataaaagagttttccactctcctctaaaacattttttcatggctttcgtgtgaggtgaacagtacaacaaattaagttacttatgtataattcgggatggtatattctgatattcacaatacctacacctcttattgttggaattgtggataaaacacatcattatatccttttagtacaacataggagtagatcttaataaaggttcggtccatagatgcactttcatcgtaaatatcctcttaccatttacatttaacccactaacaacagacataaaagattttaccatttttccatggtttatcagccatagcaaacgatcaaataaggtggtgtttagattcagagacttaactctagtccctgtatttatacgctattttagagtattaaatatagattacttacaaaactaattacataaatgaaagctaattcacgagacaaattttttaagcctaattaatctataattagagaatttttactgtagcatcacataggctaatcatggattaattaggcttaatagattcgtctcgcgaattagtcaaagattatggatgagttttattaatagtctacgtttaatatttataattaatatctaaacatccgatatgatatgtaaacatccgatataataggtacttaaaaaacttttagtcccatataaagacagtaagctggtaactattgcagtcgaaaagttaaacattctgtccagcctcttctttctctcctttttactgacatcatcctgcattacaatcgggcgataccagttccattaacgctgaacagatcattataaatgaacaaactcatccgcatacgcacgctggtccaatactaactatagagtagtactactacactttgcatgatgatatctatcccgtcgcacgtccacatctgtgaccatgatccaactttctacccgcgcgcgcggcgtcttccaagttggcagacaaaatcacaccacaccacacaataccagtgcgacactgagccctggccggctggccctgccctctcaagacaaaacttgacaaaacaacattatctgatcctctctatcgaaatattgctcttataccaactggaaatttacatgtacagtgatgatggtgagttacaggttttacatatgactaccaaaattctgctgccctcgcagctgccactgccgtggcagtggaggaagacaaataaagaatcgaatcagtggaactatgtgacataattttataaccactatatgaacaaggaaaaccgaatggatccagtccaggcagcttccagcttcaccaagctctccttcggagatgagagggagatcgaagaggtgagaaacaatgcgtattcacaacaatgctgcgttcgcgctttacctcttccagctgcaataatgtgttcgattgccgtatgacaaaacatggtctggtgggttgagtctacagctgatgttgatcagaagacttcctgattgtcattgtccaaggggtttctgcttgtaaccggacttttgtctttccagcaacttcaccttgttcttgagttttttgtccaatttcttaatgtatttctcctctctctcacggtcagcgataccaggccagaacacctgaccagtcagtggccacagccattgatcatccccagcatgcatgccatcatccgcttcctctgccagatcctcatccatgctcttcagtagggtgaaattgaagaacttcacccacatctcatttctatcatcaagagggtgctgctctctgatatctccggtgacaggatttaggtaggccatcttctttccgctgtgataagcccagacattcacaaggacttcgaggattcgacaatagcagtgccttttctgaggtaaagagggtggttatgttcagatcacacgcatatccaagtatacggatgattataaacaaaaatagggtcaccttaagctgtgatgctccaagcaagcatgaagctggatctgtaccattcacgtttaagctatgaagataatctacaaacatcctgcaagggttttttttttctctcagaataaaataaaaagcattaaagaaaagggaagtgtgccatggaaagatgataggtgcactgtaaaacaataccttgagaacatgatgaacttcaaaaatgacggagtaggcatcacccaactatgcagagtagaccaataatcaccatcattgggcattggtggcagggctgtgatgccatctgagag

SEQ ID NO: 14968 - DNA, 1175 bp, Oryza sativa
cacacattgaccaaaaggtttgaagtttgatccatatccattggtgcccagtagtatataacatcctcattattttcgccagccatagtttcctctaagggttcttcggctttttcagacaaggatacctgatgacataagaatgtttaaaacttatttccatgtcattatcaattgaaaacggcctcattcaagtgttcaagcaatctcagcacatggaaagcatagaacaacaaaaggaaaacataggcatggcaagccaaaaaaaaaaaggcattttcatggagatgaaaccaaatagaacacatggaaagcatagttccaatactttttaacatctgaagcaacaattgtattgcaaaattgcatttagctggtgcagcatagaattgcctacatgataggcatcatgagttcatggctagagggaactgttgctactgcttaaaaaatcctctatgaaaaggtcgaggaacctattttattatattgtatgtccaggcaaactggaaaactgagatagtttgggagatttggaagcaccgcaacgactgcgttttcaataacgccaatcctagagtagcgacggtcttgcaagtgatagaaaatgagggccatctttggggtgttgctggagcttctcgccttcaaaagctccttagtgggacggctaacctaggcaactaagctccccgggctgtctagtgtgtgtgggtcttggtaggagggctcgggcactcctactttgttttttctttgtgttctgttttttgtattgttttttcttccccttaatgaaatgaaatgcagctctcctgcgttttcgagaaaaaaaagaaaacttgaggtagtgaaaaattatgtctagttcatagtacagaaaaatatcgaacaccacaaatttaagtagctttagccactataaggcatatccataataatagcattggacaataatacaagaacgaattaatttccacagtttgaatgaaaggacaaaaagtggatctgtgaaaaaaaaagttcagcaggaagaatgccaaattgccaatccaatatgaccaaaattagcacatgattctatgagaaattaacttatacctttcttccagcagcctgccatgactggaaacctatccatggtaacttgtgaacagcatcgattctgttcgcaa

SEQ ID NO: 14969 - DNA, 6329 bp, Oryza sativa
  unsure (1)..(6329): unsure at all n locations
caactaaaaacaggtatattttaaaccaaacttacaagactaattgtcgagaaaaaacttacaagagtaatgccacgatatagagaaccatggtgtaaaaatggccatgccccttctccactgtaaatctcatatatacacacaggttgcccagtcctttccagttcaccttcatcacgctcgtttccttcaggctttagtctttctgattttcgggcatttttgtatacctcatcccatgataataaaggtctttccaccctttcatcaatctgtattgcaaaatataaatttgattctttttataacactagtaattagtattgttcaagaagaatatagagattatgtgaaaacaggaaaaggaaggggggaaaaactggcctcctcaatttccctcctctcaatgtcttcaaagatttcaacttcatttagatcattccagtcagataggctagggtagttatataaggaagtatcattgctatcagaataggtttggttactttcgtgagattcatcgacaagattatcaattatccttgtgaggagttggctgtcatcgtctgaagaactattttctagtgcggcttttgtctcgaaaagatcccataaccatgttctctcttgaagtttagaaacaggagatggtagtttagcgtaggaaggataatgcaacacactctcaagaagcataacatgagcagtaatacaatcataagctaacatgtttttggaaagcagcttcccctccagagcaacagaaaaggctctagctgaaagccttttttctcctaaaatttgtgcaaaagctgaaaccattgtgcttgggtcatcagcattaaaaaggaagccatgggtgccatcagtgatctgaaaacaatgatatattgttaaacatagaagaatcattcaaacattggcaaaacaaataacagctcatggactggatgaagagacatacatattttgttataacagttagatttggcacaatgatgggaatttcagaggccatggaccgcaatagcaaaggagggaaaaaagacagggggggtttcccctgttcttgtcttgaagaaccatagagaacaatatcagcaaacactaacagattcctaatatcatgagtcagggagaaatgctttaccgaaccaagaggaaatcccatatgagaagcaagttcttgcagaagaaattaagatggtcagtgaagccaaatggtgagggaaaaacatttactaccaaccagagacagcacatatttatggaaataaaatagagcacatattcatgacctaacaccagtcatcaaacctccctagtctaaaaacatgctacgatacctagcagttcaaatgctgttgaatagaaattgttgttttctgaagaaaaacataaggaatctcaggtatgttctccagatggcaaatcacagtgacacaagggcttccccaatggatcttgatagaaagtttgaaactagcgaataattattacctggaaagcagagttataggcgtcagtgtcatttccgcagaaaaaaatgaattgcacacccaaatttttagtttttgccatgtccataatgtgtggggctgatgcacgcaaaactgttgcaaaatcccatggtaattcatcaaagaacaggtagctcccaacaaccaaaacaacaacatcatcttctttgctcccatactgattccttgcactttcttgagtatgtgatgagctgtatctttttgttgccaagatatcaactggtgaaccagaaataaccaagaagttcccagtatcaagggccgaatgtaacaactgaaataagatatttaagagtcagagaagcaaatgtttcttcttgatttaattattccagaatctaaaactgacagtcacacgtacaggaaggtagctatctggaaacacgacataagtgcatgcattaaaatgagttctccaatcttcaatatgattaggaatggactggtgcagttcgggatttctaaggaactgcccaagagcatcttcatgaataagccagaccacaggtagaaattggaaaggttcttgcataagactgaacacgatatgaatgtgcagcactgcagaccgaacaaatgatgtgataaagggaaaagaaacacttgggatggaaaactaggaacaatataataacacctgtcctttccatacaaattggatcttttgtcataaccgaatttatactattttgggaaaacttagttctgaaacgttatagctgctcaacactcaacagtcaaatagaaatgatgccaaaagaaagttccagttttataaaacaaacagcaatacaagatagaatgggaagaagaatacaagaccctacatgactatacagaagtaggtctaactgttctctagatttaatatttcaacttctgataacaaaaaaatcaactgaacggaatcaacagtccataaatgccgcattaaactaaattagctgatattttgtagaaccggtgtatgacagttactagcatttgcaaatggtgggttaatacttaacattggataagatcatatggtacttggtagttaaaggggcaataaaagagtgggctgttgtccttctatatcctcctatgctatttttactaaatagcaaggcatgaagtagcagagaacacaactacgtaagtatccaagcagttgaagataggtaggttaaaattaacactcacattgaaacgaccattttcccttccagagagcttagaagcacagcattgtatctgtaaaatcaaatagaagtcaaaatcttaaaccaaatcaagtaaaagcaaaagcaaaatatcctattgtaagtttccagcacttactttgaccaatcaatgtacttcaagctcggagggctgacaacatttacatgacaaatattttccaaaatatcgttagctttcccatccgcaaatgctaaaacctgttccatagcaactgaatgaattactggaacaagaagtgttattgacacaagcatttccttttgtatggtgcttaacatataggagttggagtacgataatgaccgccaaacagtcacatgttaaaaatggcaacacaatttctagtacgctattcaatgaccattttagcaaagcaactcacctcaacctcgtaacccagattcttaagactttttgccaaagtagcaaccatcagggactgtgcatttatgttcatggttcccacaaactgaaataatacagagccaaagtcaactctccagcatgtagtttcagtattaaaaattcataagcacaagattaaaacgtgcatctgtctaggtaagcatgtctgttccttccgtttaataatgtgaccagtacagataaataatagtatcgtgcacgcaattaaactattccacatttcatccataatccaaccccgagttccagtggatcatttacaaagctagcatttctcacttggaaacaaaatgtgcaaacaaatgcagtgaaaccactatgcagcgagtgatccattagggtttatataagcgagcactcacgagtgccagcctcacgggcgcaaggccgggccaccaccgccgctcggatctcgcggcctcgagccggctctcgccgtggaactcccgcagcgccacgctcgaggccgagaaccgcatgaccccacctcccccgccgccgccgggccgcggcagaccctcgaccccctcctccgccttgccgccgtcgccgatggggagcagctgccacacgacgagcagggacgccgtgaagagcgcgacgaggagcgcgaagaacaggtggctcggcctgcacgacagccccggccgccgccgccttcgngacgcagctcctcctccgcccgcggacgacgaggcncgcccacccgccaccgccccgggcggggcgggtggggaggtggtaagcggcgtcccgagtgggacccgcgccgccacattggagcccccccacctcgccccccgcgaacggccgcgtcagtgtgcgctcctccgcctccgcgcggccgcgctcgacatggacgggagacggccgatcgggggcgcggcgagggtcgcgtacgggaatccggcggtggcggcggcggcgcgaggtaggagaggaggcggggtagggatcaggagcaaccgccgccgcggcgccgggggggagggaaggaggcaacgaatctgcgtgcgggccgcgtgggtgggggagaggagtgaggcagctgaagctagaataccggagctgaagcgggagccgtatatatccgtatcgaatactaccgtactgtatacggtggggggaatataatactggttgtatttcatacagggcagagctttttttttcaaagaaaaatacagcagactggttagtggagagatgccgactgaaataatgtcaaacagtgttatacagtgatttgatgggttggttgtgcatgtcgatgtggttgaaacttaatctcctgaaaacatactacctccgtcctataaaaaaacgaatctagaaccggatataatatattctaatacgataaatcatacgtatatctaaattcgcaatactagaatgtgtcacatctgatactacgttgatttttatgggacgaatggagtattagatataaagtacaataaatctagatagaatgttagtcaagattcgttatactatgaaatgtcttatccagtattagattattgtattatgagcggagggtggatgaaaattttgtactagtacacaaaaatctataatttttaaccaatcagaggctttcgaagaaatctaaacattttgaatctaacactaatgtggctaaaagaacttttcctttgaactaaaaacgtacaagtgcaaaataatattagtatttgttttattttttggacaaatggaaggactgtatatgaacttatagtacaaaatgattggataatattgcgcatgatggtggcatgtgtaattgtttttttgcatacgtgatatgtgttatgctttgtattaccaggtacttcctccgtttcacaatgtaagtcattttagcattttccacattcatattaatgttaataaatctagatatattgtgaaacggagggagtacttctttggttagtactattttgtattgacatcttgcaaatgccataatcggtattgccatttacactcgagattcatagagctttaggttggaataaaacaaagtataatcagaaactcacaatccgacaatattagctcaaaagtactattgcatatcacagacacaccatcagtccatcgccgtttacaaaggccaaacaacacactaacaaccaacggaattatttctgcgcgttctcaaaaccattggatatcatataacggaaaaaacttaatttataggcctgctactgaaaagatcaaaagacggtcgatcagtaggtggcaccgtccttaacgtcacactgggacagggtgaagtagaaggggccggcggagtaggtgacccttccggggtagacatgggaggggcggcacggccgctcgccagtcttaccgccattgaagttggtgaagacggcgcaaccgtggtccccggaggaggcgaggcggacgaggcatgctgatgggtggaggtgggcgctgccgacagtgtatggcacctcaatattgaacatacccttgtcatccgtcttgtctgtcccgtggtacaccgtccttcccgtctccttgtctaggcaggtgatgcccaccatgctccctgcagcgcacatcatctataattatcatcgattgcctatggttgataagtcgcgaaaaaattaaacgaaacaataaggggtggagataggagtaagacaattagaaatatgttagctagtcctgcgtctaagtatccattgaaaactacacctcaaaacatataagataaaggtaaaattatgttgcgctagccgagttctagactcgagaaatttttgatttcatccttagaaagaaataagcacttcacaagtaaaacttttatatttaccagtgttttaaatagcggcttaagacatttagcggttagccttgtcaaacagctatagcgggctaaatagagctatagcggctaaattgtacgtgagagcaaatagctagaacccttcgcaaataactatagctgaagatagcggcagttatagcgggatatttaaaaccttgatatttatacttaaagagccaatgtttaaaaataaaactaaaataaaacccctcaaaatcaaatatttttctggcaacgtatgtaaagccaacagggaaacaatgggagtgcat

SEQ ID NO: 14970 - DNA, 6744 bp, Oryza sativa
cgtgcgcgccatgcgtctctctctagtctccccccctgtgtcggtaagctagctaggtagcctggtttgatggcacgacgagttacttggtccgtcgtggaggccacacacggccgcccaggccccagggtgacaagatgcccgtcaggagaaaatagagcttgaggctacaagatgctcatagacaaaatgaaatgacggagaaaagcagaaaacaaactctgtttctcatgcagtcaggtttattgatttgcattttgtgttttgctcatgtagctacaataagtcatctagcagtttcagggattccgcaaaacccatcagggaacaggtaatagtcatttgatcatgatgaattgaatagcatgtcggtgatggcatgtttttcttcagcatgaaagcaccaactcaaacaatcgctacaagtttacaaccattttgtcattattcatagaacattaaggccccgtttggcacagctgcagctcccaactccaacttacttagagctagagttgtgccaaacagtctagatcctccgtttttgggagcggagttgggagagctgctccataaaattgtactacgggggtggagctgggtttttgctgctccacagctccactccaccccaaaagacccactaccctttaattctttagtgtatttacataaaaatgccattgaactacccctactcacttcctctcctcccgttctaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcaccccttgtttcaaagagaggaggacgggttattcatatttaatttgatggtcagaggcgaattgaaagctaagcagtggtaattaagacccccggaggaaaatagggatgtctcctacgttacccattatatgtagaagtatcaacgtaatttcatagagtcattcgatctgaatgctacatgaagaacataagccagatgacggaacgcggagacctaggatgtagaagatcataacatgagcaattcggcagatttggattcctttcctatatatccaatcatgtggtacttcatcatacgattcatataagatccatctgtctagagatcttcatatacatatagaaagtcgtatgctttggaagaagcttgtacagtttgggaaggggttttttgagagaaaagaagaatctacttcaaccgatatgcccttaggcacggccatacataacatagaaatcacatgtggaaagggtgggcaattagctagagcagcaagtgctgtagcgaaactgattgcaaaataaggtaaatcggccactttaagattaccatctggggaggtccgtttggtatcccaaaactgcttagcaacagtcggacaagtgggtaatgttggggtgaaccaaaaaagtttgggtagagctgggtctaagtgttggctaggtaaacaccccgtagtaagaggggtagttatgaaccctgtggaccacccccatgggggcggtgaaggggaagcccccattggtagaaaaaaatccacaaccccttgggttatcctgcgcttggaagaagaactaggaaaaggaaaaaatatagtgatagttttattcttcgtcgccgtaagtaaatacgtaactaggaatatggaaaattgcatctttggaatttgcaataataggatgggcgaacgacgggaattgaacccgcgcatggtggattcacaatccactgccttgatccacttggctacatctgccccttatccagctaaaggattttctcttttttccattcatcattattctatttattctgacctccatacttcgatcgagatattggacatcgaatgccactctttaaaatggaaaaaaaggagtaatcagctgtgacaagaaaaaaaacgaatccttttgtagctcatcatttattggcaaaaatagaaaatgtcaatatgaaggaggagaaagaaacaatagtaacgtggtcccgggcatctagcattctatccacaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaagaaatacccaatatcttgcaagatattgggtatttctagcttttctttcttcaatatgttagcagaaaagccttatctattaagagatggaacttcaagagcagctaggtctagagggaagttgtgagcattacgttcgtgcattacttccataccaagattagcacggttgatgatatcagcccaagtattaattggctatcaactacatattggttgaaattgaatccgtttagattgaaagccatagtactaatacctaaagcaatgaaccaaatccctactacaggccaagcagccaagaagaagtgtaaagatcgagagttgttaaaactagcatattggaagattaatcggccaaaataaccatgagcggccacaataatataagtctcttcctcttgaccaaatctgtaaccctcattagcagattcgttttcagtggtttccccgatcaaactagaggttaccaaggaaccatgcatagcactaaatagggaaccgccgaatacaccagctacacctaacatgtgaaatagatgcataaggatgttatgatctgcctggaatacaatcataaagttgaaagtaccagatattcctaaaggcataccatcaaagaaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccgccattgtataaccactcatcaacagatgcagcttcccaaattgggtaaaagtgcaatccaatcgccgtagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgttctctctcctcccccatctttctcccgagtcccaatagttgtggcgggcggtggtgggcggcatcggcggcggcaggcggcgtcggccatagcggcggaggaggaagagggatcgggggcaatggcgtcggttgctgcggtggagggcgcggcggcggcgctccggtcagtgctatcccgcggcggcggcagcaggcacacgacggtagtagggcgacgggacgacacgcgggcggttggcagcgagctagcgggcagcggccgtcgggcagtgggcggcgcgcgctgtgacgatgcgcgggaggcgtccggccggcggcgggcggggcacgcggcgacgacacgcgggaggcggccggccggcgacgggcggcgcgcgcggtgatgacgcgccaccggcggcgggaggcgccctgggattgggctgccgcgggtaggtttcctttttttttcaactttttttgcatttttttttgcaattttttttagatctagagctgaaaactagccaaacacttctcaacgagtctcggagctagctcccactggagtaggagtttggagccctaccaaacgggtcctaaacagccagtatgttaaaaattgagataaccgccaacatcaggtatcaaagggaacctctctgatcttggttaaacttcaaaattgggcaaaaaaaaatgaaaacaattgatgcattcctctcaacaaggcacaaacttgtctacacagatatcgcatccaaaacaaacctgaggtaagattgagaaacagaaagggcaccacatgattaataattaagataatacataatctcagcaacaaattaatgacatcgcatcctctttggtttaatatccatactaaactcatttatatagctaaactactatcatgcaatagcttttctttcaaagacagaggccacgggccaccggaaaaatcggaaaagttcagataacacatgaccgaatctccgacagcacattctttgtaacatcattactcccagaaattcactttgcacagcaatgttatcgacattgaaacccctgataccaaccaaaagggtgaaactcccactgtctccttttatttagtgcttctgataaatgcgcacataactatgcaaccatgtttcgagtgaaatcgaccaatatgccatttaataataactctagcaagtaaaatctaccataactatgcacagactttccagccagcaacttgtaccagtactttgagatttgagtaaaatctatgcatactattccaagaacaaaagacatactttaagaactatcactccatattcagcatttgcaaaactagcatgcagaattacacggtcaggcaccaaaaatagagacatgttggaatctgatttgcagatctaaaggttctgtaagataatctaagatacaaataaagatcagacacaaaacatatgtactttaaagacccatcaacattacattcgcatagaacgaatatcccaacttagacgcaaacatcaaatcatgacattcattaagaacatgtccaattaacaagttaacatcaataaaatagaacagcaagctgattcccggtactattggataaaaaagaatgtgtaattgagctgattcccgatactattggataaaaagaatgcgcaattgtgttaaaccatgtcctgtcattatgaccctaacaaagtttcccttacccctggctcaaaattacaactaagattacaacagcctcaattgaatcactatgcggaatgttacaagttacaacaagaagcaagctcataactaaattcaattagctaaacatctgcaggagctgacaccctatttggcagatatgtgataccactagatgacgagatcatagctgatataaaaattcaagtgttaataagggaaaatacaggcaagctcacattgaagagatgatggtggattagctggaatatctgacacaaattgctcaaaatttatagcattagaacaatccacattactcagtggaaggagtataccaaatactattgcttaaaaagaataagtataatcgtgttcaaccgtcactcagtcgttattccctagcaaaatttcgtttgccccctggctcatggtactactagaattacaacagatccaattgaatcactcatctgaaatcccaaaaatccatttgggcaatcaaatctatctgtgcctcagcgaatacgcacttaagatctagatcttaaaagcagaatgcaaacaaaaccttatgagctcgacttggctccatccaaagcaaccgcggccgtcgccgactcttgagaggcagcggcggcggcggcggcctcctcctcgagcttcttcttgttgcgctcgagcgcctcgccgacctccttgggcatgtacttctcgtcgtgcttggcgagcacctcggtggcgctgaagaagcactcgcagtcccgggccttgtccgagaccttcctccccgcggtgtctcggcggaggtcgtcggtgaacggcttgaggaagccctcgacgacgacggagtggccctcgcggaagaggtcgggtagcgcgccctcgtagcggacgaggacgtcggtgatgaggtcggtgacgacgaactcgatctcggaggaggaggcggaggggtgggcgacggagccctcgaggacgagccccccgaggcggacgcgggacttggaccggtcggtggcgtagcgcgcgagcgcgtcggtcggggtgaggtagaagacgagctggtcctggaacgtggcgagcacggtgaccacgaacccggccgcgcacccgaaggtgagcgcgtacgtccacagccgcctgctctgcagctgccgcgcccgcgccccgatgtccgtcgcccgcggccgcgccggcccgcgccgcgccgcggaggagaagaaccgcgcgggccgccggaggaaggaagccaccggcgttcccccaacctctccggcggcggcggcggcggcgcgtgggattgggacggggctgggcgtgtgaagaaggcgggggagaagtcggcgggaggagagaaggcgcgaggacgccatgggtgggggatctggaaggtgcgggaagcggagcggaattggggaaagaggcgaggcgagggccaggcgtgcgcctggtttggcggcggatcggcttgctgcccacgccacggccgcacgccggagcaagtggggggaggtcaaaccgtcaaagtgggctggctcttccgggctgcggcgtctctcagggtgggcccaacccaataagcgttgaccagggtctggtttgaactgcagtaatctgaacgaaattcgattg

SEQ ID NO: 14971 - DNA, 9620 bp, Oryza sativa
ttatagattctggcaaaaaactgtgagacgaatttatcaatcctaattaatctatcattagcaaatatttacggtagcaccacattgtttatcaatcctaattaatctatcattagtaaatatttacggtagcaccacattgtcaaaccatatcgtaattaggcttaaaagattcgtctcacaattttacacgtgatctgtgtaattgttttttccttacatttaatactttatgcatgtatccaaatattcgatgtgatagtgtaaaattttttgttttaggaactaaacggggcctaatattctcgtcttgttctaaaaaatgaaaaaaggtgcctacggtggctatcgcctacctgagttacaacgaaacaggcatcaaacacagcccacggagaaacgactaaaaggcaaattggcgacttctttttgaagagaaaagagcgtgagattgtgccttttcaattgaatatgacgggaggaaaaagagaggggcaaattggcaactgaaatgaatcaattggaacaaagactgaaatgaatcaattgaaacaacgaatggccaatattcagaaacaggctataaatgggaaacacgtcgtgacattgtgaacctaggatgtatgtgacgattgatgagagtccaagtgtagtgtaacaagcggttgataacacatagcacatgaagaagctgaacatttcttcagccaagatgtaaagagtttttagtaatcagtaataattcagtaccccgtggtgtgcctgacactacagtggggtagttaacttatgctatatctgatgaaattgtccacaaagtggcatttcagtccaatacactgtgacgaatgatctcatgaggcaaaatagaccaaattcagcattggagatcgactgccaacattgctgatcattcaggaagcgagtagagttacaactcaggttcttcaggtgagcatgtgcctttgcaaggggcatcagtgcaccggcaaacgggttgtcccgaaagctcccatccattgaacccacgttccagcaccatgatgttctttgttcctgattcttccttggtctcagatagatagtcggagaacatcttggcacacgatggacctcgcacctgcagcgtgatttgatctcactgtgtaagaaatatgcacttttgcatgttatctcaaataagaatatcaggcgggagagcacaacgatatgcttgattattatataataatgagctaaaaagagattagaaaacttgccctttccatctgctattaataaatgtgctgttacaatataataaaaaacatgagctaacgcaatcagcaatgacgacagcgttctagatgcaaaaatcgaacatggtaccaactcagtggatgtggacaagtataagttaacaaagaacactctctattattgataatattagaagataatgcaatgcttcaaaagtattaactggggatttccaaaatctttactatagaaagcatcaaaatcagagtttgaaagactatctgcttgaaccagaaataggtagcctttcatttattttagataatggatatcaatccggcctctacatccctaaaggacgtgaagcacatcaaacagaaattgaccccagaaaggtaagtctaagtcattactgatagacgctgttcaagtttaggtgaaaaccagtgatgttccgcatgtatggattgcagtggtactgtgttattccatttgcagtggatggaaatagggaaacccttagagcaagaaaatgttaaacctgaatgacaggtccacgtataagttcctgtatcaccaatatcggaaattttgtctcgacaggactacaatttgctaggacatttttcaggcaaattaactccaacgtgaagggaataactcctgatatcatatctcaaaaagcatcctggtttagattcaagccaccaagtggatattaagaatcctaaattcctagtgttcaattgaaacaagaccattcagcaggacccgaaatcttagtccaacctttagctacaaacgttgccagagaactaggacagatcatgccatccaaacaggtaatctaagttgcagacaacaggcacttagcctgatgccttttatggtgtatatctcaattctttaagctccattcaacaatgaataaagcagtacacatctcatgacatctacccagatcagtactaaagagtaaagaagctaacaaattcatacttcatcgggtagtgacaacaatagcacgatggcgaaggttcaatgataatatagctaggagactaagataagctttcgatttttcctatcagaaaccacgcaatcgagtaacctaaaatacgaaccacacgatgtcctggtaaatatcagtaaatcaaacaacgttgttgcaaggtgattggtgccatgtgcctgcatcctgtaggagatcgggtacagtaatcgcaaatttgcaaagtgcctggcatgagatgtatgggggatcggaccaaccttgctgagggcgcagtggaagacgacggtgtccttgtcgccggtggcacgcgcgagctccggcagccgcgccgcgaagctgcggctggagaagtggtgcgaccccccgatgtgcgcctggtagctcctctcctcgtccctgcaatcccccaccacacatagaaaaaaacgaactatctcatcaacatcagccaccaaatcagcgcggcggagggtcggagagagacgaagagcggaagcgagcgcgcggcacctgacgtcgatgatggcgacgcgggggttgctgcgcgccatggccaggagcttcgccgccgacacgtacgacacgctccgcgccatcctccccgcctccgccttcctttcccctctcctccgagagaaaggcgtactgatgaggaatctgcacatcgagtggaggaccctttcctccttcggagacgaagctatttttgcaacttgctcctcacaattcagaaatccctgtctaaactattttttgcaacttgcgccttgaaattcccatacctaacctaggctacgcctttcacaaatttcaaaatggaaaagatctcgtcaataaagaaatttgatattttaagaaagaaaatatttagattttagaaatataaaatttataaaatacattataaaatatatagattttggaaatataaaatttataaaatacattttaaaatagtcatttctagggtagaaaagattcacaattctgggaacaccgttagaagggaaatacccgatttattattttagtcaaatcccacggttaaggttccaaattaggtaagcccaagtcaaaacctatgggcaaagtttaaaattgggttgaaattttaaattggagaattggcaggggccgcgcgaacgcgtaccccctctaccacaaattatgacgtccactctcccgcttggggagatggtaagccaacgcgcccaccaagtgcaatgtgggccattggcctaggccacggctcttcttgatcggccgtcgaccccgtccaggtaagtatgttgcaacgagggcaggggtgcccattatatactgctcctcccctcccccacctcctggaatctccgaggtggtactaaacttataacagcgagacacaacgcccctccgcgggtgcggcgcggacagccggacaccaatctattcctgggcccatttctacggcccattggaaagcccacgagatccaaaggcccaaatctttttcgctcctgcgcgccaagcttttcaggcgaaattttcatggcgccattgcgtccaaaatttccccttctctccgatccccaatccccacgacggcgatggaggaggccggcgacgaggagggagagcaggggcttcgcctcgggggagtgggggacggcgccgacggcgaggaggaggtggctcgaggagtggtggcgccgcaggtgctcgagctgagctcgtccagctcgggcgaggaggggggctcttgggaggaggaggagagccagggatctgtcgaggtgacgagaggcgggggtggagatcgcgaggctagggtttccgagagccgggacagcgcggaggtgaacggcggcgaggcggagagccagtcccttcccggctgccccatttgcatgaacgcgtggaccgcggatggcgcgcatcgcgtaaggtgaggagattttttttttgtttttactaaattcgtggaattgcgccatatgcttctatgttttgattgttctcatgagtgcatatcttaagttgctaactgtgtgatgctgtatatctagttgcattccttgtgggcatgtctatggcagatcttgcttagagagatggttactgcagtgtcggaagaaacctgcgacagtatgttgttcaatgaatctagttctgaattatatatacaacctgtaatgttatttggagaactcctttgaatgaccccatgtttatgttttcagtgtccccaatgtggtaggaggtttaaactaaataacattatcaacctctatgcaccagagatttctgttccaaataatgatcttgaaaaggttagctttgcctcgtttcctttctttggaggtatttctgcccatgggctgaaacgtgtttgatttatgcagcaagtattgtcattgagggagaaaaatgaatctcttgagaagcaagtaagctactccttgtacagtattttgtacatgcttatacatgctttaacagaacattattttgtacgatgtggtgtgtaccttcgaaccgtttcagttcaatgtaataactactgactattttcatttccgcgaggaaaatgtaaatgttttgttgttggtttataggacactgttagctactgccatgaccctttcctataactattttatgcagctaaaatcgccacaagttccatgtatcttttctaacttaagctttcttaacattttgattcagaatcaagaattggtccaggagataaatgagcacaaggtacttacccaatttcttttgttatggtatcactttttttagaaggtgaatgatattttgactgcaaaccttgcatctaatttacataggaaaagaaatgcgacaagcatttttgtgtatagataatgtttgccaagcgtattcaacatttctttttttagcaaaggtctcccttgtatgtttccttaatccttatttaaatcaaagttgttagattaaatatcttttttttttttcattggcctttccagtgtcaggaaataaagttttctttccatggagcctcatgttttttcctttatgtttccttgtatgcagaggcagattatactgcagcaaaatttcataaatgaatcaagcttaaagagaaaggtagcttttcttaaatttttagtgattaaccatgattacacaagccttgatgttaacattctttacaacaaattgtgaagaaaatggcagatcaatcatcacatggaacaacagatgcagattcagtagcatctcttacagcagatgatggtcatagcagtccttgcagttttgttctccaggtttctctctagtctctatattttatgttaatctgggttccagcttctattattatattatacttgatcaatcaaactctagatctatttgctactccatttccatttggttgtgcctaatttagctatggtcatgtagtatgagcaggaatacttacgatgcatataacttgcttgtcatgccaacttcagcaatacggatgtttgagcagttcacaatcacctacagactacagaaagaaaaactggccagatttaatttattgctctattggacttataatttttcagtccaatactattccctggcttcctttcatgtattgcatacctcaataagcaagaaatattcacaagcgtgacaagacaatggttaaaaacctatacacgtgttgcaggaaaattgaccttttactcaatcttaggttaccctatcatttctggctatccatgcctttttctatcgaacagtttacggtcaaatagttgtaatctagattttgagtgggagctattgtaggtatgctcagggatggtataattattaaataggtattgagattttatcctccctgaatgttccattcacttttctttaatcaaagaactgcgttttgaaatggtaattatgttttgtagaacgagtttttccttgatggagctcgagtcatgggcatagatgcatcgagccagattatactcacttctggcagggcacctggaattggtgctgaacatgtcctcacaaaggtacatgttctaaacttgatgctttccctaatgattttatgtaacctatccttcttctgattatatttggtcgtttattcatattgtgtacctttaattcttaattttgacagctcagcatgtctagacagggattgcagaaaatccaccttccatctgatactaaagctatcagggatatctgtatactgcctgggggtcatgttgtttttgcatcactaggcaagaagttgtcacttttaaggtctatcttgaacatgttcaaattatttttttcacaacacatttactcagaagtttgatttttgttcttgtgttttatttcccagcatgacaactgaaagtgtcgtccttcattatgatctaccggtgattctttgaccttgcagtttcacaacattcgaaactattttttgtacctacttgttgattcgaaagtgctcaccaaaagttattcattcacaattttttgtggctaactccatctcccactttatttcatgaaagcacattctagatattatatatgcattttcttctcctggaggtgctattttggttgtcatgtcataaccctgaagctctttaaatatggaaatgcagcacgtttttcatgccaatttacattttaatctttacgagatcaccaagtttgcaatctttataatttgaagagtatatgcatattctttaaaaaaaagcatcatgatactttttttttctgacagagatgcatgtaaattttctttgccttgatctaaagctgttgagtgaaaaaaaatttgaatcttgacctgttattttggatttcattatcttgcaggctcctggctggtcctgttcaggcgatcaaaatagtccgaatcacatatatgctggactacaggttgagttttcagtatttcgtgcagttcttccttaaccattgtgtgctcttcgaagggttgactagaaatctctattgatgtttcacagaatggcatgctgttgacctttgatattcgccaaactgttgcaccgttgcattccatgatgggtctatctacacaccctgttcatacgatccactctgttgtagatggcggtggttccaggaaggtcatttctgcatcttccataggaccctgcatctgggatgttgacgggagcagaaacaggtatgaaacagttttaaaacttacaacaaagttcatagttctttgtggtttccaatgttcatttttgctagtgtttctgatcaggccagatttgctaaatggtatggaaaaccacggagtctgcatctctcttgcgtgcaatccttcatcaagtgatctcctagtggcttcctttcggccaaaagttgagctgtccgacgacggcacatctcaagccggcaaatcacagtcaccgacaccctctgcatcagggaagctaggctgccatgcactcataaggaggacgagcaacacgtccttcgccagagaccaaatctgcagaggcaatgtgagtggattgcgaatgtccaaatccgcaatcatacccttcaccggaagaagcaatcagcaacatctcttcgcctatggcgacgagtcgctgcgcggagtccggacatggcggctgccttcactccagacgtttgctgatctcaggccacaccggcaaccgatccttgatctgaggtttgcagagagctcgtcgacaggggaaaggtaccttggatgcttgagcgaggacaggctgcaggttttcagagtaaggtagcccgtagcaacaacatcagagacagtcatttgacttcagttcattgtctctgtctgttagcagctgttccctttgctgctgtgttatactatagtataacacatcagcactttggttaggttttttgtacaagcacaagcaagtcttgcaatctttctctgtacagtactgatctctagagcagatgtctagtgcataacatcatgtgtgatttgttttgggtgataaaaccatgtattaattttgtactagtatcatgagtgggtgaatctggcacaaaaatcaaaggtacagttgggtagtgatatgtcataccattgatgctcagggcactgatattttgtccagttcttatcaaatcataatcacctcatctgtcactgggttggaccatcacaaattcatgtttgctctttgtgtaccttggcaagttcggcggactcagcattctcaaaagtctatactcattcctctaccaacacaacaaactagtcaaagagggttgatagcatagtacaactagaacttcaattctgcgaaatagacaaataataatctgtgatactgcatcgcttcaaagttgataaaacacttacggggctcaattaagctcatgatataactaatgaagaataaagaatttgatcaacttatgagacagtaaaacactttcctcaaccaatacaaactagtggcagaaaggattgttataggcaacaacatactctgtagctcaacaagagcctcaaactatacactaccgacaaacaatttgtgacaatgcattgcttcgaagttgataaacacttaaacaatgcagcatgacacaacttttttttttagataaaggtattttttttacccggcctctatatccaaccggatgtatacagtccccccatttaaattgggaatttggcccttcaaaaaacccaatatgaaatttgctcatatagaaattttaactcaggatcttatggtgctacttaagtcactgcaaccacattatgatacaactgacgcattgcatacgataatgattttaatcaacttatgcacgcctcaactaccaaattgcagctgtgcagcatgcagttcacactaattcgatcacacttcacatgaatccaacgaagcaatgagccaatgagcaataatcttgacgctgttcatcagcactcggggtagaaggtgtgatccctggagtaatcctggcagtagtagtagaccatggcgttgcgctgcgcccacgccatggcggcctcctgctgcgggctgagcgccgcggagccgccgccggacgacgccggcacggggctgcacgccggcggcgcggcggtggcgcaaccgccgaccttgaggtcggcgaagcgggagacgaagggctggtagcggtagtcggcgcggtagcggccgccgtcggtggcccagtcggaggcgtcccagatggatccgtacgcccacatctcccgctccgggaacgtcccctccaccttcttctcgtacctcctgatcggcacgtcgtccaccaagaacctgaccactcgccaccgtcggcagcagcttgcttagtt

SEQ ID NO: 14972 - DNA, 4186 bp, Oryza sativa
ccgtcgccggatccgcgcatgtaaacgttcgtctgcagcgtgtacggctcccccggcaccgtccccagcagctccatgtcgatctcgtcgtggtgccccgggtactgctccgtgttcgacagctgcatccatacaacacaaaaacataactttttcagcgaaattctactgcacatttcactgaaatttgcatgacaaaagttgatcaatacgtagaaggccgtgttgacgccggcggtgtagcccggctgcaccctgatcgacgccccgaagtagccgttccggtacgaccgtgtcgacttgaacccgctccctatcagcatcgaatcgaccgatcagttcaacccaaaagccgaaaagtatttacaagtcaactaccagtttcactcaaaggcttaagatgaacagagagtacagacatacctgagctacggtccatccacagggtgagagacttctgatcctgggacagggtctggtgctgtgggccccacagggtgctgtacccttcatagaaggccatcgacctgaacatcttgcttgggtagtagccaggagaaggctgagcttctgatggatgcagtagcagcagcagcagcagcagaatcagaagaggaatgcatgctgatcctgggatgttaccactaccaggcctttccattttgtcagttatagtgatgtgaatgaatgatgggctactagtttctcttcttctttgtgatgaatctctcacttgttggagtgagtcatttataggatgatgtgtggctactaatgcatgcatgggatgggaccaagtgatggcaggttgatggatggaaggaagttaattgcatgaatcttaggtagagacaaaaactgggagatttggatgaaactgaacactgctggcataaaggctgaacaggatgttgcccccctaaagagggtttgtgtgatacggcacacaaattttggatgttgacgcctcacgaaaacaggaaacctgagaaagtgaatttgcaaattctcaccatgaaactgcatacctttggttactggcagcattaacaaagttgatttcccatgctgcctttcttccgatggtaactaagtttgcagcctcactttcggttactacacatcagcagcaacgaatatcatatatatgcttataatgcacctgaaactttttccctttaccttctttggtgaattactccacgaaatgttccttcctccattactctgttttggtattttggctccaattgggagaaattattggaattttttctcatggatcagacaaaaggtaccatcacgtacacactatcttaactttttttcagaaacttaattcactgttcacataattcatcttcccaatcatatgataattctattaattcacacatatataattcatcttcccaatcatatgacataccgacacacgtttcattgacaaactgaagggaagaacagttgagtagctgcccaaccaatggattaggcctaaatgatgagcttttcctttaatagtggacagtggtccacatcttcagttaattgccgaactagtatcatggtaaacttccacaggatatgatctctgccagtagtacagtaaaaaccatactatacacatgcaggaaatggttaagacatgcacattcttgaacgctgaactgaactgatcaagcatggatatgcagttttgcatagtttctcgttggcacatcgtcttcatagtcacaagcagcacaggtggatcaatcattagattcagagctccacataagcgccggtgctggatactacgattgatcagagggtgttgtactgtgcataacgtccttggagcatctgaatgtgactgatcagcttcgtgtctcttgcatctttgtgctgcccttaactccaaacagccccggacgcaactggtgttcagttggctgttcagaattggaagattgattctgcaacctgcaccgcaccaacaagagggtaagtacccaaatccaaggttgaattctttaggttgtcttcaaatggtcactaactcactactaccaactctaaatacgcattgtgtcagtgataattagtaaaagaaaaattcaggaatgtgtaaagcctgaaagcatgacaaaagatagcaggttaagagaatctagctccctggagacccacacgattgaatgcgcacaacattccaaacgagaacagatgctccttagaaattaaggactatatgtcatgaaatcgcagaggacccttcaattgttcacatgatcagggtactggatacagcactgctgaaggttcttatattaactataaactatgctatctgccttcctgacaagaggctcaaactgaatgcatttttctctcatgataaactttacattttatctatggtacctacacttatccttgaggccttaaacttgtggagatgaaaacaggtgaagtctgcaatcagtgcaattgcaggtacttcagagttgcttgagaattcattcctcaatctctcttcagtcacatcaaaatccagtgtaattgtccacttcgaaaaatccattgtagctgtgtgcaacagttaggtaatcaagctacagtttacaggcatctattcgtactcaggggctggagggctggggcccttgaccctccatggcgcatttaaaaggaaatctcccctagcttcactgaccgacaccaatgaagaaatgcaggtacatggaaaacataagaatatttctgaaaaaaaaatggcatttccaatttcaaaccttaggtccctgcagctttcagtttcagcagataagtttaactgttatccctgtctgatgcctggatatatctgaatgcgttcaaatttgggatagcaagtgtcaatttaattagcaagaaatgggcgcacccaaagttgatttggtggatacccacacaccttcgaccaactgagctaagtcaattgactcagttcttatcttacgtctgctcaagtctgtaacaactttcttgcgcttgaccattacatatagatagaagcaaactgtggtctgaatgtctgaaaggtgcacagttcatcacttcaggctgaaggttgatgaggcacctcttcagttttctcataagtcgatgagacaccttaaggttgacaataacgatgcgcattacccactcgatcatacatagcagtgtaaattatatttgtttgctcacttctgctgatccctattttgccatgattttagcctcactctggaaatctggtgaagacttggagcatcgatcgtttacaaacctttgtcaaagtctcttgcttatgatatgtgagaacaataggaaagcttgattgaaagatgtgattgccagtcactgtgctaggttggtgttagtcaaaatggtagcatgtggcattgtgcgctccctgtcagcaatgacatgttgctacaagtctaggtgagcaagtgttatagattattagtatgttaaatcaatatgctagtctaacaagatttagcagcattagctccagtgccaactaccaatttcctcagtattcaactggaattcgcttgaactggaattcgcttccaaaataccggtgaatcattagtattcgactgatgtgaagaattcgtccaaaaagttgtcgagaattcaaaggcacagcagggtaatatatgatcataaaatgctaaaacctcttaactagagaataaatattccacaagcttatcagatatctaaaccaacgcagaggaggtactgaaaactaaaaaaaaaaggagcaactaacgtgtactaccaaactagattggaagtggtttaaactaattcagagttcataatctgatctcaaaggaaagcgagatcattgacgtgctatacactatttggacatacaaagttacaatccaatgtgttgtagttgaaatgcttgcgagatattgttgcgtagcagcatgccaacatcaaggcatttcatcgaacagagaggaggcgcttacctccaagcgaggaggtggcgacgtcgccggtgtgggatcagccgtgcagtacagctccctcagggtgtcgatgagggggcggaacccgtcgcggagaggcacgacggagacggcgcggaaccgctcggcggcttccttcgcgaacgcgcgcatcgtcacgcgggacaccttccccttca

SEQ ID NO: 14973 - DNA, 8778 bp, Oryza sativa
  unsure (1)..(8778): unsure at all n locations
ccacctactcactgtcatgtgggcccatgacgatcctactttcaaaatttaagcaacttcttcagagttggtcaatacccaatatacttctccatgactcccaaattgtacaaggttctccagtgtagcaagtgaccattccctctacaatgaatgaggtctctaaaaaagtgaagagtaatatccttttagataaaatgaagttccccattatgatgtctatactacttatgcctagctcgaattaaacagtcgggtatatgtatcaactatcaattctaacatgtctgttgaactcccaaagtttattatttcttcaaaatccattacaacgcatgggcactctgctagtaaaagtaaaagagtacatggagtacgatggacctcattccctttattggacgatcacttggtttaagtgtgcaaaatgttcaacaaggcataagctaatgttgtttcgtgattttcggaaaaccctctcatgattacattagtttgtcatgattcatgacctgaagagtgcaatttaataaacgaatttcagattcctgtcaatctgcaatgtatctgagcttttgtatcctccacttctttgttttcttccctgcagatttcctaatgatttgtgcaacaattgtaagcgtccaggacattttgctagagattgtccaaatgtggctctttgccatgcatgtgggcttccagggtaaggactatttgttattctgttttgcagatatttcatgttcttatagcctttaaagaagtcttccattattcagtatctatttgtggtgtacttgtgtttattttctcttatattgttttgccatgcttttaaaattctgtattctcaatagcactgcttgtttatgtcattgtgtatttagaaccatatccatctagattacaaatgtgcagtgaatgagacgtgatctcaataattgtgacagttcaaccgtaatgaagttgatgttaggtgaacatgatagatggctacattgatttgctaatatttaacagttttgaggtaccccatgctcctttcgtgatggatgagacttagtgttggcatcaccaattatttgagatttgttcccaaaacacgaaacatggttcattgtcttttaacagttcaatttatagtatgcatctaatatttttttattagcttattcatatttatgacaaatcagcaaaaggtagctaaagaaactgaaatgttgaagcttaagccatgcataaagttgccagaagatggttagtaacagttaagcaataacttgtggaattaaataattgtaatttaagtcacagattatagtttcatgtgatcaagaatgcttacatgcttcaccttcttatctgtgagctagcattacttactctaatgcttactttggcaggcacattgcagcagagtgttcttccaaagatctctgctggaactgcaaagaacctggccacatggctaacagctgcccaaatgaagggatatgccgcaactgtggcaagtcgggtcacattgcaagagaatgcagtgctccaccaatgctgccaggtgaaatgaggctttgcagcaactgctacaaaccagggcaccttgctgcggaatgcaccaatgagaaggcctgcaacaactgtaggaagagtggccatcttgctcgtaactgccctaacgagcccgtctgcaacctatgcaacgtgtcaggacatttggcccgagagtgccccaaatctgatgctatcaatgagaggggtgggcctcctcccttccgtggtggatacagtgatgtggtctgccgtgcttgcaatcaggttggtcatatgagccgtgattgcatggccggtgcgttcatgatctgccacaactgcggtggtcgtggtcacatggcttatgagtgcccatctgggaggcttatggatcggtttccccctcgccgtttttgagtgattttccaagtgctcaatcagatgactcttcgttgggaccggcattatgaataatcatatctcgtgctttatgccttaagaatgttagtgtatttcagatacttcagttttcatagtttgtcagcttacttgtatttgtcggttctgctgtttaactgcgatactcgttgatcggtgaggatgaattccagatgggatacttgttttaattcctacaaacttgaagttagtcttatatgccttgcagttgcatctgtgtgtttttataccccaaactgtagtctgtccttccaatccggtactgaagcgcccttttgaactggcacacaagctcggcattgctccgttgcaagctttttttctaccccctaattttggtgtgtgaacgtaattcgggtaattcgggaagagtatgctgctgattttctcctgtttattgcatatctgagccaagtaatatttctggaatggacgttaacatgcctcgatagtatcaaaaggcataacttgttatccttgcctacgataaagtctcgattagtagtcgatttggcatcaaaacaccagagaaatgcagatcatttgcttctacagcgcatatttcacccaaaaaaaaaacatatacagcaattggttctgactctttcaagttgagcgcaaaccacataaagactacccgagtcacaatgttattggtcagcgtaacaagttccatggatgctcacaagtcacagccacaaaaacaaaaggcacagcagcacgacactactacagaaatcgaaacaaaatcaaaacactacacaagccgtaacgaacaaaatgaccagggaggcattccagattttggctatatataggacagtttaatccaacttcgcgtagctcaatccattgctatctgctttctcgccttccgtttgccccagagccttcatctgtttcatccaaggaaacaggaagagagaacgaaaaaaaaaaaaggtcagctactctgtcaactgagttgcccatttgacacataacaattgtacaaactgaaaattctctggaattgaagcatagaaaatgaccggagatagcaacagtgcaaaaagaaaactacctttgcttggtacgccttatggtatctgtaaccctgaaaaaacaagagcacaacataaatatgtcgttcttgtgtgttgggggtgggtgggtttaaacagttgcattgtgtaaaagcagatacttactttgtcggttccatatagataatcacaatacgtgaaaacagaagcgaaattgctctgactctggcgtccaacatagtgatgataatcatggtattctgcgcctccatagaatggaatatactttgtcaggttgaacgggaaatcaaagctgcaaaaataacaagataattttgttatgccatgtaaacactacacgagtgcaacagcaatgtgatgggcgatatcatttggtcagtgcaatagcaaagtgatggggaatacggcaaaaagtatggtcatgatactcaagttttatgagttgacactgacacaatattgatatgaccaaagcatatacatgtctttttatttattttagaaaaggggttggcggctttccatccttttaagttaaagttcaagcaacttaattgcttctatatcatccatggtcacatactacaattttatgagtgaacacttgcagaaaaacaatggatcagacccaaaacagtctagtaatcttgcattgttgctagttctccatgtctagcatagtatcatatacactagtaaatatgcatatctatttaaatttgacaagctgcttaaaaaaaactaatatcaatcattacactccagattgcttagagttgtataattttgtaattaaaatcacaaatgcacttttttctcaaattaattagtctaatcaactttaatgaattgaaagtgtagttgcaaaattgaacaaggttactcatttgctacttaaatttctttctactaaaaagctgcagcgaatgctgaaccatggtctgtagtctattctagcattattctggaaatagtagataaaagcatcctatttctaggtaaaccttttctgttcaataactccaaatgcatcaacataggtacctgtatcctatgttccaagcttccaattggaaacaaaccctctgtccaaaaatccatttatcactaacaaatcaaaatgccatgcagctagatttgcaatcacccactaaatctatccacaacatatccatccatcactagcaacaaatccaaatacttgccaagtcaacacaatgctgtgcacatcgttagacttatattacgtgataaattatgcatcctccaaacaatccaaagaaggggggaagtacaaagtttccttacccgctgtgtgtctctatggcctccatctggcggagtacaatccagagccagaaggtgatcatgtgaacaggtgcaagcgctggcccgacaaaggaggggatgccgaggatgagcacctcagcccagtgtgcatatggcgcgcgaaatccaatgggtgccgtgaactcatggtggacacggtggatcttctcatagccccactccccatgtagcaaccgatggatccagtaggtgggnnnncgattatttaaaaaagggtttaacctttaaccaggaaagtatactagcagttgtgctgccatttcccccagggagggcagtggtagccttgtgtggattcccaccatctgcaatgttcaaaaacgacctatcttctttatttgatctctagaactactataataatgcaccacatataaataatagtaaatgatataaaaggaacaatcttcttttacttaagagtattaaaatatcatcaagacgaccttagatcatgtgattgcatctcacaagggttcccggatcacaaatcccttcaaatctcgcaatctcgaactgatggatcacccaccatcttacaaatccaaattctaagcgccgcatacgcgtagtaaccaaatgtcgcgttcttccttcgaatctaatccccgcggcacagcattgcgcggattcatcgacgagagccgcagaaaaaaaaagaagaggaaacgcaccttgacggtagggtaggacacgagctggagcgggccgatgacgaggaagaagaggcgcatgacgtccctgtagcagcggaagaactcctcccgggagagccgcaccttgggctgcagcttgaacggccccacggcggccggcgcgcggagctcgaggagcgcgacggggagcggcgcgagcgtgaagacgacgaagaggaagaggatgttgtgccagaagaggacgtagtccgggatccccgccgagtacctgaaccacagcgactccgccgccgtcatcgccctccccagcgccgcctccgcctccgccgccgtcgcgtagggcagcatctctccccgcctccgccgccgccggcgagccactcgagatggccccctctttgcgattcccgataactctagggggttaggtgcaaaatgccgcttcgagtggcctcgcgtcgtcgtccacagctggacagtgctgtcctctgctttttatgatggcatgtttgtctcactgacatgtggggcccacgtaaggcgcggtgtgcggtgggctccacctggcagtgagtggggcccgctgctcctttgttgtttttgctaatgctgtgtggctggatctcgcatgcatatatggtatggagaattggagatggagattggagagagcatctgttgctctttgactttctgtggccatgaatccactccaaaaactacaaatactcgaaaattcgattgtttgttcaatgctgtggagtaatcagatgttcgatctggagattaagaaacaaattagctgcaatttgtgttacaagttggtggcagatcaaattaatcaaaccaccaaatcatatttttacagctgaagcgttggatactcctccaaatttcagcacaaatgcgtgcctagccagtgcattcatgatagagagaaaaagatatccagtgctacaggtcatagacaagatggatttcatttattatgggggtttttttatatataatttacatcttagaacagctattaaaatactggaaactattgagatggcaatagttttatcagagaataaaagagctatagtagcaataagtgatcagggaaacccaaaaatgtgagtatataggatttaatttgttcgatcgcccatacaaatatgttcgtgcttttaaagcagcacacgtacgtacgtacgtcgaatcgtcgatgcatgcattgtttggtcatccgtatttatagccaatgcaaatttcttacgtgcgaaatgcaactacacatatgccacctatgcatccacgttcccaagagtccaaccaccagcagccatagatgtcgatgtcataagagcactacggctagggaaaagaacaaattcaaaatgttgccatcaatgtgcattttgtcacgttatattttgttttcccgattacccagcagaaatatacgtacaataccactacacgtaacatcacacttgcacgcccgtcaaaataaacacacactaaacaaaatgaaaaccaacaatgcttatataaatttattattattttattgaaagttcatttacgtatactcgtagcttaattttcatacacgcgaggatttaaatccggtaggtaaaattatatatcgatgactccaccattattccgtatcatttctcatttcaattcaatgctataaaaatactacaatgcacttgcttttcctcaacaacctacccgtcaacctctttcttagagagcgacgtgtcgggcatatactctctctgttttaaaatgtttgacaccgttgacttttcagtacgtgtttgaccattcgtcttattcaaaaaatttaagtaattatttattcttttcatatcatttgattcattgttaaatatacttgtatgtacacatatagttttacatatttcacaaatttttttaataagacgaacggtcaaacatgtgctaaaaagtcaacggtgttaaatattttgaaacggagggaatacattcataacaaaatgtcgtacatttttatacttcgatcttaccaaagttaattggattagctatctattatcgtttttttgctggtccatttcggaaagtagctagctagatgcatttttctatggctagctaggtacgatgtcgagctagctatgtgtcatcgcctcaatttcggcagtttttcttcctctcctctcgtgacttcttctgtcgacaaagtggcatggtttccacgtccaaattcaggtatgccaggccgccgcctatgcatacatgtatactcaagcaaaattgttaggaaatgataagcgaacaaacgataaaaaaataatagatcagtcacagaagacacgagatttaacgtggaaaaccctctcaatacaggagagaaaaaaccacgggcgccagccagcaaaatatcttcactatatctggggtgaggttacatcgccgcacggcggtttacaagaggtatatatatggtggaaccctaaaaaggatgacgatccgttttgcgggggctccggcccaagcctcccggtgacgggcctccgctctgctacggcagaagctggcctttattaagtgcaaatgaatttgtatcacaactcaacaaaaatgaacatgttttgttatgataaaataaaatatataataatatatcatatatgtaatatatttttaaataaaaatgctagtatgatttgttgcttatttgattatattttatttacttgatgcaaacaaatattagactattatgtgatattagaaactaatttaaaaagtccaaaagtagcggtatatctttcatagtagtagtttagataaacaggtatgcaataccacgcacatttcagacctctcaacttcatcaagcaattaaatttctgagtcccctcatgtactgtgttagatactttggacttgagtttgcttaatttgtcccatgtatagccccataaaatttatttttaaatataagtggtttgcatttagtttcaggcctccatccttaaacacacaagataccatcacaattgtatatttctatgagagtatgaatactacttatatagctttattttttataactattaggtacaaactttttaacagttcatagtataattatattataactcatatatattatatatgtatttaactaattagaagtagtctcgccgaggagcacttttgctcacgaggtagtgcggcttttttctcttgggcctgttcagctgcacttaactttattgttgtgcagtcaacacaaatagtaagttgagtttgcagctgcagcaacaacggctgcgtacaatggctgtaccagctagccgaacaggcctcttgtagacacgaatctcaagacgacccgacggtccacaaatcaactgtttggcaaaacaaatttatcaacaattgtatagcaattcagatcctttaatccacgaacagaggatagtttctttttccggcaggtacagtaaaacacaccaaaaacacatctataaatccaaggatagttatcgtccttggccctgtttggtggagtttaagattctaagaaacaactggtgagaatttggagaagctgggaaacccagcttctgacttctagtttattttctgtattctacaactacagtttctcataatctaagtgaaaatttggattgtttggggagcttctaacaatagcagcttctagaaaaatcttcagc

SEQ ID NO: 14974 - DNA, 8332 bp, Oryza sativa
ccgccgccggcggactgtacagaggcgtcgtcaaacgggcggcgcacatagtttccctggggcgtgcagacaccgaacgctccgacgacttgcacgctccatgcatcgccgggaaacctgtctctctctgacggctcacgagcaattcgcctgacaagtgaccacccctcatgctcaatgttctgcatcacaaactgacacggccaatacaacaattaatactggtgcttaagtttaaactgcttgcttgtgtccatcttgtattcattgtttgctggctaatttggccgatctcactttgtatatctccagtggttgagcacgtgagtcgtcaaacatccactacaggcggcaattttacagcaaggatgatcaaatcttcagattaataatctagcacctgctactgctttgtcccttgtgctgtgtcccatctctgcactctgcagcttcagatttggaccggttcattgatcccacattccaccactcgatccaaaacatctcacatactcacatgcctggatgctcaatcaaaggtagtagtatcatctgcatcttcaagtgcactgtgtgcagtggcagtccataaccaggacacgaactccatacatgcatgcacaaatgcactggatgcagaagaattgtagacattcagagttccggataaatggccgaaggatgattgatggaggcgtagacgactgtgagcggaacaagttgaggtctgtggtagttagaggtcttttgttccattttagatgacgtaattcatataaaataccgttataaattctaagtgttttctattcggggtttcagttagatatcatcaggagggacataggggtttgtcccataaccttgagtattttatttatcttttcttgactcattggtcatgtacctgatggcagagaccagagatttaaatcattttcatgtctaaaaaaattagaaaatctgagaaggaacatctcttaatctcttatgcatgttcttacagagaactctagcaatctgaccatatccatcagccaaccaccatttgagccattatggttcatgtttgacatggttaatctccctctgattcttagagccttcccatcttaattgtaggcattgtaggtactgacgtagagtaatgcacccacgactctaatacttttggcaccgacgccatttaaggaaaaaaaaatcctagtttacacatataatcctaacacttggagctggtgatttcagtaggtgagtttgatcactgctgcctgatttctcttcatgggcctttccatcagcttagcccagtggctacattagattctcttcattgctaattcgttcctgtatgcagattgtataacagagaacatatagctcaatttctccaaataggaaatacaaaagaattatacacaagttagaacaatcagaacaaaccagcatctcgtggtcacccattatttcctcgatcacctcaccaagaatcttgtctgcactgttaggaacaagtgctgcaaaagcagctggttccaaccctgaacaacaagtagcagctcattaattttgacaacacatgatctgcaagcttccaaagttcatttatatgatcccagttaagtgtaataaatttcacagtttacataggacaatcgagttaccagtttctgggtaggaattgatgaacatcatcatctcttcaccagtcaggccagaaaatatacaaattcttggcattgactttgcaatctgccaattgaaaatgagtgttaaccgttaacaagtgctcaatatcctgatctaaggtcagagattaattgattggcatttggtatctgtaacatcagcacaatagtgatgtgtcagctgttagcagattaagactgaaaagaaacgtgaaaataatgagaatgaatgattcagaccttgacagcttctatactaggttgctcagtgtgcatggcatcccacaacgtttgctttgtcatttcttctgtacaatgaatcacctgaaacaaagccatatgagcatataactgacctttcagattatccatagattcatataagcatggttgcatttcgtcctttgaatgatgcacttgcacgctatgaattttctccctgaatttcatcttagatgattcttgccgatgagactaaagctgagtccccatattttatcccttcttctagcttctatttgctctcatcagaagtcagaagatacatttttgttcaagtttactacatgcgcaagaacaaataggaaaaactgttctatgttttgatgtcataaaaaccaatatcattacatgcgaatggcatcagacaactattttataccttgagaaattctccgtcaagctctctcaggaactcctgaacctgcacgaattatgcatttcaggtaagcttatcgaacattcagaacaacaagaagcacacacaccaaacatacaaatcaatgcaccatatgtctggtaatttcagacaaacaggaccgttctgttctgcgtgaacagttcattgactgcgtatttaccttgttgggttcgccttcctcgaatccgatgagcaacagcgcctgacgaacacaaccaattcagatggagatcagcacagaagcagcaaatagcaaggaagaggagccgcagctagcaactcaccggcggtccgtacatgggatcctcggcgttcagcggcacgaacttggagtcctcctcctcctccatgagttcgccggggacccctgcgggggacgtcccatcagatcaacgcaaccaaaccaatcagctaaccgtggatgcatccgcaccttcgggaggcggcgacgatcggagcagccgccaccttctccccctcctccgctgcggcgccaagacgcaagcggaggcgcgcggagatcgagatcgagggagtaagatggtggcggaacggcggagaaggaggagtacgggggtggctgcggccatggccatcgtcgccggcgccggcggtgaggacgacgacgaggggagctatcctcctctgtgtggtctccgcttcgtcggcgttttcccgccaccaccacgcaatctcagccgtccgatcaccatcctgcgtctgagagtggaggaggcagagcctgcgagaaatcgcgcggttcgtgttgggcttcgcgccccgctcccaaatgggccgggcccgacccaatcgcttctggcccagtacggcccatcaagcggcgcattacacgcgggccaacgccttcgcctctccggtctccgaagcttttctcccccgcacgcgacgacctcgccgtcgccgtcgccgccgccaccaccgccatggggaggcgatccggggggaggaagctgccctttttcgcctcgaacgcctccacgtcgtcctccaccaagcggacccgctcggcgcgccgcctcccctcgctcaccaggccgcgcgcgtcgagctccccatccccggcgtcgccgtccccgccgccgccgtccgcgtcgcaccccgcccctccgtcccctcccctcgccgtatctcccgccggcgccggtaaggtcgggaagaagaaggccggggcgcgcctctggatgcggctcgaccggtggggcgtctccgaaaccctccatctcgacaagggctccatcatccgacgcgccggcctgccgccgcgggacctccggatcctcggccccgtcttctccgactcctccagcatcctcggtgagctcgaccacgcccccattagtatcgattgctgcttagggggtcgcttttgttgtgacaatacacaatgtttaattgtgcagctagagagaaggcgatggtgatcaacctagaattcatcagggcgatcgttacggccgatgagatccttctactggatcctctcacgatcgatgtgatcccttttgttgagcaattgacacatcatctccctctcaagaacctggtgtgtgggaatggtcaacctggtggtgatgaccatggggaaaagcatgatgactcgcatggagatcaggtgccccgccttaacgaggccaccggagcagagcacgagttgccatttgaattccaggtgctggagctcgcactcgagaccgtgtgctcatcattcgacgttaacgtgtctggtcttgaaaggcgcgccactccggtacttgaggaactgaccaagaatgtcagcacaaggaatctcgatcgtgtgcgaactctcaagagtgatcttacccgtttgcttgcccatgtgcagaaggtactattagagatagagtagtgcgtgcctttggtctggcaaagttcaaagttttcatccctgtttgactgtctttattattgcatattaatttgactgatcaaaagctatattcatagtatgttctagctgttcttttctgtggttaaagtttaattgcactaaggggcatggatgatccaaacaggccctaagacaataatatttcttctttggagctatgtggatataactgaacttaaaagcagtaccgaatatttgttcaaaagaatagtgtgcctgacatagccagtataattttaccatctcaaacttataatagttatggttcaccgtggaccaatcaccaactgaagtctgctgtgccgtggtcctgtgtgcacgggggaacaattgtttcatgtacatagagatgttgtagtgcatgtgttgaaagagccaaagtcttcaggtgtatatactttggattatcaaaatacatgtttatataattttagttcttactgtatggttggaacttggggcatataaaacaaaaggtggttataaacaactgattttttttttgttcgtgatgttctatgtacctacctattcatttctttttaaagcttgttgattttattttatatgcagtattgctgctgggtagtttggctgtacttttgagaaccttgatggttacctgcatgctgctctaaacaagggtttcttctgaagatatgtatcttaaccctcatatcatttcaggtcagagatgaaatagaacatcttctggatgataatgaagacatggcacatctgtatctaacaaggaagcaattacaaaaccagcaagttgaggctttaatatcatcggctgcttccaatagcattgttcctggaggaacaagtctgtccaggttgaacaatagttttcggcgcagcgtgagcatcgctacaagcatgcatttggataatgacgtggaagacctagaaatgttgcttgaggcttacttcatgcaattggatggaattcgcaacagaattttgtcggttagtccttttacccatattgaaatggggtagttgcagttttacttggatctacttaatgctatatgacttatcctagtgttcatttggacttattctctgctgacttatcataatgaatataactgtaagttcttgttggagataaattgtaaagatacacagccacgtcttgttcctaaacatatatttgagttagtattcaagttagcatagatgttgaattctttaactactagaagttgctaaacatatatttgagttagtattcaagtttgcaatagatgttgaattctttaactactactagactagaagtagaagttgctaaacatagatttgagttagcaatagatgttgaattctttaactactagaagcacatctctcttttctgatgaagaaacaaggaaaagtatatcacttttctgtataattctttggcgcccttatgctatatcttggcgtgacataatttctcgtttgggaattaaacaggttcgagagtatattgatgatacagaagactatgtcaatattcaacttgacaaccagcgtaatgaacttattcagcttcagcttacactgactattgcatccttcggcatagctgtcaacaccttcatagctggggcttttgcgatgaacatccagagcaaattgtacagcattgatgatggtagcttcttttggccatttgttgggggcacctcatcgggctgcttcatgatctgcatcgtcttattatggtatgcccggtggaagaagttgctcggtccttgaacacaatgtaacaagtcacgactcatgagaactgtctcgctgtaaagggcatgcattttgacttgtaacgtctgcagaaaggagcagtcatttgaaacataaaagagaatcctaggattagggagaaactctaatgcatttatgtttcactggtaaataagatacattttctgtagttttcccttggtaaaaatatagtatactaacatgttatgatcatcagcacccttgaattgattgtggatttgtgggttataggggatccaatcatcctgaggcagcagtatgtcttctttgcagagagatagctgatgaatcactgactttatggacaatactgaatagtatatcggtatgtcattactcattatattccagttaaaccatatttagacaaatattggttatggccaattgaagctttcttccatggccctgtgtacatgaaggattgacggggttgtttggttctacaccattcttaacattaccaaataattggcattgctcaaatttgtcccttatttggcttggttaagtttggcactagcccagccttaaattttttgccttgccaaatcttgccaaataaaatggcaaggctaggaatggtagagaaccaaacaaacctgaaataacccagcgaaatttgttgagggaacccagacatttgtggagagtgacgtgcatttttgcttgagacgtctgtactctgtagaacgggagcatgcattttcacgtttgaagggtaaaagaaaaccgtagagactatagtgagagactctgatgttctacgtttcacgagcagtaaacaacacaaatccattatataatataaactcattttatcctgctccaatgcaatcctgtcaattcatgacacggtttttgcattagttctaaattcattcctgtgacacgattacgaaaatgacacgccaaaagaaacacatacttctgagaaacgatcaaaccaacaaacataaacaaatctctcaaaccccctgaagaaatattccaccaagacatcctaaattatttattttcccggtaatctgatcatgctagttggttattcagatttcatagtttcgctaccgagcgttggtacgcacgctgagcagcgcaggaaccagttaaccacgtgccgcaccaaactagcaacagatgcatcaactgaaaaggtgaacacaaaatgcatgcaatcacaacggcttcaccgtttcatgctgcccccaattttggttgacatctgtcataatcatgtaaacagcatgatgctgacaaaggctgagttcaacagatttttgcaatcatcatcttcacaggccacttttgattcatcattgaattcatggtggctggaaactattatcatgaaagcaacctgctgctcatagaaaaggttgtctcaaggtgacgcgataaaacagcattgtgatttctgaaggagttaacaaaataagggatgatgaactattatcacaagatgatccagagaatgtacaaccacctgatatcccatgagcgtgaaaaaaggggtgaaaaagaaaagctaagaataatctaatcttataccttgctatcagtacactagtcaccaagtttgaatctaaaaaggttttacaagaacaacgcagaagaaatcacgcaacagttaatcacaactgatgctctcttccttttccttttcttcctcttttttttctttttttttcttttttggtcttcttgcattcttaaattcggtgctgtttttaaaaagagcttcttagctatgtaggaactgagaatggagcaagggaatttgcagggagagtaacaccaccccctcgaagagaaactgaaggtcggctccagttagcagtggttatggcattcgaatcaaagaacaccacaacaactgttatatcatcatggaagtgccgccttaccccacgatcaattttcttcagatctgaatacctcatctccctcttttttgctgcctgctgcattgcagcctttactagtcttctagcaatcccctgatacgcaggaagttatagtagcattagtaagataagcaattaattgttatctgtaagatgaataaaagcccaaaaaaatagagaacaagatttcatttgatgaggctgggttgcactacatgatctggaactaataagtttagaaaaccatttaagatggatccgtagtgagcatcttgaggtggacagatatagtgtgtgaagttgcaaggaatatgaacaaattagc

SEQ ID NO: 14975 - DNA, 5407 bp, Oryza sativa
  unsure (1)..(5407): unsure at all n locations
ccatcacaccacgtaatatgtgctgtgggaacgcagcagtctaaacaaaatatcccggcaccttcttatacacactaattaccagaagcaatcagaataattgttccttcagggagattgcaattgaattcaagaactttacatcatattggtcttggtccataacagcagtgtcatgttattgcagttgcattagttttagagataaaaagatcgattcatggttattgaaacttgaaaagaagcataattatcgaatcacttatatttatttagctgtgataaatgagattttcctcttaccaaacaaagaaacaaaagacactaaattctgcagaagttgccatcacatagcatgttctaaagggtttgaaattaccagattaattgggaaaaagagaaacatgtacacttattttatgaaggcaggtccagattataacagtacagatggatggcgtacataatagagcattactccatccgtatcagagaagtacaattctaattttggacataaacctaagagtggcacagcaaacacaattatgctttcagttggctgactataatctagtcccgtgccaatcgcatgggaaagtctgcgagttattattagaacaagacgtcaagattctacaaaataattagatgagtcaaaatgaatagacaacaaatagcaaaataattaagatgtccagatatgtacctggataatacccttcacacgccaaacattgtgctttagaaccacaatatggggatcatcaggatgtgctgcctgcagctctcgcctgacctcttcaaaggatgcattgtgttctgctgacaactgcatagccagaacctccccagttcccttcacaagtctaccgagaacagcacgggaatcgccaagtttgcaatatatagatttccagcacagatcacaccaaccagacagcaagagcctactgccgctaattgaggcctcatcgaccattgactactaactacagaaaagaatccctcctcagttgctcgaaacgccttccgaatcacatccgctgacatgcacttgtgctcagaagcaaatcctgaaaaaggaaggtaatcatgggcatgcacaactgatgattagcaagtaattaaagctatagagatgcacaggcagaaatgattattagcagttacttgtaaacaaataattatacaatcagatgtaactagaagatgccatgctttatattcataaaaaaattcttgcagtcagtttctaaactggcatgtgatgtgtttaattacattccagaaaatcatctatgggtcaaaattagggcaatcctggcccctggtctaatagtagatgcattcaaatacgcgcgcgctttttcgcggtaatatgcgcagaaccacatctcatgcaatgatgcaatgcagcttataacagatatctactcaactgaaaaccattttcgctcaacaactatcaatatcaaacacatctacacttgcagcacatcataaacaattggacccatcacctattaattagatagcatagcgagatcggcattggatcaaagggtgaagattttcagcagcagtagtcagtagaggcctaacccctcagatggttgaagagatggtcattgatgtagcgcgccgtctccgggcctccatgcccatcatagacgcccacaagagtgccctgcaggttgggatccgtggtgctcagtggcccggattccacctggctgtggtcctcgagcaggttgttggcctggacccggccaatcgagaactcgccggcgacgagctggccggcgtccttgtaccacagcagcccatcctgccgccccgccgcatccgatcctttgggggggcgcccggccggcgacgacgcggggccccagcaagatctcaagtattccatcgcagcagatagcatccttcatttcngacacttccccatcgcccacttcctcacaaagcccattcctttaccttccctctcctcctctcgtttcttcgcgaaacctgcaattgcatccaaacaaacacgcatcccaggatcaagaaccacaaaccatatgatcatcagagggagaaggatcaacgagacaaccctactctacttgcattttggaacataaggagaaagaagcgaaaaataactcgccttttttttctctctttctttctaggattagcttcgagattcctgcgcgatcgatctcgcagccgaaaggggtggccttagatctggaaggaaccaatcgatctcaagctcggaggaagcagcaaggattgggtttttggtggagaaacggtgggctcctcctctcctctccaggatccaaaagaagcaaccaggaaactgaaccaagacgactaaaaaaagatgcgctttttcgcttctccccccctgcctacctctcctgccaaatcttgcagacagcctcgatgaacagatagatcagggtatcttttttatctcctcctccactacacaaacaaactgcacaacacaatcaagagaggaggaagggaaaaaaaaaactgcaaaagaagcaaccaggaagagagagaggttcagggccagcaaggcaggggctcagagatgggctctacaagtcctaatttctgagagggatttgggagtggtggtggtgactgtttttgtgcccttttgttccattttaaatctctttttttcttcttcttttcttgctctctacacctttcttacctagaaagaaaagaaaaagggacatttatgtatgtagctctactatactagtactactctttttttcctttcctctctatctcttttcttttcctcctccttgtcaatatgcatgacgtgctgttttgtatctttgctggtctcacatggtttgacctgttttgtttcttcatcgctactcttcagatttcagatgtacttgaaaaaaaatatatctttcatgtacaaatatcagtgaaaattaactgcaaaaatgcaggactattcgtataagtatttgatctgaaacttaatagagtattgtaccagctacagtgcatttaattggagatttgtcaagtactctgaaatctcacataatacatagaaatcattcaatgtaatttcatgccatctttatgacatgttcaaaacatattaatcgtattattgtcgtataatatctatttttattattacaataaattaaatgttttaacaaataaacctaacaaatagtttagaattagtgggctaagcactgtattagaagaaattttgaaaaaaaaaacatactttgtatagatgtggagtaaataagccaaccatccgataaaatagctgaaaataactattgtataataacttagggtgtgtccgtatatgctggtttccaacccgaaaataacattgaaaacggagcaatcccattaacacgtgattaattaagtatttgctattttttaaaaaatggattaatatattttttaagcaactttcgtatagaaactttttataaaaaatacaccgtttaatagtttgaaaagcgtgcgcgcgaaaacaagaaatatgggatgggaaaaaggggtgctgaacacgcccttagtgatgcgccttgcttaactgacagtggctaattaacttatttaaaccaccagccaagctccatgcacggatggatcgatcgaacatggcgtccaaattggcgcggcgacgttcggagaaatttcatgggatttggacgctagccgagccgaggagcaggaggagaagatttatcgattaaacaatggtgacccaacgcattcagcctgcctgccaattgtatgaggtgacgcggacgaaacgcaactcggcgcggcgcgcgacacacatggcgttgccgtggcggcgagcgcgatgccacggcgaacgcggcgcgcatgcgtgcgccacgccacgccacggcgatcggcgccgacgacgacttctctcgctcgtcgctacggaacaacggatatgatgacatgtactagtactatctgcattctgtgcttcagcctgaagactcccatttgggcctccggatggattcacattctcgtggtgttcgaatggcagggtttacattaccggttgagcactaaattttgagccccgtcggtattacggttttcgataaatttcgactaatttactatttaacctttgaaattctaatcgaaaactaattccgagctcgaaaaccgaccggctttcgtcggctctgttaaccctgtcgtatgatacatttatgctgagttgtaaactttgatttcaatgtacaaccttactgtgtttcagtccaaaacggttaaacggtgtgttttgtaaaaaaaattatatagtatattttaaaaaaacaaataaatatacttttacaaatttaatagttaatatttaattaattatatgctaatgagtcatcctattttacttatagttaacacgcttctccaataaagagtttcaagcggggtcttagagatttaaggnnnaaaaaaaagggcgcaaagggggggaaaaaacgtaattttggttgtgtgtcatttcgtggacgggtcaagagatacgaggaatggaacggacggtggtgccattacgcgttttagtgactagtgagtatatcttggcatggggtttgggctgtgtttagatccaaattttaaatccaaactttagtactttttcatcacatcaacctgtcatacactcacaacttttcagtcacatcatcttcagttttaaccaaaatccaaactttgtcatcaactaaacacagccttggtaatttgtatttggtcggtggtacggataagttcatcatagcttggatgccggatatttgacatggagagataacagtgcgccgatatttaaaagtgatgtttaaaatagcacgaactgaacttttatttattttcaaactaaaagatatactaccttcttcttaaaatatatatcattgagcttttacgtaacatttaatcatttgtcttattaaagaattagtataaatatataaaaatattagttaaaagcatatttatttaataataataaaattaaatagaataaataacatatataattttttaaaaataaaatatatagtcaaacgttatgctgaaaataacggcgacaggcaggtgagcatcgagcactgggccggcaggctgtggcctcgctggccgccactccgggcgcggcagctggggccgtgggccctgctccaacgcatcttgagccgtccgatcaaaatcctgcgtctcctgtgcatgggcccaacggcgacaggttaatcaatggctagcttctcctgtgctctctgcgtcgcccggtccccggtcagaaaaatcatataattgtacagtaaacttgcatcactatcacgtgcgg

SEQ ID NO: 14976 - DNA, 5165 bp, Oryza sativa
caaaagctacacaaaccaaattccagtttctccgattaatcacaaattcgcaattcacacacacacacatcaagaacgtacgatcgaagatcaatcacgcactccatcgacgaaagccgttgcgaccttttaccagttcgatccattgcacatgatatgagcgatgcagattaattaactaaagttagctgcaaatcatcacacatatgcgatcgagaattaagagattaattgatcggtgtcaatcgcaattatgcaaagccgagggataatcgcctacatccatgcaaaaaggtgtactattgatcgatgatctgcgctgcaagtgggcagaggccatgcaaacgtaattaagctcgatctggatgtgacatctcgaaccttggcatgtgatccatccagcttgagcttgaagaaataactagctagctcggctcatttccttataattaattattcatggaattattaaaataaaatatttacttcatatgttaaaaaaataagttttttttataaaagttcttctactaggatcatttgttctaagctatgtgttaaatttatgtatcaaaataatacttaatttgttcttgtaataaatagataatccgtgtcaataattcgcttcatataatctaaaccaaaccattaagaatgctctcatggatccatcaatcattagttcgaaccttaatttttttgctccttaattaattaccaccgttactctcatggagtatttcttaattaatttgtctgttactatttctgatagatgattcctttgcggcgaaaatattaattgtatattagtcaggtcgtggaaagcggtcaaagtggccgggtgatttcttggagtgtaatttacggcaggaactacgaaggattaatactcactgacccggttggagtcaagcggcaaaattctacggtgacgatgctgatgatggcgtaaacgttatgtacatatgcatatgcaatgagcagttactgattaattaagtacagtactacagtgttgtattgttcgtgcatatgcatatatacgcaatgatcagttacatgttcataaactgaatgaatttaactgaagaattatacgcatgtttacttatcgggacgaccaatacatatttaacacaaacccctctactaaaatcttacgaattttggatcattcgatcaagatcgaacaccccacaacccaccccacaacggcacaggccttccccctttctttcttcagatcttcctcttagctcgcgaagcatgctgctgccctctacccttatttatttatgagctccaacgatccctccattagtaggtgccaataccccaccctcctcctctatccctgacaatctctatcatcgaatccgtcattatcattcgctaccacctatctagttagccaatatttttccacctcataccccttttccatctcatcgacgtcgctctgcgccttctaacctcttcgctttgcccctaccccctatcctgcccattgctaacctccctctaaggcatgaaactcctctggcttccacctctcccaacccctctttcaccttaactctaacacccaaacctacatggatgttaggccaacaccatcacaccgaagtaactcgtcggagctaaaggagaagaaggttgggcaggatgcgatgatccaaaatccgtaagatttgggattctgtttttgtcgcatgtaggactttttttattgtttatatagatgtggattttataactatatatatagtgccatgagcagtataatactccttttaatttcttagagtcgtataacctgccagaaaaatgctctagtacgtgcacgtacggccggccgccctctctagttgacctggtaatttaattagtttgtatgctggatctaataatggctgagtcggattagcatcatcagctggatgctacgtgcaatctaaattatgaatgttgtgcttgccttgaccatcgatcgatggaatgggattcgatggcatgcaaatgcacgcatgcaccctccattattcttcccaaggggatcatcatgatatttgacctagcaagatagcaggtaattaattagtttaagatgggtttaattagagagtccggctagctaggtagctgactcggatcaacatcagctcaaatgttctctcaaactctgctgctcgacgtgattctcggccatactgttcaaaaaagacttcaattttaatatatcttatattacctccatcctgaaaaaaatatttttatacgactcatttttatacatgtagatgtagataagagtgaaacgtaccaacgtaaagctaaaatgactaaaccttacatttttttttcttaaactccaatacatttattcccccattttctcaaacttcaatgaaattgtccttcattttctcaaattataatatttgttttaaagataaaagtatttgcaggataaataaagaggaaacaaaataaagcccgtgtagggcggagggagtagcaaattcagcgagcacaatcggcaatcatgctttgtttttttttcttcctttgtttttattgcgatacgatgcatcagaagttaaaattaaacagaggcacgcgtccgatgactcgatgagtacgatgaggccacctgctgtgacgtactccttcgtttcaaaataaatcgatctcttaccgcatataatataatgaatctgatatttagattcattgtattatgatgcattatatttcgtatgggattgatttattttgtaatggaggcagcagtatagacgatgttggtattaaagttaatgattaaattggtaataattttcaaacccataaaggtcttaggcaagggggaattatcttcaattctttttaatatagtggctgatatgcttgctttactgattaagattaagagggctaaagatgctagttctataaatggtgtaattcctcatttggtagatgatggtttatctatattgcagtatgcagataatactatcatttttctagagcataatttacagcaagcaaataatctaaaattgattttatccgtatttgaaaagctctctggtctgaaaattaattttcacaaaagtgaattgttttgcttcggtcaagcgaaggatcattacgatcaatattctaatatgagtaaaatgcaccagcgatccttaaacttgtcaggagatttcacttcggtccacgaacttgcaaagcgcatattaaggcccctaaacttggtttattgtatcatctcggtccaaagccgcgtttgaccgtggtcttgcctacatggcacgtgtcacgcccagaaatttaacccaaatttctagactattttgcgtattaaatccctgtccaggaccagccagggtacacaaaacgacaagtaatatacagttccaaacgtaaataaagcgtaaaatacttacgaaagaggcacttagtcctcacaccgaaacagaacgacagcagcggaaaaaggcgatcctagcggggcttcagctccactccacaggcaaaactcaactggggtctgagccttggtcctctaactccatcttcagctcagaagcactacacttctgaaaagggggaataaaagcaagactgagtacaaccaccgtactcagcaagccacactaacgatgcagatgtgcaaggggatacaaggatggtttgtgactatttgcataaaggcggttgtaaaacattttattgagcaaaacagtaaaactgttgagtaattaaagtaacattaaatctccattgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacaacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatctggaagcgacagaggccgtcgcagggcccgccccgctccatcacgcccacccttgcctggatgcgtcgactagaggaaagctacactacaagcccagccgttgtccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatactaaaaggtctaatacggtaattatcccatcaactgagctaatggtaattaagcatggctaagcatatagttctagctaggtcacataagtaacatgagctagtcgatttattacccaatgttgacaaaggacatatatcaagtaaatatggcacaagcgagcagataggtaaaaccctgaccccatgtaattagcaaaatatgcatatttatttgcaaacagtaaaacatttgcaaattgggatcaacatgctcaaggggaatgtgtgacttgccttgcttcttcaaacaatcttccgaactcttatcctgcgaccgtgatcttccgaaacgacggattctacacgcaggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctagaattattaacgaattattgtgcaattgttaattattttatcaaaggaaaaggctcctgctggcgtcatcaaagggcagcggcgccgacaggcgggccccacacgacagcgggcaagggagtggtccaccgtggactgggaccacggggtggtccatcgccggtccacgggaaccgacggcccaaatcagcccgagctgatcgggct

SEQ ID NO: 14977 - DNA, 1711 bp, Oryza sativa
gggcggcgtggggagagcgagggagagagtgccgggccccggaaacaaggggaaatggacgaagggagcacgggggcgctttttatgggctcggaaaggcgggatcgaggccggacgtggcggaatcggccgacgaagtggggcgcccacgtggggtggtggaggggttaactgtggacccccgtttttataacaggaatcattcgtgtaaacagtaccatttccctggatcaagtagtctggtacacacgagtttatagctgaaataccaaaagcacatacacgagagtctaatgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaaagggtgagtaccaaccgtactcagcaagtcaacacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaggaagtggctccaacagcataaaaattcgtcatgcaacaacccatcccacataagttaagaatttagaaactagccaagtgtaatacatgtcccggtgctcaataaccgcgagcagggctattcgaatagatttggtttactcacactgcagtggatgtacactttacccgcactccgcgactgcccaacacatgagtctcgtctcaacacatgaggcgcgtcacggcaaagcttttcgataacctcgcattggcagtacccgctccatgaacttaaatcctcatgcactctaggcgtccatgtttctagcagtgagagaagttttggcgctcccggaaaagagaagtctcacacacatattaaattatggttcaagttaagttctctctcacacactcatggcagtcctaccaatggcgacaccgatgtagggcacggttctcggccctacctcaacggctgtcccatcgtagcgcacctgcctcactcaggggtgaaccatctatgcagggatactgcctccgctcggctatctaatccgctaggtctatacccattcgaaaagtacggttgtacggggttgtttcatgcttaacttcatggctcggtccttaattgactggggacggtactagccttttccagataccacccaaatcatccgtccgccccagtcgaaaacagttgttttcgctttattttcctttcacaaatcatgttatcaatttcatggcaatgtggcgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatgattacgaaggaat

SEQ ID NO: 14978 - DNA, 1025 bp, Oryza sativa
ataagtgctagtacatacctatttctctgcgtattatttccaacctcctgtaattattttccaattagaaaatggataaaataaactatcaagaaattggtatattaactgatcaaatccaatacctcttccaacatttctttcaggacataatgagtctgagagagtacttcttgcaaaaagaaactctgcatcttttcagccatgccaccgatgtcacccatcagcgcataggcatcaataacctattgtccacgtgtaaacatataaagaatggaacttgtaaattagcaaagcaaatagataactaagacttccctaacaactaagccaatcaagggctcacgaggaaaaacaacaatggaaatactcacagttagatagctttcctcatggaaggtctgacaaacccctagtaaatgggtgtctaatttttggattgttcgtgccaaccatgcctgaggatgtattcatagtataaacaccatcaaaaggacaaacattatacagctatttgttcaatttgatggtggacaagtttcttttgctctttgaacataccaaaagaaagctttgagatgaagataggttcaatgcattctacacttgacatagaagcaagcaataaatgcaataaaataataacaattacctcaatcccacgccccatttcttgtacagaagaaaggcctgaatagttctccaagatttgcaaatattcaggcaataattgaaacgcctgcaaacatcagcaacatggcataagaaaactaccataaatataagaaggcataggtgattaacagcataagaaacaactactgtggtagttcagactgtggagcaaccaacatactacaacaggtcaggtgatttatggggttgaaaactactggagtaaataaagcagtagctaatatcaccctagagtaaaagagatggattcatgaaacagatagagaaaacagcaggcattgataaaattcagctcacctgaaaatagttttctttcttcacaaaacttt

SEQ ID NO: 14979 - DNA, 1505 bp, Oryza sativa
ccacccaaatcatccgtccggccccagtcaaaaacagttgttttcgctttattttcctttcacaaatcatgttatcaatttcatggcaatgtggcgctcatgtctccacatgccgcatctcaatttcccttcccaaaggtattgcccaagcatttagcatttgataaatatgagtatgcatgatcctagaatagcatttctaagcaattgtcataattgactagggactcatacgtaaacatgattacgaaggaataagggataaacaataatcaaggcatggcataatcacaagtaggatgttcatcattgcatgcaattttatttataaacaaaataatttcgcaattgggatcaacatgttcaaggaatagtgatgacttgccttgctcaaggtcttgcgggtcttggccttcacccggatccgcggctccctcggtctctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttacgggtataaatgttttgttgtcataagtttttaatttaatctacctgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactacagcgaattgatttcttatagaaattaccaagaataatccataatttatattaaattttgcaattctacgactatagttaatctataattaaattctaattattttaaattttctaaacttccctaatctccctctaatttcctatttatttccttttcctttttctccctttccttttttttctttcctttctttttcttttcttttctcttttctccccccccctttttttcctttttcttttcttttcccctccctcccggcttctttctctcttcccgggcttctccctccctctctctgggctccttgctacctggggcggcgacggcgaccgagcaaggaaaggaggcggcggcttaccgacggcggtggcggtgacggcggcgcgatgacggcgcacggcgcggcggcacgaaggtagcggtgcggcggcgcgagggctgcgcgactgcgaccgcggcgcaaggcggcgacgcacggcgcggcggctccggggcgacggtgcggcggcttcgaaggtggcggcgcggcggcacgacaacggcggcgcgtagagaaggggaagagggagaggaagggggagatggagtggggaaaatgggga

SEQ ID NO: 14980 - DNA, 676 bp, Oryza sativa
tgcatctgtgtgtttttataccccaaactgtagtctgtacttccaatccggtactgaagcgcccttttgaactggcacacaagctcggcattgctccgttgcaagctttttttctaccccctaattttggtgtgtgaacgtaattcgggtaattcgggaagagtatgctgctgattttctcctgtttattgcatatctgagccaagtaatatttctggaatggacgttaacatgcctcgatagtatcaaaaggcataacttgttatccttgcctacgataaagtctcgattagtagtcgatttggcatcaaaacaccagagaaatgcagatcatttgcttctacagcgcatatttcacccaaaaaaaaaacatatacagcaattggttctgactctttcaagttgagcgcaaaccacataaagactacccgagtcacaatgttatttggtcagcgtaacaagttccatggatgctcacaagtcacagccacaaaaacaaaaggcacagcagcacgacactactacagaaatcgaaacaaaatcaaaacactcacaagccgtaacgaacaaaatgaccagggaggcattccagattttggctatatataggacagtttaatccaacttcgcgtagctcaatccattgctatctgtttttcgccttccgtttgcccca

SEQ ID NO: 14981 - DNA, 907 bp, Oryza sativa
aatatcatttcggttactttaggctggtactgcgcgcataagctgttgcgtgggcttaacgaactaaactaaagaccaggcctttaagcaacccatttaaatgatcttgtcatgggctcatggccggtatcaggtgagcccacgtatagcccataaagaacggcccactcaagcaaaatcagcaccatccacagtccgttttacaatcatcaggcccgttatggccctgtatattcgaactacaagcccatcatgggcccaactttggcccttatatttgaagaagaagcccattatggaaatcagagacccacatttggcccatttatgatccgttcaaacccatatattcaccgagtaggcccatgttgataacccatttccggcccatattggagcgtttaggcccacttacggcccattggcggtgtgttggaatatgtaggcccattaacagagttttgtacgactgttttgcggttggaataagatcactttgactccctcaactgaccaccgaatctaaatcgtatccctcaaccgcaataccagaaatcttgaccccccgaacttgtaaaaccggtgcaatctgactcccttggtggttttggatggcggtttcgctgacgtggcgcacacgtggcagtgttgacctggtctttgttccacgtggcattgacgtggcgtttatgtggcattaaaataaaaaaatatatgcggggcccatttatcattcacacaaaaaaaattgtgggacccactgacatgtggatcccacaatgtatcttctctctcactatccttcttcctcctctctcccttatttctctctctctctccccctgacaagaaccgatggcaggcgagggctcggtggcggcatcagcgagtgggtgccggagtggtg

SEQ ID NO: 14982 - DNA, 4253 bp, Oryza sativa
cctgtacgccgatatttaccacctgtgcacaaaaaggcagatattcagacagctaaactagacaagcaataaatttaaacttgtagattacatctcatgtgtgtcgatgtacatcttttgcttttctgctttgaagctgtttccttccgttcatctggacccactgaaagaggaaaatgatagtatgttaaactatggaaagtatgtacaacgaccacctagtaaaatttgggcttgaaacggattaactgatacattaaagcaacattcatgaatcatcatggtgcatatgtacctgagtgcaaaatcaggttccctgtcaactttacgcagacttacattcatatacaggccctgcgagaaagaagagtattttagtgtatttttcagatctgaataagatgggaggattgagttctgctgtcaattgaagcaaatatttcttcatttccagcatcccgtctgcccattcaggtagaagctggcaacttacagtgactatatgcaatagttccaattgcaacatgaccagattttccaatttcctcgaccaagtttcaactagtttttatatatttatttatttattttgggcgaggagtggtatggtaaaatatgcaggaaaagtgactacttctaaactctaaagctgatctagacaaattataaactcagatcatgtgccctttacaagtgtgacgataattatctcgttctaggttctttcctacttcctccgttttacaatgtaagtcattctaggggcccaattttttttttccacattcatattgatgttaatgaatcttgtcatcatttcccacattcatattaatgttaatgaatctagacaggattcattaacatcaatatgaatgtgaaaaatgctagaatgacttacattggaaacggagggagtagtagacaggtaagtggtttagtatttgttatatttcaacatttaatgccatctgctagcagtcataagcattgacagtggaacacttacattggttgtatgaattgtggccccagtagtcatgttaattttttgatctggcacaagctcaatgtccatcttctgcaacacaacagcaagtgccacaattgcttccaagagagcaaactgatctccaacacatttccgaggacctcccctgaatgggataaatctgaaaaagagaagtgacagaaaggcagcatagtttaatttgtgtgtgtgtgtgtgtgtgtgtgtgtgtgtgtgtgtgtgtgtccagatgatttaaagtcagttcgatgataagtggacacgttgtaaaaacaggttaaaaaaatatctcaagatgacctgtattcagtgtttgtctcatttggaacaggtccctctaaatcaaatctctcaggaataaaatcatcagctctgtcccaaacctttgcataaggaacaaacaatcaattgtaaaaatgtataatgttatggtcgttcagacattgctaagaggatgacaatatcataaagacagcagaatgattgcttattcactgtgacataaatttcattgccagtcacaccatttcaactagtgagcagataaccctgcaatgcgctgctaaagaaaatctacatttcacaaatatgctggacatagatatggtactttctctaaacaattggcataaagagcttaaaaaacgccaatcaataatgcatgtgctccaatattcagatggaaaacgtacctcaggtgacctgtgtatattgtacactgaaatcataatatcttgaccagctttgatcttatagtttccgggaagcacatcatcaactatggctcgccgtatcaacacctgttaacaagaagcccttgagtaacctaaactaactctgaagttggttgactaagcacaaggaatgtacaggtgggtgtggataaagccgcatagactcatttatacagcgcatcaagtacttcagctcttttagatcttcatatctggggagtctaccttgtagaacacggtcaacctctgcttgagctctcctcagcgctgctggatccttcagtagtgcaatactgagtagtcaacatatagttaagggatagcttatcttaagtaacgttttacttgttaaatcattagcgcaaggcgcaagcaataagggagtaccttactgagaagataaatagtccacgtcagtacagagcctgttgtttcatgaccagcaactaacattgacaatagatcatcacgttactgcacactggttacctggaccgcataaagaaaagcatgttaggtaacggcagtaaaacaagtcaaaagcaagatgcatgcatgtgagatagtgaaaaagagtattaataggaagttccattcaaatgcatcattagtttgaaacaaaagctttgtggattccgtgaaagtattacccacaaaaacaaaggaactgtgcatggaaactgtcttataagattcaaaaatcaataataagtccatgtcacaaaattctatgaaatgagggaatagctttctactagtacaaaaatcaatgaagactacaattgctgtaaaacaacatcaaggctttagattagtcaaaagtacctcttcacggctagcaagtaggaatcgcagaatgctagggtctgcctcccctacatattcctcaccctcaatttgtaaattaaaagcatgtacaatattcttgcatttggtaattaggtcctcaacggtattcctgatgatgttaactgccttttctgcttttatttgtctaggaacaatcttgcacagcaaatcaatctatcaagaacaaacaagggctacatcagacatcagtcagcgacatcagtcagcaatttcgtctcactagaagttagataggccaaccataattggattttttagaaaataacatggcaaaaggaacattaccttccagtatggtaaaagatctgtagaacgaagttctgcttccttgagtgcagtgtaaacagcatcaataacagggctatctgatgtgagggaatcaaaattgtaattgaacaaggacaaaccaatcacatctaaagtcatttgagagaaccttgcttccatatttacaggtttgccacttaaagcagatgtctcaagcttctccactaatctctcagcacatttacaaaaaactctgtcaaccatcaccgagagaaatcgtttgtgtagagatggtacaactgatcgacgtctcacctgaacagataccaaaacaagtgtaagttgaacaagagattatcaattaggtaagtagcacataaaaaggtaaggggcaaacaagggattgtaagaaaacaccaaaccatgtgaattagatataggaacctttcacctttcagaaccaacccacaatcacctttttgttttcatatttttttatactagtttcactgttccagctacaaaatgaaatactactctagtacactacagaatatcctcatgtccacaggagcacctatattctgttaatagcttgtgagaagctactgtaatactaaatgggtaataacattgacttctgataacattacataagatctaataacattgcaaggcaataccttcgtgtgtcctatccaattcaaaatgcagggaaatttcttcaacacatacgagaaactaaatggctacatcaaacagcttaaaacaaccaaattacaaagttagaggaaaactgttaacttcacctaactatgcaaaattcactccatacctaaatttctatccttatcaagtgaggaccagaggcaatatcttctgggagcggtaaaaagttaggtatttatttccaaatccctaggatgctatgctatgaaccaccagcacatcaatacagaatagattatccagaaaaaaaaaggacagccataaaggaatcacggggtaatgtcaaaaactctaactactccacaattaccgcttaacaaacaatcgaatggcccacatcctttggtaactcaatctaaaaataaccaaattctaaggatttactacaacgacataatccgctataatttttgcaggtttaagccaatcaggaacatttcacagcactatactactataggatagtcacttagccatcccctcaaaaacagcattagtccagaacacgaagagagacagagagagagagagagagcaccgtacagagagcgccctcggcgatggcgaacccggagccgaagaggaactcggaaacctcgcgacgagccccttctcgtacctcg

SEQ ID NO: 14983 - DNA, 10730 bp, Oryza sativa
  unsure (1)..(10730): unsure at all n locations
tgtctcacactcttctcgtttgggtaggcagctggggaggatgtcggagggctgttgccttcaacggggctaggtgggacgagggcgtcggcggccggcgacgggcgacacgacggcggcggctggcaactggcgacgcaccgccgttgcaaaggccgcaggagcggaggtgggccgccgtcgagggaggaggtaggcaagcaaggggggcggggaggccggcgatgacctcctcaccggctgcgagggggagcaaggcgtcggcggcaacgaggcggttcttagccgcggccagctcgacccgtagtctctcaagctcctcgccgagcggcatggagggacgacacggcggcggcaagccagtcgcatcgtcgggtttgatttccgacagcaaatttccctgcgcaaacatcagatcgggatggctgcggcgatcaggatgcatgattcggaagaaggtcactacagttttcactcaattttgtccaggtcgttcactcaattcggaatgaaattcattttcagtagcactggcacatgatttttcaaaaacatcaagttgtctcaactcttcggatcgaacaactgctttcttggatcaacatcaacaaaataggattataggagcgctggccgctgcacatgatttttttggttggatgcggcagatttggcaacgctgaggagctccgcggtgtgcaggaacgtgtcgccgcgagcgtcgtggtgtgcggagaaggagaacagcgggcaacgtgacgcggcggcgaggacgacgacgcccaagcccgctctttgcgcggagaaggagagctaccgtctgggcagagagctaccgtctagattttttttatgtttgcgtgtgatcaaggctagacaaagagctagatggtagctctctgcctagggcccaacctcagcgccaagaaaaatggtgttgagacttaagacctcggcgccaaatcaagtggcgccgagctctgtaacttaaccgtgtgcttgcggccgacccaacatcccttttgtgttggccgtcaacttggcgctgagcctacaaacgtcagtgccaggagtaatggcgctgaggtcctcaatgccaaggcaacgcccaacataagagctatgttgggcgggcaggcctcgcgcggctgttgacagaaaatacgaggcctgggagatctgcttaactccagtgcaggtccaaagctcgccttcggatgtatgagcgtgccatttgatttgatattgcaatcaacaagaaatagaacaaagaaaccccaattaatcctataaatgataaccgatcggctaggtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgggatagatcggtcgccttgccgagacagtataaatcacttatatcgaaatatatattaatagtaggattatatacattcatagcatagccgatcaggtggatctagcatgtatctgctaatactccgatactactctatactaagattttaaagtaagtagaatatactaaacataagcttaatatacttagatgcgacaaaatcttaacataaagggcagatttaacatatagatcaagcatatagaataaaagtagttaaatcagataagatcggctgaaactctgatactaccctaatcagcaaccagaaagcaggctagagattgcaattttaagcacgacttaatagatcaaactcaactgatgcagcattaagtatgaaaagaaaaacaatatctggacaatcaagccactggaagtttcatagagtggtagatatatcacatagtctaagttaacatcattgtctaacctaatcggctgccttccattaacagatgttagccgattacagattagatgaagatattatcgaagattatgtgagatatatgataactcgacgaattatatagacaagattagagtgtcataaagatggaagcactaatcttgagaacataagtcgtcatgacaagctttacctcttgttgaagatcgaaaccgatgcagctcaacccgagagcacgaactcgtcgaaataaaagtaaagcataaagggtggcgatgcgccgagattgtattggatgtcttgttttttttacataggactcgggtctatttatacccgagaattacaagatacgttcataacagacacgactattatctctaacaaactctaagataccataagtatttacggcagacttttacccaaacatatctctaaggaaattaaatagaatatcctaattaatagatacaattgccttcccaggactctatccatgcatggcaatcatcttgaagcacatcaacttgaacccgatgacgtacaccgagtcatattatcagaatcggttgtatcggctaaccccgtccgacttgaactatgccgacctgaccttagccgatttggactgcagccgattcttactctatttccgcaacgatcttcatcttggattccacttcgatctgatctttacctccgatgccaatagtgatagaatttaccaaatttggttgttaacagcggctaagtccgaaacctcagcgccaatgtacatggcgctgaggtttgtaggctcagtgacaatctcaatggcgttgagatttgccggctcaacgcgtccttgcggccgaacacaggagcgatgttgagcggcaaggacgcgagcgtctaagtcccaaatctcagcgccaagcaagctggtgctgagcttagtggtttagcgccaatgagactggcgttgacatcctgccacgtaagcgtgaggattggtagggggatggttggcgctgaccccgtggcctatttttggttgaagtttttagcaagtactagttttgaaataagttttccccaaggaccaatttgtcaaaaactcccgaggaccaggtgccagttggagaagtcagatgacgagacttttccgatcctatccaacccatccgtcccgccccgttgctactccctccggtttgataatacttgtcattttggacaaggatacggtcttcaaaaaataattttgactattattttttattataatatgtataaaagtattaacaaatatatgattttattaaagtatttttaagactaatctatacatgtttgaaagataaatattttaaaaatgatttaaatcaaatattctaaaatttaatctcacccttatctaaaacgataagtattatcagcccggagatgggaagagcatttgttctccaacgattgtgctgaagagagactgatttgtacaagtgtgaatgccgcacgtgtgtctatgtaatggacttgagtaattagtcttaagcatccctaattcgtggacaagaaacttaaatcaagcgatccaagacgaagacagccgatcccgggacaggagggcatgtctgacacagcaactttttctttcacacacacaggacagtatggcacaccatgaccaccgatgacgcaacccgcgagatcagtttggggagatgcagcgcagctagctaggagtagcgatgttcggtagcagaacagacaaaaggcaaccgtgggcaaccaaccagcagagcccgcgtttgcggatgaccatccagctgcactgcatgtacgaccgattcgcgccgcggaattataaaccggatccgatcctagtccattcattcacaacacacgtgtgttcttgatcttggataggggtagtacctgggttcaaacaacgaaccagcgaaagcacaaaacaacgcagtgtcgatcgagccatatgagtggagttgggatcctatcctgtaaatgtacgtgcagtaagtcactgacatatgggtctaaaatttaggtgggacccacatgtcagtgacacataccacaggtacagtaatgtacaacagtggatttgcatccgagtgaccattttaattttaataaccacccaagatggatcggaccggttccatctcactttttttttaacctttaccgacctcatctcacctcagttgtatgactgtatctcctccattcgagtcatgttactgttcacagatccccacacgatgctgtagggcctctgcatttcgccaggcccgtcaataaaatatgagtgtcgtatgataaacacactctcttcctctcacgacagtagatactactactcctatatcctaccaatggatcaaaaggagacagaaaaaaacggacgcggaggaaaaaaacaaggagcagcacgcatggtcgttcgtactcccccaagctgttaattattcaaaatacttactgctaccaccaccagttcgtcccgtacctgtagtaacgaatagatcagtttaactgtcagacactcatgttcacccaaaggaatacaaggcggagtaggattctctcgccgatgcgtcgcggcgggagaggacacgtcggcactcggtcggcagcgggagagatcacgacaggacgacggcagcgcggtgcgtggcgtggcctactggagtatactactgctccatctatcgtagggtgtgtttagttcaaaataaaattagaagtttggttgaattggaacggtgtgacggaaaaatggaaagtttatagctcctatcgtttagctttttccctgataagtcaaaatggtttattagggaacaaaaataaatttttagataaaaattttatatatgtgttcttgttaacttaaaagccaatgctgaaaaagaaactacgttgaaaatatcaaaatcaatctcaaaattaagtttgaaaatttaaattttatcttattatttggctgtttaggccatccgatgggagcatgtgtatagaaaaattttgatgtgatggaaaagttggaagtttgaaaaaaagttcgaaactaaccagaccctataagtacactccaatcttaagtacggttgtgggtctttttactaacgttcattttatttaaaattattttataataattatttttatttttattagatgataaaatataaatagtattttatatatgacttgttttttatttttaattatgttttaaaatgaaatggacgattaaacgttgaacataaccttggaatgagacggatgagtaatatactgcgagtttaggcgcacgggcggcgggggtgggcatccgatgcggtggggttgggggtggggggcaagcaaagactggggcaagtacagtggtgtggcgccgctccggaaattcgcttcgcttcgcggcgcggcggctgaggatcagcgtcagccggatgggaatcccaggcgtggaagcgcgatttttaatttgggcggcccccgaggcggtatccgatgatctccttgtcggctacccgcgtcaaacacactggtatagtgcggctaggtacccaacttttctgctgttttacacaacggtccttcctctatttgactatgcctacccgtatggtagcaacttatttcctcctattgtagtaattcttaacattttcaataatgatactgtctctaaaatatatctttaacaaattttctattattacagtactttgtaaaataaatttatatgttgttctagtacctttcaactatatatttttcaaagttatttatagtaaagttataaaattttaacctcaactttgggtgtgtttagttcacgtaaaaattggaagtttgattgaaattgaaacgatgtgacggaaaaattaaaagtttatgtgtgtaggaaaattttgatgtgtcagaaaagttgaaagtttgaagaaaaagttaggaactaaaccaggcctttgtataaaacatcaagaattatagatttggagggagtactccatatccgttttatattgtgaaaaattttgggtttcatgctgtgaaacacttcaaaatgttgatgcatttcttttattgaacttggacaagaccaaaataacttatataatatactagaatagagtgaaaactgtttctacgcaaacattattaggtaccaagatgtgtacaatgtggaaagctatggtatgtattaataattcatccatttcatatgtaattatcgcttttccgtgattatctttcatgcaactttttttgttattatgtggaaagttagctttaagggcctgttcactttgatgtcattttcaaccttaccaaatttcggtaaagttaccaaaaagagtggctacatttagtttgttgttaaattttggtaactatgtaagaaatcctgcccaaattttggtaaggtattttttttattaaagtgaacaggccttaaaagaaaaaaggcttgcttatatcttggaacaaatttatactccagcaaagtcaaatacacatggatcgacctagctagccttttcatactgtgcactcaaaaccatacctttagtgtggaggataacatagtatcccactacaattccactgctataaaacccctagtttatttgattttaataacaaaacaaagttctacaattagcaagccttaactagggaaggcaatgaaaacaaaaatcaaactacattagactaggtcaaaatgcacccacaaccacaacggttatgtgctcgagccagtatctcatactaccaatactacaccaacaccaacactacatactactactagcggactgtacatacaaggggaataatacaagctaaaataaagctactccactcctagagaaggaggacctaaacgcaataaccaagtcaattaaacacggttggtacaaaaaggacacccgcccaatacaaaaacgccactacaaatgcaaccgcaaatgcacggccctttcccccaaaacccccactgcattcccccccaaacccacaaaccccgccgctggatcaacaccacctcaagctcgaagtgagccactgtcccaagcaaccttccttcttctccccacctcgttttctccaaatcgccattcacaacccatacacactctgtgcgcgtgtgtgtctctatgatgtcggcgtcgccggagttctacaagccggcgccggtgttctcgccgtgcagctcgccgctgcggctgctgcagcagcagcacggggaggatcatcaggaggagtacggctacggcagcagcggcggctgctgcaggacgccgacgggaggggagagcaacctgaaggcgccagggacgtgcccgccggcgccgaggaagccgcgcgcgcccgccgcgccgtgccggaagcggctgttcgaggtcgaggtgttaagcctccgcctcgaggagctcgagcgcctcttctggcgccctccgccgccgccgccgacgacgcagccgcagccgcagccgcagcagccgccgcagaagcgccggagggtggccaagctcggcagctagctagctcgccggagtagcacacgtgtgcgtggatggccataagtggtgttggttgggttagttactagagctaaagctagagtagttcggagttggtaggatttaggcgtactggcgtttttactgctgtacttgcactatatttctactgctcaaattatctccatggctagtatagctggttgtacactttgtactatacctgcctagctaaggttgctactactactactgtagcgtatcagtgcagtttatactagtatctgtgtatgtgatggcattgggggtgtgtactcctggtacgtattagcaatcaataggagcttagcttgaatttgcttccatgcatatatggcagttgcagtgcagcctgtgaagtaatgacaagttgtatgatccgtgtatacatccatcaatgtatcagtgaatcaatccttgcaacgaatacaatgagaagcagctcaatcctcatatgttctactattgcttccgtcctaaaatatagctacttcctattacatgttttctctactttgtgcaacagataggagtagttctcgaaagtatggagatactgatccatctgcgtagcaactggcaagaacgcaagatggatggattcagtttcagagtgagctgcacctcccaggcacagcacgcagctgggctggaaggaggtgcaagggggagaggaatcattcagaaatgtgagacgagagcagaaggccaaagcatcgagtggtagtagcaagcagtaatgatgtgtgtcgctgctgtggcttgctttgtagtagtagtagtaccgaaaatttttctgcaggctttgcacccggcaaggctccagcaggggagcctgtgctgaaggtaccagaaggaataattttgggcaccggtgccagtaaatgtaagaacgtgtggtgttgggggtcttggttggggatccaagtccatctatcatcacataagcatcgcaagcagcagctgtccatgtgttctggacttctggtgcgctcgcagatagagcagcgaggaatacggtgatgccgaaatgcatatgaacatcaggctaaagcatgaattgaaaaaaaaataatactgtcactccatatgcaaatgcaatgtatttttacggtatgaatttattatagcatcattagttattattactacagtaggagtgaggtttaaagctgcagtgaataccgcaatttaagcatttatgacgcatctgtacactacagtcatttaagacatctggagcgagtttgcagggtagtacacactcctattgaaacagttgctccgttgcccctttgtttatgagttttgaggacatatgggacacgtagaaaaagattggtatttattgagccaatgctccatgtatggtgtacatacatactgttatttttgctgttgagtacttaccccagtaatatgatacaaagatcgacgcttcaatatacaccaagggtgaatcatggggttagcttcaaaatgagccgaaaggtgaaagaatcgccaagaaaaaaaagaaataataagaaaaggaaaaaaaataagggagcaaaacacaacagctctatatgcagctgaagaaaacaaaaacaattacagccgttttcgcctatggtcctgcctcaatcctctcgatggtttctaacctcgttttccgtttccatcctttcatagtcgcaaccaggttaaccaacccgacaacctgacttttgctgtattcctgtaagatcagacaacaaaaacataaatcattttgtagaagtatcattaccaaaagtgaaaatttactcaaaaaaatatatagattaacagggttcttactggatgagaccgtgcccaatgaacatactcggtctctggcaaataataagcctgtaaagagtaaaaggctttgtcaggttcttataaatgaaaaggccaaatgaagcatacaaaggcactcggtctctagcagatagtacgtggttggcatagcgggagtactccaagccaattactactgcagaagcgtggtgtaaatgaagccttgactggtgcatgcaacgtacctttatgaaagtatccacaatttgcagctttggcctaacatttgcggatacaatgtgcagcagcccattaattagtccctaaaggagcagagaaaatctttatgagtattcatccatgcctttcaatctagataagctactgggtaagaataaaaaagattacaacctgaaggtccagtgacatcaaagcccgtccttcatctgtgcaccgttttaccatagagagacctcaattanaactttgtgagatgctatttatgccatactccagcaagaggtcttggagctgggaagaaaatttacaagttcaatcacctttaacatcagtatatcatcgataattttaaaattaagngcgtgtgtttagttcacactaaagtttggaagtttggttgaaattggtacgatgtgatagaaaagttgtgtgtgtatgaaatgtttgatgtgacggaaagttgaaagtttggaaaaaaactttggaactaaacagggccatagtttgaaaaccgaagaactatcttaatgacgaagcagaatgaagtactccctccgtcccaaaaaaaactcaacctaagaggggtgacccctcctaggacaacgaatctagactaagggtaatccagattcattgtactaggggtcaaattccctcctaggttgaatttttttgggacggagggagtaggtccgaaaacattgtattgctcgccacataaagaacacaaacaaagcacattaaccaaaaagggaggagggggtgcccttggcttgtactaacctccttggaaattcctccatggtccaatctagttttgtagtgcttgaattcacccaataacaaatcaacatagctgtaataaaaggtgcaaacaacatcatcagtggcactccaggtcacaattaaaaaacaccactatcaaccataatcctttaactatgcaatttgtaatcagatccctaactatgatactaagaattaaacacattcaatgcagccctgaattattccaaatgcatgtacaagttacagattttttgatatatccagcatggcgaattttgatatgttggcttcaaagtacaaggacctaatactccacccaatttttttagcacactgcgaaaggaaaggtgtggtttttcttttctgtaagagtaaattcaacaagacccaatat

SEQ ID NO: 14984 - DNA, 756 bp, Oryza sativa
ctcgctcgcttcaaacccacaaaatgcttcaccagccaagataaaaatggtgagatcttcgtagttcttcaaaaattgatacgtgctagttgagaaacaaactgaagaggacagtaatacagataagcgacttgttgctagttgccaaagatttctccgccctctttcaaatgcatgtgcaacaagttttgcagcatctgtccttagctgatagaatggtgaatctgttcctgatgtgctagtatcaggattgctgacatcagaagatgatgtcctgtcactcatttcagctgcatgacctctacctgaatcacctaatgattcatctgcactctgggatgtgttgttccttcctgtcagagagttttcgccctcggactcgatactctgaaaagtaaccacagtaaaaacgaataaagatatcaaaaatcaaaacaactcaaccaaaatattgcattagaatatgtaaaattatggaaagataagcctaattaacttacatctcttttattctcaaaacaggtaattcttggtgatatattatgtacgggtcaacttacagcatatttgacagttgccaactgccagctccatacacaaaatagagtttaaactgttaacatttgacatctttatacataaaagtttgttcagttgtaagattctggatgcttttattgttgttgttatttcaacttcctaaactattatttctcagttcggctttgcaattttttatgatggtttacaatttta

SEQ ID NO: 14985 - DNA, 5258 bp, Oryza sativa
tttactatgataacaataagtaaaaacaatatgtaagatagcttaaacaacataataagcttatataaacataagcttatataaacataagtttatataagttgatgcgatttaaatttaaatagtatgtagaatgatgattcaaatgtaaaagtaagatgatgtggttttattagagaacaaaagaagaaagataatttagaccatacatctaagagctaaaaaaaagatatggcttaataagagaagaaaataagagagataattttaaccatagattaatcatctaaggactaaaaacaattgatgtgatgtgacttaataagagaaaaaaacatgaactaagtaagaataaactacttcctccgtttcatattataagactttctagtattgcccacattcatacagatgttaatgaatctagaaagtcttataacctgaaacggaggtagtatataggtatataggatattataaaaaagatgaagagatatattgaaatattatgtgaattatgtgggatgatttaacattcttacattttaaatatctaaaatttaataaattatagatgatatatcatgcttgcatgatgcttaaatgtaataattgttagttgataatgatgtatcatttttacatgttaaattttagaaattagtgggatatatataagagaggattccgtagtgtacgttcctaacacttatgcatcaccgtgttcaatttgaagatcttagatacttaatactcgtgttagtctaaccacttgaagttaatgatcctgtggagtacaaatttattttatgtgctttatgaggtactccatcattgtcacactgttcagtactgttcactgcagtattcacacactaatacaactcttatcttttgtttcatctattcgcacgttacacatgtgcatagctttgaacttgaagcggtggtccaacaagtactaatcgtgcacaaagtcttgcacacccttgcacttcacaacagaaacatcaataattgggggagctgtagtttgaaattttgggttttcttgtgatagaactctaatgtcgcctttggtacaattatactacaatatgattaactgtatccactccctcttaggctgcattcgaaaactacaatcttttatcttctattcccttatttttctttagcacactcactgaactgctaaacggtatattcttttaaaaaaacatgtaaaaaagtttcttaaaaacatattaatcaattttcatgtttttaaaaccaatatttaattaatcacgtgctaatgagtcataccgttatgcgtggacggaggagaagatccaaacccctctatctgaacgcaccctagtccttttccaacctctagccatatgtatggttagtgtcaactataacaggttgaccaagggtaattagtttataaaaaaaactctatttcatctcgtatatgataatagccgctttatctcttatcgtgattgtcaatccaattttatttctaatatccctacacacgttgagatattttatttttttcaaggataacctttgacaatcattgacgctcgcaaccaccataccacattgtcctaccaactctcctagctaaaaaaaatgtatcatgtcgtcccaccaaacctcctagctatagaagatatatcatcgcgatacttcgtgttgaaacaagtggtgctatgctccatgactagagattaattccattgtactctctcatcgcccatggcaaagatctatggtcaggctttggtaactatggtaactatagctatgtttggatagagcttgagattttgagaaacatttgatgagccaaatacgaagttaagcttcttggcttctgacttttagtttatttttaattctgtaactataaattctcaaaatctttctgagaatccaaattctctacttacgagaagctcctccaaacatgcaacaaaaacctaagaaagtgaagtacgaatcttgagtcacgaacaatgaccagatcttgctaaccctggagagaattatttggacaatgaaaatactgggaaaaaagaaaatgttacagaatggtatcccgttcggatgggataatgcctttgagctactgcatgatatagctagtattgactgaggtatcatacgatacctggtaggtatcagctgatatcccgttcaaacgaaatgatatctttgaggtattacataatacctaagatgtataggatgatacctgtccgaacataatactgtcctgtaacattcttataaaaaaaaaacaattgaaagctggggccatgggcaccgtttttcttccaaaaacccggtagagaggaaatcgggaagcgaattaaatactcagataagccggggaaggcgacgtcgcgcgctctggtctcttcacccgggcaaacatccccacaacgagtggtcctcctcacctcacctccaaccccctcgtctacccacccactgccacgtgggaccagccacccacccgggcccacccgtcagtgaccaaacgtgacgacgaggtgaggcagatcagcggaggcgaggtcgtcgtcaacctcgcgccattaatggcgcgcgcggtaatcagttaatcaccgggcttaagccgctgggggcggagaggcaggcaggcaggcagtgcgccattagcgtcacatggggtgggctcttgtacactagccattaatacggcaggtcgcccatcccatcgcgtctcctccgcttaaatccccgcggctccctcctgtccgtggttgcagctcgctcgccgcgctagagcttagctccgccgccgccgccgccgccatcgccggtcgagctagctctttttggtagtgtagctaaggctagcaagaggccgggagcgcgggtggtgtggccgcggattatctgggtgcttgcttgtgcctccggatcggccgggggtgatcgaggcatggacgcggtcatgtccgccgccgacgacgcgggcgcggcgtccggccgggaggacccaccgccagccgtggtgctcgtctccgccggcgccagccactccgtcgcgctcctcggtaagcgtccttcggggcgggggaagcatttcgtcgaacgccttgccggcgcttctatctaagcgggcgtttgcctttttcttttctttttcttttttcccgttttgcagcgggcaatgtgctgtgctcgtgggggagaggggaggacgggcagctcgggcacggggacgcggaggaccggctggtgccgacggtgctgagcggcttcgacgccgccgcgccggggatcacgtcggtcatctgcggcgccgaccacaccaccgcctactccgaggacgagcagcaggtgtacagctggggctggggagacttcgggaggctcggccatggcaactccagcgacgtgttcactcctcagccagtcaaggccctgcaggggataaagatcaagcagatagcttgcggcgatagccattgtcttgccgtcactatggcaggtgaagtgcaaaggtgagtgaagatcgctgtaaacagccatctgcccatactatttactgtatataactccaggattgtatagtatggttgtcatgtgatcttgtttaaagctgcttatcagcaaccaaaacataatttatgggtaaagcttttatagttattatgtccttagtgatttaaaagtcaatgctaaaaaataaggcatgatgagaaaaaaaaatcccaaaatctacttcaaaattaaattttaaaattcaaatttagaagccgcagggcaagtgatgggatgcagctgctggcaacttttataaatgatgtttttgtttttctatattaccagaaggatgatctgggaattcgaagggttgtgcatatttttttttggatgaatattgaatagtggcaaattcttacattattctgttgtgttgcgatttctgagttttgggtgactgctgtttgcactgatcttctcatgactttttgttttagttgggggcgcaaccaaaacggacagcttggtcttggaaccactgaagactcattgctcccacaaaagattcaatcttttgaggtagaatattgtgtatcatattcatataattatacatattagaatgttgtgtatcatataattatgtatatcataaaaaggatagttttagtactacctcaccgtttattgatatttgtgcatggaaatagtatacgaatacattgtgctaaggaagagtgtcatgtgaaaatcactggtatggtggcatccattacgcagtctagtgcaaatctttggtcatccctgtacttattaactaaattttgtactccatatcatgaggtggactgcaggtgtagatcctctcacgttattgtaacagttttactctccaatatagacagcacccagagacaataaataatatgttcatgtaataataatctgaacatcctggcccacttattacgtgttgcttcaaagagaaggaagatggataacttttagattttctcaatacactatgcactgttgctaatggtctaacatatgtatagggagtttgtgtgaaaatgattgctgctggtgctgaacataccgctgcagtaactgaagatggtgacctctatggatggggctggggtcgatatggaaacttggggcttggtgatcgcaatgatcggttggtacctgagaaagtatcttctgtggaggtaaatattctaacaagcttgcccttcgcatcccctcctttcaaattccttcaatatttaattcattaaaaaggaatattccatccaatttccagaatatgtttttgaagattccatccctatatgctactggactgtattgtcagtcagtcaccatatcactgttatcatagagttaagaatgagttgaaggagacaagatccttttattttgtcagtcattttctcaatacactattaaaaaacaagatatttcctacatagttcagagcatcctgtattttgttatcaccttatattccaaagcattattagaatcagaacacctaagccaatcattttcttatgtggaattcaatggaatacaatatggtcctagagtcaattaattgaagctagatacactcatctacttatccagtagtgatttatccttggaaactctaatcataggttgctagtattatcaccttttatggttttcgcaaaggaaaggcacttgtactaatcagggacagggaaact

SEQ ID NO: 14986 - DNA, 14299 bp, Oryza sativa
caaccttcgggatatcaacactttttttctttctgtgagcatcatgggcctcttggcaaatcatgcacccatttcgacttccaccagtaccatccactgcgagtccattgtctaagggactaaaagacgcttcatgctccccaaacccccctgctatcatccaccccagacctgatgctgacttgtgccaactaactggaaacattttgtggcattcttttacaagtcaattttgaggtaacgtgagttacgtgattagtgataagctcaggttgtctttatcactaagcatagctctgatttgtatacggagcctagcttgcttgagttccagttctaccggctgcagtcctagatataccatcagtttgacatataatgtttcaaaaatgtttactttcttttgaactggtaatttaccattgtttttactgattctacctcatacttcggatatgcagtttgggcaagtcggagttggtgatactgatgatcactgtttcccagtacaggtcaagtttccagaggatcaggtatggcatatatctggaggaataaatgaactattgaagcatacaagtcataatcacaatatttatgctcaatcaagaacttgatgttccatttcttgtgttgttgctgcagaaagttgcccaagttgcttgcgggtggaggcatactcttgcatttacagaaaagaaaaatgttttctcatgggggaggggtactagcggacaacttggtcatggtgaaatagttgacaggtgtttcctatcaatatttctgtacccataatatcttgctcccaaaatgaatcatttttggtcttctgtaaattaacaatctaccattctgaatctgaaggaacaaacctgtgatgattgatgccttaagcccggatggtcctggctgcaagaaattagagccatcaacagctgtaccatttgcaggttggtcccaacgtgttctagctattgcagcttgccagcttgcagatactagcagttgcatgactaatggtgctttctgctgttttcagccaaagtctgggtctcgccatcagaaagatatgccattgttcctgatgaaaaagtgagttcctttgtgtacttgaagccctttattctcccacaagaacacgaacagttaaaatcaaaccattacacggcacttataatctgatactatactagaactgttactgaagttcttttccttctttacctgtaggttccaaattcaggtgaaggcacggcacgaggcaacggggcggacgcaaatgtaccagagaacgatgtaaagaggatgcgtgtgcattcgtaggggcctggacctcccaatttaactccctagtacactatccaaaaaccccctatgtgcaactgtttcaccgcacgtttccatccagtgctgtcccatttttgtgcatcccattctgcccaagtgatgatttccacgaacccctcctggtgttgttgagatccagtacctattagggttatcgcagctgccactgtctgtaatcgatcacctgcttagaggtgattttagcaaaaaaccaacctgcaccgttgtggacatgtgtttggaatgtttttaacttctgttggaagatgcaataagtgcttggttctgatctcttgatgatttgtcactaaagaatctccccttctgataatcactgagaatataggtgttcgcaaacttttcagaagtggcaaaccggaagagaacttgtgaaacggcacgcttttccaagtgatacaactacgctacagccctatttgtttagacgtttagacttataaactaatttatgagctaaaaaaaatctaagggtgtgtttagttctttgggtgtaaattttttgaagtatacggacgcacatttcaattattaaacgtaaactaataacaaaacaaattatagatttcgtatgtaaactgcgagacgaatttgataagcttaattaatccgtcattagtaaatgtttactgtagcatcacattgtcaaatcatggcgtaattaggctcaaaagatttacctcgcattttacatgcaaactgtgcaatcgattttttttccacgtttaatgtcccatgcatgtccatcggcgggagcgccaccggccgtgtcccgtaggtccattacacgggagcgccgccgaccgtgtcccggccgtgctgctcgccctcgccggttgagtctcggccgtgccgctcgccctcgctggcgctggcccataagagggggtcgcccaccaaaagcgagaagcttggaagagaaatggggaagggcaaggtgaattcctcattgtcgctgccggccgcggtgggtggtggcgatggcggcgctcggggcggagaggaaggaggtgctcgcgtcgaagggccgcggccgacgatgagcgcgcagggagatcctctttgccgtcgccgtcgctgccaccctccttcagggcattgccaccgtgggccgcctcctctctcgcctcacccagccagcgtcgcacccgccacttccccctgcctagcgccgccgtgtcgctcgtcaccggccgccggcggacctgctcctctcccacctctccccgctggcctcctacgcacatgccggccgactaccctggaacggcgagaaaagagagataagggaagggagagaagagggagaaaggtgatgatgtggtcgccctgacacgtggggcccacatgggtctcacgctgacttgatcggcacgtcggacaaaaaccaccgaaggatttaaagtgaacagttttataatttgagggatatcatatatctggttttgtgattaggggacgattttgtatcttgatgacaaatagagggacctttggtatactttttccccgtgaatttaatttcccggcccggccactacagtgagataagcggcccagccggcctggcctccggcgctcgcgcgatcgtctacaaagccgagccgaggtgggcgcgcgcgatcgcgtcccgtctcccgttgggctcgatcggtcgcgtttcgcgtggttggtgcatttggcagctgaggcggggcgacgacgacgacgacgtgaccgcctcacaccgggcggagtgggagaagcgaagcgggcaggagatcgaggagcaccggagcggagcacgtcgcgcgcggggcggtgcgtgcgcggtggggggacgtacgggaaagtgatgtgatgtgatccgcggtggcgccgcgcgcgcgcccgcctgccgatctctagctcggtgctcttgaaaacgaacgagaaaggtttcggccggtcggcgcgaaacgggccgggccgatcagctagagctacaaaagactttaaaagacaccgttaggaacatgaaagaattaatgaacttacgaacggactgtcgtcgcgagcgttggttaaattgtcagacaaaggcagtcgagaagggtgtgattgtgaagcatatacgatttccccgtacgttcagggttgcatccagcgtgtaccgtttctactacacagctgcgcagtctgcagacccttccatttaattttgtgaataagaaaaagaacatgttaagatgagagccctagacgggcgacagccacagctgcgggtgccccagccagccagcatcacgccattacgcacccgcaaagcacagcccaaatgaatcttatatacacggtcggccaccacaccgggaccccggacccccccacactctcccctcgtttccaaggagacgccccacaccaccacacatccacacgcccaaccaagacgcccggtcgatcagtccccacatgcagcgtactacgtacgtgcgtgactagttgtcgtcgtaagttcacccccaacactcgtcgacgcccaagttcgccgcgcggcgcgggcgcgggtaccagccaaggggcagcgtcacaggctcacctctcacagcaggctgatgcgacggcgaagcgcaacgtggcaacgtaccacccaccctcaacaccgtccaaaaatgtaaatgctttctctagtttttttttacgaagattaaagtgagatgtaaaattaaacgagaaataattatgatgggttgagatgaataaataaataaattaaacaataagagatatttgtttaagataattaactgagtagctagtcataagtagccactcacccgtccaaaaacataagggcggtccaacctcataagtagagtactcaatttatcaaatggacgctactttatggtatgtattagctcaataaccaactccttcctttgtcataaaatatatagtaatatactcaattaaacatcatcaagtattataaatattgataaattgtgtatagatttatagtattagtatctaattggttattttttctattaatgtttatggtcattaggatttgaactcttatgagcacacacgactctaccacagcaccaattgttcattctcgtgtctaatcaaatatttggttactatattctagaatggtagagtaacaattagaccaatcaggaatggtccttcagttcaatgaccgatatgatggtttatcttgttccttaactggttttaaaactatcgtaaacccttatatatatatatatatatatatatatatatatatatatatatatatatatatgtttgggatgaaattggaagtaattataattttcttttgacggcgagaatacgtacacaggagtagtatgtctgttacatggcccagcatgcatgcgcgcgtacaaagtagcggtactacgttcggtagctagctagcttgtgttgtaagctttctaacggccggccggcacagttgcgcagtgacgcctcttcctcgtcctgtcggtagatccgtgcaccgcagatctacccacccctgcttccgctttgtcgccacgcccgtacgtacgctgttatactatctaccgccttcggttgtgacttgtgcctgtggttctttgcatggcatatgccactctgccattggcacgcgcgcacacgctaggcgatggcgcacacccactgcccccattatataacaattttatatcgaattcgacatattttaattctatgaatttagacaaaaatatatttagattcgtgataacatgatacgtcaatctgatatttccttcgtttcacaatgtaagtcattctatcatttttcacattaaacattaatatgaatatagaaaatattataatgacttacattatgaaacggagagagtacttgctatatattgagctgtagggagtatttgctattagtactagctggcagcatttttaccgtacgtaattaggacgacctgttgagcaactatttttaccgtactttggagcgttttcgaagtaaccaggggtttgtaccagcactcgaagataaaatagtttattgtagtgttaagttatgcttaagtctcacggtactttaaaaaagaatttatatgaattatacctctcgttgcagaggaagtcctaaaagcgaaacaccaaggacgatttatatatgtaaaaaaaacataggatgaatttaagtgccatgcatgggtattttataattttttttaataaaatgtaccagtatattacgaaattacctgtaatatctgataggtctgatattctttttaaaaaaatttctgaccaatatgacattgtatatgtgaattgagtgtaacttggttttctcgtggtaaaattaacctatctgcggggattcgagtatccaaaaaatcaacttagcatggacacatatattagtaaaaagatgtctatgctaaactcatcagtgttaagatataccgatttattctatctcgaacaagttcgtaggagtggtgacagctaaacgcatataataaattcatcaatctctcgaatgtgcatataggaatggtgaacatgtcaacttgtgtaatcataagggtaaaagagtaagtacttgcgttcgcgtttttaccgtgtttctttaaaaaaatacagttgaaagcaaaactatattttaaaacacgacagtttgcatgaaaaactagcaagagtaaacactaccgtacttactactactgtttactgttaagctgtagccacctaaagagcaagctagggccacacccacactgacacacatatacaagccagagagattgattaatatccctgtcgcaaaacagcgtggcatttcaccaatttttctacacgcaaaccgcagtgtctaacagatgatggacgacttcaccttccctataaccgcagcagcagcagcagcggcggcagataccgccgccgccgccgccgcagcagcagagcccctccgcctccaccaccaccaccaccaccatcgccgccgcggccgcctccacttcgccgcctcgccgctctggttcccttcctcctgccccgtcgccgccgcgccacctgacgtgccggtggccgacgacgccgacaccgccgacgccgccgtggcgagcgccgtcaaagacgtcgacgtcgtcgtcttcgtccgagacgccatggaaggcaaagaacaagaacaagaagatgaagaaggaggaggaggcggtcaagaagaagcgacgtcggacgccgggcggcgggaggaggaggaggggaagaaagaggaggaggcgacagcagcagcagcagcaacaggagagctctcgcgcggcgacggcgacgaggacggcggcgaccatggcggcggtggcgcggcgcgcgacaaggaggagaagatggaccagctgtgggagaacttcaacgaggagctccgccaggcgctgcaccagcgggtgggctcgtgcccccgcgcggacgcgcgggcggcggcggcggccgggatggagctgtcgccggagacgtcggacgcagagtcggagccggcggcggcggcggcgctgcgcgggcacatcgggtgcgcgccgatgctgcggccctcgtcgagggccggcgccggcggctaccgccggacggccaccagctgggtgctgctcatgaagatcttcaggaggctcttcgtcatcgagaagaccatctcgtcgtcgtcgtcggcggcggcgtcggcgtccggccgccatgggagtgcgcgccggtgatgccgccatcattaattcacgatcagcgcgcggcatccgtactgctctttgcacgattaatcgcctgcaattaattaagaagcatcgctagcttctgatgatgctaattaaactgcagttaagtaaattataggcacacgtacgtacgaattgctcctgcatgctgataacgccatgtagctagatagggtttgttcagcagatacaagggactgagggagctagttaagcatcacttgaattttgaattcttcagttttttttacagtaatttatttgaattacaacattttttctttctttcttcctgtgctctcgaattataccatgatttcaggtaggctgaagggcactgctacattatgcatactgattttatttaggcctgtttggggaattagcgagattccaggaaataatcggtatccatccggtgataatctggaacccaacgtggcacgtttagattagttatattataaattatttcatccaattccacattgttatatcatgggatgtaaggagtagttcgaagctgttcagattggaaccaaaataaaccttatcaaattttgacaagttagacaatattatcaaaattttggcaggatttaagtctggcaacaaactaaatatatgtactttttttaataactttgtcaaaaaaaatggtaaggttgaaaatgatatcaatctgaacggcccattcatttcgagaattttggcattttgtagctattgaggctcggaatctccccaaacctgacttaaaagcatcgcttccttctcatgcaaatggtagggtgaattgcaactaattctagcttggtatactagctgtcatcttaatcgaacattaacatggaactgaatatggaattcattttccaggtcttcttcaatgctagctagtagtaatagatcatttaattatcacataatctgcgttaacataatcagaagagatcaagacctacccagattccttttatctctattggtcacgagatgctgtcatgatttgtgacaatatcatctttggatctggacaaggaaaggtgtacggccttttagaggtcactttttttgtgggggaagaaaaagcttccgtactgtgcttagtaggagaaatggaggatgcgtgtttaatttaggtttctcatatagggacaggggattaattcggggcactaaaggccaaaagagatcaaggacagggacatccaacctccaacctgattagagcagtaatgaatctctgctcctaagctatagaagctcctgaagacaggtgagcaccgagttgagtaaaaatgggagaaagcatttgattgtaccagttcagagtagattcagttgcagtgctgcatcaaacaaaatgacagcatattgttaaaccaactggtgtaactggagtttaaggtttgtgatttctggactacaccctctgtcccaaaatatagcaattcttggctacgaatctggacataggttatgtccaggtttgtaagcaggaattggtttattttaagatgaagtatcttttaagaaaggtaaaccagcaagttaaattagagctgaagtgacgggcaacttgaaaatctcacaatgaaggatctgaggtacaattgccagttcaattagcactgggaggaacagaacagttgttgtacaatctagaaacctaacctaaatgaatctcccaattgatgtcaaccaacagctagaggctagagcagacaacccacaagaaattatttgaaacacagaaacaagaatgattgcagctggccctacattcacctactatctcagagcaatgtagtgcatccagattatatatgcagtggataccattgtcaccaaacaaataatacaacaatgatcatatgaacagagggaatcaccctagctgagggaagactacagttatgtaatcgaagatattgacacaaatgcaatctgatttgagtacttaactactcttattttccagttgcgtaatttctgaggtcctgtttgtataactgaagagttgggtatgaatttaggaggatttacccccattttctgtgaaatcccttcattcccaataggaattgacctaagcaatataaataacagaaccgccatcaatctatgcgtttgagatggacacgatcctattttagaacaatatacagcactgacagcgtatgacaaggtctagatagtaaagagtttgacatgatcattttggtatctaggaaaacctcatagtttgctagatacagcgaggtacttggtatggcgggcctgcgctatcaatttgcctgtctttttcttcctgaaatcaacagagacaacaccgactgattttccagcgcgcaacagctttccctcaacctctatttcttcctggaaaattaccaaagtaaaagcagttaatggaaatgtcaaacaacttcttgagtcaacacagtagtggaaagcgaagataattggaaaattaaaaacaccttgtcataagaatcagaagaaattaaccaaatctacatttttttcatccaatttcgagccaattaacaagctatatatattttttcacaaaataatggacaggtagaaacaattggtgtggttacctcttatattcgaccaggcattttgccagcaacactgctagtcaaattctaatatcctgtactggtaccaggaacgatgttttagccagcaagttttgatctcaacttatccttgagtgccaacaaaggaaaaaggaaatcacaaaaggaatgcaggcgcattcacttctagtcctgaaccaccccttttgcctagagactacacacctattgtcctacagtagaaaagtgacctaaaggtgaaaggtaagaagtaatgacccttttttttaatctaaacaattgggctgtcatcctccatgttcaccaacgttaacccattagaatactaccttccacctttctagacaaatacaaatatgagattgcaaaaaactttagggagtttttttttaatctgctgaatatttacttattccaaagaagaaatagcacgcttgcacattatctcatgtcccaagacagtcctagaatttattgtgcccgtttatggaagatattgaagcacacatgtgcatatgcactattcttgagcacataaggctcaaggtcattactcttcacaacactatttccatcaacttatatacttccacatacaacaatagttaagcatatcaaacagtgaaaaatggacacgtaggtggaggaaatgaagagattagaagtacactgtttagatatgctatcagaataccaaagcaccgtcactcaatgattaatatgaaaataatgcaggaaaaatgcattcaaattcattacaagaagtattacaagtccaagagacatccaacatccaagatgggcaaatcactaagaaaattgcattcaaatcaccataagagaaccacaaatcacaaaaatgtgtcctaactaataactagattaaagacacagactttagattgatgtgaccacacttacggaaaataactccaacatgatgatcaccaatggcacaattggagcctctgtttattatgaatatgtttaatctctcatgaggaagtactgataatactctgatgaatgctgtgccacaccctaacaacagcaaagtacttgcgctataaaaagctgtatgcaccctaaaaaaatccatgagcccacacacaaaatatctgatttaggcagaatcttaatttatgtcatggagccagaaaactaggagaattcaacaacttccatcaagttcaaagtaattgttaccctggttcacccctagttcctgctttgagcaattcttacaaaggaaaaccaactactactacatattctctccctctctctctctctttggggtactcagtggcagattcagctaagacgcaaagctgtccttaacaactgctgtagcactcgtaccaaccatccacgacaacaacctcatgccctcatttggcattcacctgcaaagcatcccagcatcgtgacagaacttgatcaaggatcactaatacaaacaacaagaacgctagacacctgcaatagttttaaccaaccgcaatggtattattgttgggtaccactcccccttccttgccaaacgtgactgccaaacacgagcccactcggagaaaagcctcgcaactacttgcctaatctcattgtttcaggctcccagcaattcggcgaggcctaatttgacaaataagcaccaaatgcacaaaatttcgacagaaccgcagcatcgacggcacaatttgttttcacctacttagccccaaattagttgattgcacatttacacagacaaacaggatcaaaaatttgtactaactggcaattgggaagagaatccttggtctcaccccgatgctggccacgtcgacgtaggagaggttgagctcgagcgagacaccgctcgtcccgatcccgctggagaggaacacgcccgacccgagctggtcggcgagcgtcgccgtgacgccgctgaggaggtaccccgccgggctctgccaaaaaaccaccacgcgcgtccgcgccgtcaccatctcagacccaccgaagcttattagggtttgggagggagtgggagagggggggggggctgcgggcgcttacggcgatgcgcggggtgacgacgaaggagcagaggaggcggccgtgctcggccgcgtcgatgcggacgccggtgagggcgaaggcgtcgtagcgcaggctcgcggaggcggggccgacgacctccttggacaaggcggtgggctcgaggctcctccgcaccgcttccgggtccatctctacggcggcggcggcggcgatccggccggccggcgacgaggtcgcgcgcccggatccgacaaggggacacgggttgggttggtaactccactagctaaccgccacgcgacttccccaaacgatggtgaggcttgcttctgtggagggtgttccatttacccgtttcgagagttttaccgccggtttaccgcacccgaaggtaagcctatttacgcattgtttggttaggcttggattcaattcgggccgggaataagtatagtaaaaaatttatgaatgatccaataagaacccgaaatttatttcgggccgagaatcaatttactcatgatagggacaataagagatcgggattagttccacatctcttgactagtggattgattcctggtctcttattgcccctatcatgagtaaattggttttcagcccgaaataaatctcggtctcttattgtatctatcataaattttttactatacttgtcattcccggcccggattgaatcgaagcgtaaccgaacaaggccttactacgcaaccgagaaaaaaccaaatacccacttcattttatattattaatcattttaacttcttttctaattaaacttcttttgaatttatcaaatcaatagaaaaatttaataacatctacgacaatgaaatagtttcagtaaaactaatatttaatatagtttaatagtaatatgtttgttttgggttagaaatgttgctattattttctataaatttagttaaattttaaaaagtttgataaaaaaatcaaaacgactaataatatggaacggagggaccgagggagtattgacaatttactaattcggtcccaaaatatagtaatgtaaagtaagtgcaattatatccattctagtgctacaaatatttctaggactacaaatcggaactgattcgtactacgtagattgatggtccaaatttctaatctcatcctatattgctatattttgagatggggccatgaaggtagtaaaattttaaatttttgtttaacttttttttaaagcttaggggttacttgctgggtccatatttccgattgagcacgggatcctgacccatgacggtatgacaactttcaccaaatcttaattaaatttcgatctaaattactgttttaaacttgaattccccaaaaacattcaaaatcttactcggaatatgttttcagtacccggaatggtgtttgtgaggcggacaggtgggaccggcgggccacgaatgagctgacaagtaggtccagccaggcactattcctgatccaatggctttgtgtgagactgaagctacatttgaactgcttttcagtacagatcagatcggccttaatttcctttcccttcaagtcatagcaatgccggaaatgtttctaatgaaacgaacgcccagatgttcaacggaacaaaagacgaactgtattgaattattcaatgcaattaagtttagacagcagatttccaacaaactgactagtatagttcacaaatttcgaacaaaatggctagtgttcctgtaagagaatggtgacaagactgaccaaactcaaacttggttgggtcacgggtcatatttaacccactctgaatttctatccatcttgctgaacaactgcactgcatactcattttcagtagtctctgttgtatgcagtgtagagaccatcagtgtcctgcacaacacaggtgcctctgagcattaaattttgcaaagcaagatacagggcaaaatacatggaatgctggaaaagaaattaaagatgcatacagcaccttgatcagagttcatctttaacaggctctgatgatgatgttacctcctcttccacagcatcaatatgggttttctcatccactgcagcagatgcaccagctttcggtcccctgttctcgttgataaaactgatgatctcctcagctgtccttgcaccgtcgtacgacaaaaggttcccacttgatgaatagaagtagatagttggatatccctcaaccgtgaagtctgttggtatatcgttcacagttccatcctgcaaaaccgtaggcattgatttccataacacaaaaggtatgaataaacgatccgcaacaacagcgaggaatataaagtcatcaactcaagacgaagtaccatctttgctatcactatatcttggtcatcttgcaatgacactgcaatttcctccaggatcagggcaaacttgcggcaatggccacaccaaggtgcatagaactcaagcaaaactgcaacgaaattgatgtcatgcagtggtgaaacaagcaatcaaatagaa

SEQ ID NO: 14987 - DNA, 1201 bp, Oryza sativa
cttatatgcctagaataacgaaattttaaagtttattacgagggattttcattatccatttattagcgttagctttttaaaccagttagtattatttttatcgtaaaatttaaatcgagagcgctctcgatttagtcataatgagcgaccctatcatccaatcaaccgttgtccagatatgtcttgaagaatcttactttactatagtactaattgatcaagcaagtagaacaaatattcctatcatctatgcttcaaataaaattttctcttaaattactcatccgatttacaatccgatttgacggagcgtggggcccctcaccggaagaccgcgcaggcccccctttgccggttcggccggggactcagggtgagattctaagctctctgtatgtggaaggttcgcgagacaggaaacacacaagacacgggcgatgtatacaggttcgggccgctgagaagcgtaataccctactcctgtgtttttgggagatctgtgtatgaaggagctacaaagtatgagccagcctctcccttgttctgggttcctaatctggaaaagttcagtcttctttatctaagtgggcaaggtcctccttttatatcttaaggggataccacatgcaccatttctctcttttttgtggggacttcccccaccttttcataaatggacggagatttgtatagttgccgtccgagtcaccttctgatgagacgggccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaatgagtgcactgcactgcgttacatgcggcgtgacacgctcagccgaaacgcaataaatgtggttaggtgagccccgccgtcttacctaacccatacacgctgagcaaaataccca

SEQ ID NO: 14988 - DNA, 8916 bp, Oryza sativa
  unsure (1)..(8916): unsure at all n locations
tacttctataatatatgtaaattacttttaggttatattgaattacttttatatgtctaagaagtaacttagtgaaatctaaaagtaatttagatatattacaaatgtgatatatattttttcatcaaaatataatcatgtgagatcttgttataatgatttaattgtatgaacacaacggtgtaatctgattgtagatcggatgactagtttaagagaaaattgtatttgaattataggtggatagtgtttatcatagatggagtggtagataaaccagctaccattagatgtctagcaatgtcctatttttattgctttgttcatttatctatattacatgggctcgaaccgcagaagatcaggaggctaggaaaaatctccaccgtcgggccatccgatcgcgtcatctgggccatccgtgcgaggcgcacctgatcggatcagacacgccgcacggcgactacacggccacgtggcggggcccagcaattagaaagtacagtgagtttttctttttctttctaccggggggcccaatgcggggtcgacacgtgaacactgcttaccgcctccctcccccgtctggtcccgtcaagcgtggccgaaacccgagctcacgtggcatttgggcactgcattttgagagagtggcaaatagtaaattctcccagctcacgtggcggcgtggcgtggcgcgtcgcgtctgcaggggaccgggagccgtcgcctcccgaccggcacgtggcgcctactctgctgcctcaggcaagacaacccagcgatttaactaccgcatcatatcatcagcaaagttaatcacagtacagtaattagtactacaaggtgtgctccctccctccacaaatataattagaagtatcgtttaggttttctttaagggccctttgaataaaggaattacgaaggaactattgaaatcctataggaaatcttcatatatagctcttttgattcaaagattgaagttttctaaatcctacagaatttctatagaatattttgttgcatataggttttggaggaaacttagtaagaggttgtccaacctcttagtaaaaatcctctgagtctatctctcttatccgattcctgtgttttttctgtggtctaatctaacgatcattcatgtgttttgcaatcctctgttttaaacttacattcttgtcataattctatgtttttactattcctccgtttttttatacctacgattcaaaagggccctaaattaagaaagaaagagaagatctcatacagtactccctccctcccttgatataaagggattttgatattttgtttgcactatttgaccattcgtaatctttaaaaaaaattagaattattatttattttatttgtgacttattttattatctaaaatactttaaacatagtttttttgtttttatatttgcataatttttaaataagatgagtggttaaacagtgtaagtaaaatattaaaatgggagagaggttgtactagttaccccataaaacatgtgctagtgctacgtagtactagtatcaactatcaagttcggattaaccgaaccaatacaaccactcaaaagtagtgtagtggagtacagtaactatagaggagtattacttactaaatgagtggtggttggtccgtgataatagtactaaatgtgtataattaatacatacaaataaaaatgcatatactgggtcagttctctttgacagttcactgctgtctctagctcgtaccggctcagttcattagggtgaaactgttttgccgctttgtccaaactggggtcacattaactaaccgactataactgatcactgtattaattataatcagtcacacacacacccctcacaccagccgtgtccacgcgcgcgcataaaagctccccctcctctctgctcgtcccggtcgctgccgctatcaacaccaacaaacaccgcgcctcgcctcgtctcctccgatagcgacgccgccgccgccgccgccaccgacgccgggagtgacagcgagtgagatcgtcatgatggatcacctgagcctggtgccctacgagggcggcagcgccggcgggggaggaggtggagggaagtacaaggagtgcatgcggaaccacgcggcggcgatgggcgggcaggcgttcgacgggtgcggggagtacatgccggcgtcgcccgactcgctcaagtgcgccgcgtgcggctgccaccgcagcttccaccgccgcgccggcgcgggcatcaacggcgggccggtgtttttcggccgccgccaccgctgcagcagcactcgcaccacgcggcgntcaaggtcttcctcccgtcgtccgtgccggcgccggcgccgccgccgcagctcgcgctgccgtaccacgccgtgcccgccgcggcgtggcaccacgcggcgggggcggcggcaggccgcgccggctcggagacgcccccgcggatggacgacttcggccccggcagcgccggcgggagcgggagcggcggcggcggcatcttcgggcggaagcggttccggaccaagttcacgccggagcagaaggagcggatgcgggagttcgccgagaagcaagggtggcgcatcaaccgcaacgacgacggcgccctggaccgcttctgcgtcgagatcggcgtcaagcgccacgtcctcaaggtctggatgcacaaccacaagaaccagctcgcctcctccccgacctccgccgccgccgccgccgccggcgtcatgaaccccggcgccggcatcggcctcggcaccggcctcggcaccggcatcagcggcgacggcgacggcgacgacgacgacaccgacgactccccgccccgcgccgccgtgtcctccccctccccttcaccgatcagcgtctagctagacagccagacacactgtcactggcacacactagcttagccttagcctagcttagcttagctagctaatgagttcacttaatcactagggtttaattagctctaattcaactagcaatatcccatggattaattagccgctagtcgctcagttccgcgttaattaattaatgacccacttccctcctgccccccgcaccgcggccgtggtaagctaatggaggtcatatctgtaatttctccccccactagtactactctgctgtagtagtagtagctgctgctgcactgtctcatctcattttcagtcgtagtaccactgattgcattgcagtgactaatcatcgtatcctagctcattaaacagcatcggccacggcagtgagagtgagtgagagtgcatcggtcgcgcgttggggttggtgcgtgtgcctccactactgcaggaagcttccatttgcttcggcctgggcgcgagatttttttcttccccgagatttggctctcaccaacgtcgtgtcggtacagtagtgctgaggtttttgttggcatttggcggaggataatgcgacggccaaggcggaggcgacagcgcggcggcggcggtggagccagctgggggatcgaacggctcgctcgggtgcacggctccccacgtcgcgtcgcgtccgctagcgtgagcagcgtctcgtctcgttctcgtggggctcgtggcgggttcttgtcgcgcttctaatgacaaggttgggtttacaaacccgatggaaaccgtctggttactgtgtttaccgttgggaacgagaaagtttaaaccgctgtaactccattaaatttaaaaacaatttgaattttcgacaaattttatatggtttgtcattgttacggtgattattgcgtgtgtaatcatattcagcaccccgggtgctgtaacccccactcctatggtaagggaaaccctagctaatgcttgatctgctctttttgttttctacggtgatgatggcggtccagggaatgaaaatgatcacgaaaattcctaatcgaacgagcttcgtttttatatagggaaggattaccgtttctgactagtatcgttttgttgtatactataaaatttataatttctttgtgttttgtattaatgttaacactgaataatttaaatgaggaaaaaaatacaaattactagttgatcaaacctagcggtgctatctattccgaccgtttttcaccccgtgtggctgagaaatgggccggctgcgtctggtcgcgtcgcgagttgtcttttcggcgcgtcctcctgccggtgtcgcggtggaacggcacgagccggggtttttaggaggtaaggtgatgatggcaattaggccggcacgattgggggctttcggtgcgggagggatctgacacgatcccacgaggatttgtgtcgcgtactagtagtacgctccgtttgctttttgagagcacctggggctggggggtcgatcggtcagtcatccgatcgaatgtgtgacagtggcgggtgtttgtgtggtaggaggcaggggtttttgtgtgtgtgtgttcgtgagtgatttgattttgtttggtttggtgggctgttttggctgtctgatccatggattgggatcacctgcagtagctatagctacttaagcagtcctatagtcaccattggatcagaaattaacgttctagatcttttctaaataaaaaccgtacaaagcatattcctgtagtatgtaattaaagctactgtagcatatgtttagaccgttgattgccttaatccaacgatgaaaaacagtctcaactgccaaacttgcagtctctactagaggacagcttttttgcattgcagtcttgcagaagacaaagcaaacacagggccgtcatcacgagttgacgacccgcgccaccacgccacctgtggtgcgcggctgcaaaccggaaggcacacgcgttgtggcggaattctcaacaccgtcgctccgatccacgccgctagcaatgcaccgcacgagatggcacaacattggtcgttccttccaagcctcatgagtagcctcgtacggagtattatggtaaatcccgatcagcgatagaggcttccagtcagcggaggcaggccgcgatcggttcttctcagattacggtaaatcccgattagcctcgcccggctgatctggtccctgacgtcggtgattcggcgaaaggaaaatacccactttacgtatatcaactagttgaggacttggagggtttgactttcatcgacgttcctcgaccacagaaccgattatattatatttgtcaaccttttaaaaacggtgaaaatagtagtggccacctcttgagcaggtcgggtgaccatccgagctccgccactgccgtcttcactattagagtgtgtttagttcacgcgaaaattgaaagtttggttgaaattaaaatgatgtgatgaaaaagttgaaagttcgaagaaaaagtttgaaactaaacaaggccttagtagctcgggtttgatagtgtcactggcttcaccattgagtgtaaatcgagtcacttaacgttgcattagctaaaacagctctcatcacgtcactaaacaaaactatgtttcaattcgcatcggtttcactaaacaaagtagactcgattcgcatgggttttagaaattaagggaaactctagcgacacgaatgaatactaaacctctagtagatagagggatcctgagtagacttattcgttcggtgaaatgctcgggctcgtttcattgcgtcaaccgaaatagcccgggattgggaacgttcaaggtcacggcctagttaccccgacttcagcagaattgcacaggacaacccatgggcctaactaacagttgctacttgtctgccacggccgacgggcctggcctatattcccccatcactaagacccaaacagatcgcgtattgcctaacatttcaacacgccggctcaacgcatgaaaaattcgtgtcttttgccccaatttgagagttgagacgatcagcaatgggatgtgcaatgccgctcatatgctcgcagcgcaaatccgagaagaactcaagaacctgagcacccatcgtcgatgaacggtcgatgcaacgatcgatcgcgcgtgataaaacagattaggggtttccagttacattcatcccagctaaaacaagccaacaacggacgtcgtgtccgaaatgcagcagttttgagctacatcccaacctgcaagaacactgcaggaaactacaaacaacagcagatcgacatgctactgtttttacgtcgacgaaatatacctaagcaagtacattgatacatacgaacagatcagacgccatgacaactgcctgaactaaaacggtaaaaactacaagaagctacagcatgtcagattcacagcaaacgacacggacgacgaagagttttgagcctagcagacgctggctatctggaggcgacgtgccaggtgcacgaggtgccacgtcagcgccatcaggcacagcacgttgcacagagacgagtagccgttcagcttcttgagccgctggttcagcgtcgccacccggctcttggacgtctgctcgtccaccggcgccgccgccgccgccgacttcgccgccatattgttgttgcctgccggcttgcgcgccgccgccgtgggaacggtggtggtggtggccgtgttgcccgccgcgacggtgaccgttggcgggtcgacgatgtcggccatgtccctccccctgccttcctccttctccaccttcatcctctcgaacatcacctgtgcaagaacgcaaggaatcgatcataaaactatgaaaagaattgggtgatcgatgaagtgaggtgagcttacgtactttggtggcttttggctccaggagcagcatgttggcgaggaccagggcgagcgcggcgaggaggttgacgctctgggcgcgcgcggcgagggagctgcgctcgcggccgagcaggtgcgccgcgagcgcgaggccgacgccgtacgccacggcgcggaagtacatcgggaacagcttgctctgcaccatggcgagctgctgccggggcagcgccgcggcgaggacgtagctggacacgaacgtcacccacagggacgcgccgtacgccgcggcgaaccccagcaggtgcatcaccgccgtcgcggtgcgcgccgcctccctgggcccgccgccgaggaggtgcgcggcggcgtcggacgccacgtcgcgcgccctccgcgcgatgtcggagaggttgctggccgcctcgccggccttcgccttcacggcctcctcggcccgcgccgccttttgcgccgcgcgccccgcggcgtcctccgtgcactgctcggctctctcggcgacgtcggagaccctgtccttggcgtccatggcgcgctccctagcgctctcccgggcatgtctcgcggcgtgagagaccttgtccttggcattcctcacggtctctgctgctccgtgctggacgtgagacgccctctccttggctttgcccgccgcttcggagaccttgtccttggctcccacggcggtctccttcactttggacgcagcgtcgaacaccttgtcctcagctatctccttagcatgcgagagcgcctcctctgcacctctcgccgcctcctccgcgccgtgctcgcctgccgacgccttgtccttcgcgccctcctccgcctccctggccgcgccgcagagcctgtccttgcaccgcttcaccgcgccgaacaccttccccgtcgcgctctccttggcgtcggacatcttctccttgccgccctccgccgcgtcggccaccctgtcggccgcgtcggagactgcgcccctggccttgtccgtgagcctgccctcgccgccgtcgagggagtcagggggcaggacgtgcgtctccttcacggcgtcgccggggtacagcgggtgctcccgctcgtactcgacgatgaccacgcggcgtccctcccggacgacgtgctcgccggccgtggacggcggtggcgtcggcgccggcgaccacacgccggccgcggccagggtggagagcacgagcccgatggccaccacgttcatcatggcgagagcggcacgccgtggcattggacgaacactcgtaagcttccagttccagtgagtggagtggagggagctcagtgcgaagaagcataagctaccgcggtaaaagtgcattgctggttcgaccacgccgcctaatgacgggcttaaattcgcgcgctcgctgagccgccgatggttgtagaagcgcccggcggccgcggcggccgaggccgtggcgcgctgccgcggcgtacgcgtggacgcgccgcagtggatgcggtggcgagctcggcgtcgccgcgaggcgacacgcgtgggcgggacgtggccgcgcgtcgcgcggtttcggttctcgcgcgcgtgcgggcgcggccggtggaaaggtggggcggcccaaaaaatcgaattgggtgggcttcgtctcggcctgcaaaggatagcccacaaagcgggcccaaaccgagaagcccactttcactcgcgtcgtcgcgacgcaagcgagaaaccctactcggtcggggaagccaccagcccacgacgactcgcctggacgcgccgccgccgtcgccgccgccgccgcagcagcagcagccgccggagatggagatggaggacatcgaggacgtgctggggccggccgggatcgccggcggcggggcggctccggggctccgtctcccgctcgccgccgtcgccgtgaagcccaagcgtccgagatcgtccagggtcgcgcagacccggccgcagcccgaggcccggatccccgggacgcaggtgaaaccgccgccgtagctcgagctccaatgagcgtgttgctgcgtttccacgtttaatctgatgcgcttgatggtttcgttttgttgcagacgatatatgtgaagacgttcgggtgctcgcataaccaggcaagctt

SEQ ID NO: 14989 - DNA, 2230 bp, Oryza sativa
catacattgacttatgtactaatgaccataaaactaatgtggcagagttctggtcttcaaagggattgtgttaatcaagagttcatgatagtttctcctttagtaaaaccaaatactactatatgataatttttagttttgttccatgccctgcgtggacccatcagccaatggagctcacgcttacatgatgtgtgatgtgtgctttgcttatgtggacattgtaatgttcatgagcaaatggctaggatcatatgttgggcagatcatctttaattgtgagaaattatttgcttggttccggtgatcctccacatatgcactattatttcttcatccacctaactatcattctcaaataatcagaatgaattcatggtacaagttcctttcttccttctgtaaatgcatggctcagatttaatgaccaaccttgcaaggctcaaaatcaaggactaccatgtcagcttttttacatgagcataagcagaagatgtacaccgatgcctccattgcatgaggtctacattagcaatagatgatctgtggcccactgtcactgactgttgtgtgttatggtttgctatgatgtgtgcatacttattgcctcatgtacagtatatacgcatggtgtttcacttactgtctatatatacttcaacacagcaagcatcatcaacagatcatgttctcaatctgaaacttttggagccttaggtctttgggatgagcgaggaagaggaagaaagaggtagtctaagagcagtgggaatgggaacatagaggaaaaatgagctctcagtgttcacttctggaagtggaggtggatatttgtctcagtatttttcccgatgcctcccattcctatcgttcttaggtgctccttcctcttcctttcagctcatagagatattttagttgagaaaaatatattaatgtttaggtttggatgatgagattgagagagtgggtcaggaagaggaagaatagagcacctaagagcagtgggcatgggaacatggaggaaagctcaaactcttctgtccctctaaaatagcggggtcgacttgttttgatgttttcccgatgcctcccaagcctattgtccttaggtactccttcctcttccctttggctcatataatctgcttggcagtagtatagatgatgaggtcttgaaggcaaattgggaagaggaagaaaaagagcacctaagagcattaggcatgggaacatggaggaaagcctcaaccattatttccctttaaaattaggggtcacaatatgttcctgtgttttcccaatacctcccatgcctattgttctcaggtgttcctttcctcttccttttggcttgcacgaagttatcaaagaggggaatcaaggatttgccagttgccacttgccagtttgccactacaaaagttgccatttgagaatatcctaacccagatagctcagtgaaaaaatctcaagtgtacccttttctcgactttttctaaacaaaaggcagcttcatggttcagtcagtctcagaatgaatcatgggcagaccctcattttgtctcgaaacattcataatgccgcatggcttttaccacttcaattctaacaaataaaatactaaattgagtgcgttctattcccaaaaaaaatgagtgctgcattcctatcactctagctcccacatgtttatcttccagctcctgtgctccactactgcatgagtacagtcaactgaacagagatgttaatttgccgttgagttttctcctaagaaggtgaccaacttgatctaatacgattccactaaatctaacctgacgtatgtacctacaaccaacaacttttccgtgaatttagaaacaaaaatacctcacgggtgggttggcaaaccatcaaacaaatcattttcacgagccaagcacagacacttgcattgattcgaaacacatcgcataaatcacaggatcgcattgcatcacagattctagttgcagaagagcacgagagatggagaagaggaactcacggaaccaactcgccgcaggtcctcggccggccgtagctgaagcgcctccaaccgtatcccccgcgcgcccccgctgccctcctcgcgcacggcgtgctcccctcgctctccgatccggcgagcggcgatgctatgtcggaagcggaagctcgcggtcgccgccgacgaagaggcccttcccttctctctttcccgaat

SEQ ID NO: 14990 - DNA, 24489 bp, Oryza sativa
ccccccccccccccccccccccctcgtgtcttcctttgcgtattgggctggcccaatttactcgaaattgggcctagttgcggcccattctcgtcgtctcctacgtgaattccagtggccctttcaaacgaaagaagttttgaagttcaactttctccacaaaaaagaaaaagtgaaattgatgcatgttttttcttttcctcgtgcgaaaaccttccagtgttccatcatggggtaatttcagatttgacgatatgtcatatgatacggagcagatacttcaaaattgtgggtgttttttttattggttctggtgatcgccattcttctcgcatagtattcacaagcattaataactgaagctttgtatggattgaatcatttcctccctggttgctccagttcttgaagaggctgattggctgaatgaatgcattgtttctctatcgcatgctagttgtttactcctttcgttctataatataagggattttggagtggatctgacacaacggtctgtctatattcattttactaggatatgtcacatacacccaacattgacagatggagtagatacgcaaatccgtcagaagatccccggtgtgcttgcacttcgttgacacaatttgaccgtagaagtcccgggcccactgtcattgactggtgaaagctgcgttgcaccgtgcagtaggttcgtgcattgatttggctcacagtgtcccattacttctttatagtgcatctagagtgagtatatatatagtcagaagtcaggatgcacctataacactattcaacatcccagatttcttttcttattttcgaaactcttgtagttgtagcctcaggcctttggtgagcttgggaagaggaagaaagagaggctccaagagtagtaggactgggaacatatgagaaagcatgagctctatccatctatccatcccctcccattcgctagaatgttgcaggtggagatttcgctcttatgttttctcgatgcctcccattcctatcgttcttggaacttccttcctcttcctttttttgctgatataattttcttagcacagtaaacaaacatacaacacacacaaaattttgatcgatgatagatgcctttgagaaaattggaagtgagccggggaagagggggaaatgtgtgtccaagagcggttggcatgagaccgtggaggaaagccccaacacagcctctcttctgaattcaggggttaagcacttaagcatgtgtttcggtgttttcccgatgcctgtcatgcctatcgttcttcggtgctccttcctcctcctccaagctaatacaatttaatttagtttgtgtcttcataatgcttgcgtgctctgttctaagtatgtgatacatgtaactaatttaagtcattctatatggcacaaagttttctccacatcctaaactaaccccattgatagtgtcacagaatagtacacgtacacaacaaagtaggagacaacacaagagagggaaaaaaaaactctatcgagaatgtgatcaatttggcttgagctaatgatctgctcaaactaagtactccagtaacaacctaaaccatacttagaccttgttgccattgttatggacgccatcaccaccaccatctttcagaggatcgtcgatgttcctgacgggtcccttgaaccacctcctggcgtcgagcacccaccagagcccgatgaggccgaggcaggcgccgagcgcgacgggggcgtagttgaagttgccggcgctgatcgggtacgccgtcgggaggaggaacacggtgcaggtgtagcagatccacaggaacgcgacgaggcacaccggccgcgacgcgcgccggaggtagaagggccccggcgagaagtcctcctcccgcatcaccatgcgggcgaagatgggcacggcgtagccgccgacccagccgatggttgcgatcgacgtgatggccgtgaagacgacgttgatccacaggatggggaggcccagcagcgcgcacgcggcggcgcagagccagacggcgttggcggggacgcggtggcgcgggtggacgcggcgccacacggaggagagcgggacgccgcggtcgcgggacagcgcgtacacgacgcgcgcggcgctggtggtgatggagaggccgccgaagaagaaggagccccagatgacgaagaggagggcgatggcgcccgcggaggagccgtaccggccgtggaacgcgtcgaacaggatctgcgccggcacgaacgtgccggccgtctcgttgctcgggtcgaacaggtagctgaagtcctgcgcacacacaggaacagagttcatgtcaggccattcctagggcaagtgcgagatgtgcgatcgcacaggcaacaaaaaaaaatcgatattgctaaatttatgtcgacatattttaggataatttacagtcggatgttttaaccgtgagatcctccgataagattcgtttcaagcacatgcacccatcttacaccttatgcgaaagaaccagctgcacctaatcaagctccaagctcattagcacttcacctccgttgtaaaattaataattatttatatatttatacgaatttacacagtagttacacatcacttatacatcacttacatatgtaattaatatgtaaatttgggatttacatatgtaattttaggaattatatatgtatttttgggatttatattgtaaatacactaaaattacatatgtaatttaggaagctacaatgtaaatacatgccgactattttttgttgaaaaatatgacgctataaatatagatagtcccaaaaaaataggggccctaaaattatacataatctatgtcaatgtattctaatatggttaggatcttttcactccaatttttaaaacttcattaaattcatctagaacaatttttttctaaactccatgttcgatgataatcatagctatcttgaagaactaatactgatgaaggcgttgttaacatgcgttctaaaccataccaattatatttttttcacttaattattaataacaactaagtgcagcgattcttcttctgcctagctagatcataagagataagaggtgattttttgtcccgagctcgatgaagaggaagaggatgaggagtaccaacctggatgctgaaggtgagggcgaggatgtaggcccagccgaagacggtgatgatgccgatgctggagaggatggcgatgggcccgttcttgtcggcgcccttggtctcctcggtgaggtgcgccgccgcgtcgtagccgtacagggagtactggctcaccaggagggacaggatggtggcgtaggcgctgctccgtatcccggtcgcctccggcgccgtctcgaagtgcgtgaacacgtacgacgccggctgcgtcgtcttcgccaccagcggcagcacgatcactatcaccgtgccaccgatcacctgcacacacacacagaagcatcgtcaatggcagctcgatcaaaattaactactactccctccgtccagatggacagacttcttctagattcattgtattaggttatgtctcattcagtacaagtttgttatattttaaaacggagtgagtactgatcttgggatgaacacggaagggattgttggttggattgtcacctgccaccacatcgagatcaggtcgaggaaggcgatgacttccagcgcgaaggtgttgagcacggcccagatgaaggttaggccgatgtacatgaggaggaacagccagcgaggggtcaggtagccgccgcctttgttcgtgccggtgcatagcaggattatgctctgcagaacttgagatcccgcgaatgcctgcgcaagcgcaatacggttgattgaaatgctcaaagaaatggaacaaacagacggtttttgctacgaattaagaggtttagcatgagaaatgtaacggattgctttgcatttttaagtccatggcagtgctgaaagtccacaaccgaaatggacagtaacatttgatttgatgttttcttaggataacatttaatttgcttccacctaataacaaaatggatactactgagtactgaccagaaatgagaacacagctagaaaaggatcaagcgtgtgactgaccatgttctactacagagaacaattgacaaaagagcatacctgtgtaccaattccggcaataagacctatggcctctaaccaagcacagcaccaagatgccaacgggccccagactgggccagccagatgagcagcccaaaagtacagagaaccagtggtctggtttcaaaaggaaaaacgatgccatcagtagattatcagaaacagccagctttcttcggcaaaacaaatagagtactgtaagtacagcaaaatgatgcgttgaaagtttcaaccatgccatattgcaactcaagagtcagaactggattgcaaaacctatttcttttttcaaaaatttcaaggatgcatgtcatgtgctgatggcgcgtttgcggagtctatgctgtagtactaatgtgagtagtcaacagaacagtgacagcaggcaggcttataattaatcaaagatgcaatagtgctggaaacaagtactactactactactacaaaacaaaacagccgtgagagagtacttaacgctagcatcacccaggtaaaacaaatgtgtaatgctagtgacaaaggtcacaaacattttacggggattcaaactaactgtgattaaagttggggttgatgttggcctaacgtaagtagtagtgtagtgttacgtaagttatgcctgccttgcccactatgattggaaatagtaccatttagtagagaggcaggtatttcaaactaatttgcaatttaaaaggcaaactaaattccaagacagcaagcaacttcgaaatgttatagtagtgggttgaagtaaaacgaacataaattagctatcgtaatcgaaatttgccgtcaaaaagtcgactgttccattgaaagttgtatcagaagcaaaccaagggattgttgctgaaataaaccttaccaaaaaactaaatgcatttattgctaaaataaactaagtcggattggtaagttggcaatagtgctaaattttggcaagattccttaagtatgtatcaaagtttggtagaaaactaaatgtatgcacatttttaacaacttttagaaaagaaaaaggtatattttgaaataacattaatctaaacaacccaaatgtctaaacagagcaactcgatgagcaccaagtttccatgataattgcaatccaattatagttttcagcaaatttatccacggcatggaggaggacggccaaactgcgatccaagaaatggtattgccaaagggaggagagacgaagaggggtgtgcttacggggaaggaagagcagatctcggccatggcgaagccgacgaaccaggtgaagaaggagacgacgacccagccccagacgaggctggccggccccgtgtaccgcaggctgctcccgtacagcggcgtgatcccggtgaacagcgtcatcgtcgagaaggagatggccagcgtcttgaacagagtctaaagaacaacatgcccaagaaaaaaaaaacatatcatcaatcaatctcttgaagaacaaaaatgaagagaaggaagagaactaactactaccaagaatccaaagatcaaatgcaaaaccgtgaagaaactaaagccaaatcacgcaagagaattccggtgtgaacgggaggaaattagccacgaatttagtcaaatctcacgactccctgatcgttcctatcgatcttataaccccccacgatcattttcaaattgaaatccagaagagaaacagagagaaagaaagagggggcggtggtaaatgaaaaaaaccgcaccatctccctgcggagctcctgcttgtacccgagctcgttgaggcgcttctcgccggagtcgatggccacctcgccggccatggcggcgccccggcgggatatgtttcggcgcgcgcggcccacgcctctcgggcggcggcgtctctcgggaatcttatatgaaatggagaagcgtgcggcgtcttgggaaggatttcgaggggaggagggttttggtgagttgagcggggggagcttctcctctctgcctcgtgttgggtaggaagggaggcaaagctgcgatgttgtggctacttctacgctatatagacggctattgctcctacgtatccgttctttgtttgcatggttgtagacagagtttcaggatctttgcgttgactaggattcccatctctttcctatccagcctagcctgagtgcctgactcgctagtaatttagcttctcggtccattccgcctataatttagcccaatcctttcctggcccatttgattcaaaggaaatttatacaaattttagagaattttatttctataggaatttttcctataaagccctttgaatcaaagaaatgaactatatggaatcctatgaaattcctatgggatgcctcttcccatacaagttttggaggaattttaacaagaggtagaacctcatggaagaaatcatttgtctttatctcttctcaaattcatgtgtttttcctgttgtccaatcaaacggtcattcctatatttttcctgtgttttggaatcacctgttttacacttgcattcctgtcagaatcctatgtttttcctattcctctgttttttcattcctgtgattcaaaggggcccttaagatgtactccgtactactattttctcgtatagaaaattttctatacgggttttgctttaaaatattaaataaatatatttttccaaatcaataataattaaactaaattaattatacattaatgactttcttgttttacatgcaccgactttatcttcatctataaaaacaccacctagaatacataaaagatgaattttagtatcattcttctcatcctactcttgtcatagcaagtgtcataatgattcatgtgatgcctctaaaaataccaaatatgattgagtgatgagatagagtagagaaggagagatgatgagtcactcataaatcaagaggcaactttcacataaactccaaaaagtgagtgtgagtgtttaaaaggtgttggtatttgtgtattagaggtgcaatatttctatacgttgcctcttaatttatgagtgagtgacattgataaatttagagatactgatcatatctattatagcacttgctatcactccacagctcgccaaccaaagtgagcactttagtgactttagggcttgtttaatttgtgaaaagaaaattttttgggtatcacatcggatgtttgaccggatgtcggaaggggtttccggacactaataaaaaaaactaatttcttaactcgcctggaaaccgcgagacgaatcttttgagcctaattaatctgtcattagcacatgtgggttattgtagcatttatggctaatcatagactaattaggctcaaaagattcgtctcatgattttccccctaactgtgcaattagttttttaatctatatttaatgctccatgcatatgttcaaagatttgatgcgatgtttttggggaaattttttaggtactaaaccaggccttagtgaggacatttcagacctttcacatcaattgtaaatctctccaaagatttcaaattgagctctatttgggacagatagagtagttaatattcacgtggcaaatgtcgtgtgtactcttaaagtgtaaataatacaaactctgttattattaagttgttttacccctttgctacaatgacttgcattttgtaacataaggagtagattaaaatagtgcttgtgtagtttagtgggcttaaattttcgattcatcagtagtgtctatattagataaaaacagacatgcttaagatgttttggcgttgtgtttgtaccattattttctgttagtacaatgaggcagggctactaacttttgtatttgatctctccttttctgtagtagcaaccatacaaagttttgttgaatattagctcttcccttatactgttgcttagagatgagtgacatactttgtgtttaatgctaaactttttgcttagagatcaaacaacgaatttccataaacaaaaacttgccaaaggctttaattagttgtgagttcaagagtttttatacgcctcccctatcatgcacaatacgtgaacgaacaaaatttgtcttcacttgtatgactagcattggtagctaagggcattcataatgtgagacacccctagagtgtcctcaccaataggaaactcagcttgcaatgggaggtatctctaggtgggctcctcaaaatctgaagcaacccgataagagtactatagcccacaatgggtgtcttggcccaaagtagccccagataaaaaatccccaaatacccctcttttcttccgctgcttcttccttctcttttcttccgccgcttcttctcgcttcttcttctcgccctcgtcgcccatctcgccgccgccgccacctccctcctctctcccccgctcgccgccgccgctctcccccgccgctcgccaccgccgccgccacctccctcctctctaccgtcgctctcttctcttctctcgcgtcttctcgtctcctccgcctcctctctcgtccccgatgccaggaggcatccccgccccaccctgccgccagcatcgaagcggcggcatcgacagcgcgcggcgagcggcgagcggcgcacggctatccctccgcccgtcgccgcctctctccctccgcaaggcgagcaggacacagggcggggtggccaacggcggatggcgggcggcggcgggcctcggcgccgtcccggatttgcttgctcttctttcttccttcccaatctggatttgcttggatgtggtctgcatgcagtgcggcgattcgtccggcggcgactccggctctgccccgagtgcacgcacacgccttgcccctgcgccgcgtcgtcctcatccccttcctccggccaagggtggaataggaatatgagctggggaaccggtgcccataggagcccgtcgccccccaatgggtctctcggctgcgtcgctccgccaaaaagcggcgagaggcgcgtccctcagccagaggtcgcgtcgcatcatggggaggtggctcggacggaaaagcgaacggcttagggtgaggggacgagctgaagacacccattgctgatgctctaactatacagatacaaaattgcctaaaatgtgatgagttgttttatgtcagcacagttgagcatgttcgattgctacaaatttaattgcatttatgctgctggtacagtatatagaaaaatagaaataaagatttactaacatatgggcacgcacattgcttcatattcaaacgtggtgggccacccgcgaagccatctccgttgactgggcgaatagaatatccgctggtgcaaatatttttccccaaaattggatgcggcttgtattattattgcagcgtccacacgtaggcacgtagctgttgctgtcacagaaacatccaaaagtagcctttgaaatgtcaagtgctacgtaagctaagaaaattgagcacgtttctttcagcggaagaatactccttcaccttctccagaacaataatggtacagtcaagccccttcacgtattgggtaaggtaatgacgtactggtaatgttatgattatgaaatgtacgtactaatacgcacaaatccctacatcaaattagtgcctttataaagtattatactatcactaaaaataatttgaaacgtttggtatgaaaggtaaatcaataatttaataatacaattattagggataactttattatttatgttttttctagctagatcgatatgtggtaatccattgcactagcatcactcatattgcatctaaaaagccaaaagaaaaaaatatttagtcactactaaatgacgatcatacctatccacatattttttttaaatagtgtcctatgtttctactacagatgctagtataagtagatctgaactctttgatcaaataagataaccgattggtttctactaacaatagagagcaccgtattggagctcttttatttatctttttctttttttaaaaaaaagtaagcaggagcactgctattcataaaacggaataagtttatagatcttttatgcaccactatagtgcagggctgaaaaaatgacttgtactatgctgttctgttcagtaaatcaagaacaaaaaggaatatggaaaaaaaaaaatctcaagttcatgcgtgcatacatagtgagacagcaagcagaacgtaccgtgctagtgttactcgctatgcttaaggcctggtttacttcctcaaatttttttccaaaaacatcacatcgaatctttgacacatgtatgaagcattaaatatagatttttaaaaaactaattgtacaattagggaggaaatcgcgagacaaatcttttgagcctaattagtccatgattagccataggtactacagtgacccacatgtgctaataacggattaattaggctcaagagatacgtctcacggtttccaagcgagttatgaaattagttttttcatttgtgtccaaaaaaccccttccgacatccaatcaaacatccgacgtgaccacctaaaaattttcttttcgcgaactaaataggccctaagtcagttgctttctgaagtgaatgtgtgaacgccagtagcttgctagtatcaaggagcaaccgaatcatacgaatggaagaagcaaattgaatgtagccactggtgcagaacgggtggacgcatcccttccacatgatgctgtcatgctaacgtgccaacatgttaatcttcggcagaaattttctagtgctactcttaaaagtggcatccgatttcacatctaggaggggaacgacagcgtgtcgctttcttctgggagtaaacaagagagaacccgttgactactatcaaaaataaaaattgcaaaagattgcagattgcggcacagatgccttctcattcatgatccatttccagcctgcacttcgaaccaatatgggggatggatcatggatgcatggttgttggtggcaacttgcaacagcataaccacccacaaacaggccagattgccagaatgttgtgtacagccatcctactcgtgtgtgaagcatgtgaatctgcttttgtttttcatgcctaaaaggtgtcacaatgatcaaaacctattttcgcattctttttttgttccatggatgattttgaatttaggcagccactggtagcatgtgttttcccaagtgaaaatgaaagtaaacgttctttaaggaaggaagtagataagtaaacgttctttaaggaaagaagtagataagtcttactccttttgaatttctccctgcctttttatggaaaaggagtattcctggatgactctctcatggagtcatggaacggtggaagatagcactgcatgcaccgatgcacgctgtacctgatctgctactgaagacctggtaatcctgaaaacatataagaattcaatgcggttatttcagcactgctcaatgcactgtattttcccaagtgaaaatgaaagtaaactttctttaaggaaagaagttgataagtcttacgccttttgaatttctccctgccttcttatggaaaaggagtattcctggatgactctctcatggaacggtggaagatagcactgcatgcatctatgcacactgtacctgatctgctactgaagacctggtaatcctgaaaacatataagaattcaatgcagttatttcagcactgctcaatacactgtattttcctaagtgaaaatgaaagtaaactttctttaaggaaagaagttgataagtcttactcttttcaacttccctgctttgaaaaaagaacattcccgaatgactatctcgttgaactctgttagtatagaattgcatgcagagtgtaaccgatatgctcatgaagacctggtaattctgaaaggatacaaggatgcaatgctgttattttagcactcacaatgcactgtatttaggatgctcatcgatggaagtgtgcaccttcaagcggaataatttccttatatgtgcagcaacatccatattgtcctgaatcttgaaaatagcatatcctgcttaaacagacaactgtactcggagaacagggaaattgtttaggaggaatagcctttttagcagcatcaattgacatatcactcctgtacaagtttgcaagaaaacataaatttgagtatcatttacatacaacatattgctaagaagaatgggtttagacgtacctatgcagttgaagagatcaaagtcatcaaaccattctgcaaaggttcataataactctactaaagacgtgttgtcatgctccgttctagttcagatgtcctatggcctctccaatgtatttgagtaggctactgctgtattcagcttatacagctttacagaaacaacaagtgcaaccgtaagaagcgctttttaatatcccaatttcaagcagtttgcaggtcacagaagtcttatttgctcactgatttgtcgaatcaaaactttagttgcagtgctcattttatctgaatcaatcaaagaacagttacccagatgaagattaagatggctttctgatctaatactgatggacaatgtctcttttcttctcgctatattatgtcatgtgcaatgtcggttacaacgtttaaatataagaaaggactttgtatacaacatgaaccccgaaaatatagataaataatagcatagaagcaaccgatattttacaacttgagttacattggttgtgatgcaaaaatgggttattcaatggaagattccctggaatgtagtataaaacatgcttccatttccttaaacaaaggctccaaagatgctgaaatactgatgacatatttgggaaacaggttataatgtatttctaaaaataccatattaacacaaagatacaggcatttcgattaatggttgcaaaagaacaatgttatgggaacagacaagagaaaggaatgcctctcctgttaaaagaaagcaactatacagaatcaaaagaatggagaacttgttcaagaacatttctagtctggctgtccaagggcttctcctggctatccgagtgggctatatttaacagatagagcttcctagaagcaacaaatgcagccgaaaatatcctcttcatccctccccttgtactatccagtaagtattcgatttcatacactgtcaggccatcatggcctgatctctcttcagcagaaataacctctgcagatttggtgctttcctgtattaacggaaaggattcaaaccaactgtcgatactagcattgaactcctcaagtacaactgatcctttacaggcaatcataagcaaaacaataaaattaactaagttgagttttcacataactgtttatttacatatgctactgtcaatttgtcacacaagctaagcaacaatacaagatgtatcacagacccctatatgataattaatcagcgtccatctaatctaattagtagtgcacttcaaatgtgaaatcatgaaaaatcactaggaaatagcatggagctgacaaattgcaatgtccaaaaggatcgttcatgcatttacctttttcttctcagcctgaatcagcctttcagcgacaaattgcggtgtgccaaactctgtcagcgtcgataggcggacgggattaacaacgataccaatattgttactccctttcccctcctgctgaaagagcgccgtcgccccggccttctccaccttcaccaaatcacgccacagaaacctcaaaattcacagctccaatccacacaataccagcgcatcaatttctactgcattgcacgatgcgtgctcacgcaattaccctacgttgcattaccacatagttcagagttcagagtgttttgcgtaccttgggccacgagacgggcttgagcagggtgaagccctcgtcccggtcagtgtaccgctccagttccagttccagttccagttccagctctccctcgccctctctcgcttctgcttcatcgtcttccttcgcggatgccacggggagttgcggcgacgaggcggggaacggggggagggcggcgaggagcagcgaggcggcggatgccgcccttctggtggttagcagcggaggagtggtggaggaggaggaggaggaggcgcgcttgggcgcgacggagtgcggtggaggcgggcgctgggcgcggccggcgggcctcggcggcgggccgcggcgggggcagccgacgacgagcggcatcggtttgttggttgctgtacggtgctcgtcgccaccggcggcggctgcgcctccgcgcgttatcgccgtatgtgacacgtagacactggcacacgtgggcaacagccggtttgtcaatgggctgggcccatagcgcttttcaccttgtatttaccttatgggccaaaagctctatgggccggctcaaggcctgctgaaatgttgggttaactcatggttgacttagtcacaacaactatagacttatggggtgaacgtggaggttgatatctttcctaacaatgaactgataaagagggaaagatattgcaatatactcatatataagaagttgtagtaatgtacatgatagagttagtttatgtcaaactcgtgtaaaactaaactatgaatacggaagagcaccacgccaaagtcatccgcatgttgtagaaaatagtcatttccgttgaccccaccactcttttggagttgaaaatgacaacgcgtgtgaaagctcagcaacgaggaataatccaaaactaccaagcaagcacgtaggcctcgttcggaagtgcttcggacaaagatgaagtactgctacctcagttttaggttataaaacattctaacattacctatttttataaagatactacatccgtcccataaaagttacatttctagctaatttaggataaaatagtatgattgaaaaatgaccacaataactttatttaatgaacccactgtatgcacacattccatatatacaaatgattaaaaggaagtttgagagaataaacccatataattagcatacttaacaaaattacaagcattaacagcccaaattacgtgggatggaaggaaacttatatagatgaattaattggttaggcccaacatactagaaatacaatttttgtgggacaaagccttggagctagaaatacaatttttatgggacggatggagtattaataaatctaggcacacatatatatctagatttattaacatatatatgaatgtggacaatattagaaagtcttataatataaaacggaggaagtaacacattaatgaaaaaattattagcctatagttaattaagttaattattttaaactttaaaaagtagatttatttgatattttaaaacaacttttgtataaaatatttctatatttagctgtttaaaaaaatgctagagaaaaccgatataggatctgttgtatttcctccgtcgtaaaatatctataaaaatgctactttgactaacaaatattaataaaaataaaatattttaaataaaaagagctgtgtattatgataatttgtttcgggagaatagccaatatggtccctaaagtttcgcttctgggtcattttagtccttaatctttcttattgtctaaataagtcctttaattttgtcacgtgggctgatatagtccttggtcccaccaaaatcgccacatggacatgccatgtcatattcctatgcaaaatctatatgatttgtccaatttacccttatatatatcatagcaaaataaaaaaataaaaggttaaatgtaagagcaaaagtatacctcaaacggtgaaaaaaaggatgagtatttttttcctatggttatgtctaattcacccttatatttatttttctatgatatacgtaagggtaaattggacaattcatcatagattttgcatgaatgatgacatggcatatccatatgatgattttggtggacccaatgactattctaggacttgtgataaagtttaaggatttctttggaccatttaaaaggttagggactaaactgatcctacggagaaactttagggactaaagcaactattctcccatttgtttcataataaatatagtaccatcaattttacgtgattgatttttttattttttattaatagctaaaattaaaaatgcttgacttaacccttaatataactgtacaaccggacaatcgaacaaccgtgacgtgtcatcctatcacgagtacgacgagtcacggtccagcacgagtgcacacacacactgcaccagtcaccgttctcagtagaggtgtactagtagaccgtatcacacggcagaaaacaccgcgccgccaccaccacctgcgcctcccctccccggaagccgccgaaaagccgcgcggcccaccaccaccaccgtcgccgcgtccggcgcggactttaaaccaaaccaaaccccactactcccctgagcaccaacgaaccgcgaaaaaccccctcgaaacccaaggcggcgggcgtggtggtggactggacttttttcacctcactccgcctcgtccccgccccaaaggccacgctcccctccctcccaccaacccaccaccagcgtcacccatggcggcccagcgactcgccgccctccacgccgccgcgccgtcggccttctcctccacctcctccgcctcgcatggccgccccgcggcgcgatccagcaccaccgctctcctcccggtggccctcccgcgcgcctccgccaccctccgcgccgcaccttctcggctcctcccccaggtccgtgtcggctcggtcttgggtggtggttgggttggggtttgggacgccctggttgtttgttgttgttgactcgtgctctggctgtgtgtgtgtgatcgcaggaggcgaaggcggcggggagcggcaggtcggtgatgtgcatggcgtcggcgtcggcgtcgccggcgtcggcggcggtggcgtcgggcgcggcggagctgaaggccgctcgcgaggacatcagggagctcctcaagacgacgcactgccaccccatcctggtatgatctcgtctcgtgtacacgcaccacgcgatgcggctttggttgctccgaaacttctccttcatatcagcatcaccatgtgggagatttgattcggtagcagaggagccatctggccgatcgcctttgcaaccaaggattgcacatgagaacaaactcagctcggagacagcgatgttatgagtttgtgaacacactgaattttctctctggagacagtgatgtcatgaatctgtgaacacactgaatatgctctctggagcaatgctggaatttaacatcacgaggaagtaatttcatgaccagcttgcctctcaaataggattttgacctctagaaatagcgtattgtcgtaaatcaccaatgtgtaacgacagttcaattgttaagtctgatctcatctgtactgacgagtaggttgcacatgtcacaaatggcttgtgagagttaagagttgtattgaaagtttgaaactataaattcattcatcacgtatcctatcatcatttattgtttgtggtgataactgatactaacacttgcagcagcttttcccagtgagactatcaagtatcatgtgagttactctgtccgttctcaaatataagtatttctagccagaaatgcttacatttaggaacgtaggtcgtgcttgtgtaaattgttaggctgtgttcaattagttatcagatggtacaagtaaattctaaggaattaggcaatatgaatgcggcgttgaataattaatgacagcagaacaacattatcatagcactaggacataagtccagttcattggttatttccatgctattttaccttcatatggtcatggctatgatatgccagcttgctgaagttaaaggtgttaatagggctgccatttatccaaataatcaccattgactgaacttgtactgtcgtacattttgaatttgcaaatactgaatgcaatgcaacgggggtagaccacggcaccatttcctattgtttagttccattcaaacccttgcatgtgcacaatcaattggctttctactccagtttctctatatccacggtggttaaaatgttattcctttgcctgcatgaaggttcgtcttggatggcatgattccggtacgtatgacaagaatattaaagagtggccacaacgaggtggagctaatggaagcttgagatttgatgttgagttaaaacatggagccaatgctggtaacattaccttttcacgatttcgtttccttgttgcttgtaagtgtactttcagcaactaaaaatcctgattgaattattgaagggctggtaaatgctctaaagcttgtccaacctatcaaggacaaatacccaaatatctcatatgcggatttattccagctggcaagtgctacagcaattgaggtctgatcccctcacgcccccaaaaaataatgaaaaatgaagtacctaactagtctggttttaatgtacgaacactatattctaccttaatgatccatttttgtcaaacttgtactaggaagctggtggtccaaagattccaatgacatatggacggattgatgtcacaggtcctgagcagtgtccacctgaggggaagcttcccggttagcaacttatgtttcactggattttccaaaacactaacatctgtactgatatcctgtcttgcttacttcataattgttctttttaatttttaaatgtaaaggttcctatgtacattgtctctcatcagcttaatatatcaaccgaccttattttttcccttggaaaattatgggatagtttttattgccacgctaacaggcataaaactgttcttacatataggggtatttaggaaatattgcaccagcatcatactcaatcccttaaaactgatgcttgctaactttcagttatccttcccttttggttgctcagatgctggcccaagtgcacctgcggatcacttgaggaaggtattttacaggatgggtcttgatgacaaggtgtgcaaatgagattctagttaaccagatgttttcccatttgctttgttttatgtgatgttgagttgcatgtgccccgcgatgctgtgcctacaggagattgttgtgctgtctggagcacatacacttggaaggtccagacctgaacggagtggctgggggaaaccagaaacgaaatatactgtatgttcttcttatctttattttcttatgtgagaaccgagttttgagcatgatctcagttctatccactgtttcaatgtattcccatgttaagtctatcattgcatatcatgtcatcatttttgcaacaaggagtcaaggaccacttagtacttcatgatgttttatgctttcagtacttaatgtctctgcttaaattacccttattcctcaggaaagaaactacgtgtattaatttcaagatgtgtacatagctacagactagagtaaatcagaactccatacgttttagatatttttccttggcctctgctccgatggttttggctgaaggatgtactttttgctcacataatctctatatattctctgcaaaatatcgtgccgcctctgcaactccatgaagcaacatcaactccaagtgcatttgtctttatggttagactggattggacaaatcttgagctttttcaccttttttttcttactttttcagaagaatggccctggtgcacctggtgggcaatcgtggacagctgaatggcttaagtttgataacagttatttcaaggtacgtgccactttgcccttattcttcatgtcggatgattcatatgattttgcatgatgtgagctggtgcctggtggcaatactgcaggagataaaagagaaaagagatcaggatctcctggtcttgcctacagatgctgcattatttgaggacccaacattcaaggtgaataatgcttaaactgtactctcacttcccgaaataaaccaatctcgtactaggatatgtcaggatcatttgaaaattgaaataattattgaactaactgtctgagaattcaccgcacattcaggtctatgcagaaaaatacgcagaggaccaagaagcattctttaaagactatgccggagctcatgctaaactgagcaatctgggtgcaaaattcaatcctcctgaggtgagtgataacatcttgtccttagttttcctttccacaacacgccactcttgaccgactgggccacagttagtagagatagtttatccgacaaaccactgccaagttgtttttacccccgatgactagcgcccaatcctagtccgtggtccttctgttgtggcaaactgagagtatgtgactgtttggttgtcctgcagggattcacgttggacggttaatgcgatgcgcatgagccagatcgctgaagtggccaaccacttttacagaaaggtctatatactctactaccccatccacctcccaatttgtaggttcatgtcagctgttctacttactcgatactgtgattcaacagaaggttcgctcggttcttggctaaaatgattccaatctgctatttatcttgctcgtaggatcaagagagaaacactacacaatccaatttcctgctccaacgttgtgtcatcattccagatgaagcttttcctgaccacgagtcatattggatttggaaactgagtattcgaataaaaaaacagactggctagagaggcaaatttgagccgaacttgcggaccaaattcgacgagaaaccaaaaagaaaaacattttaatactattctttacttattatgctttactcgtcctgtcatttttttagctgtaccagccagatgctcccccgaccacgggggcagcagatctgcagactgcagcacacacaccacaggggccagggcacgagtaaattcccgttcggcgagtgctcttggattttgtccgctacgggcacgaagaatcttttggtgcactgccgtgccgtgcagtgcttgggcccatggacccggtccacagtccgcgccaccgggtacggcccaccgagatcgggagcgccggagtggctgcctggtgggcgcccaccgagccaccaccacgcaggagagagtctacagggtttttgctaacgggacgccattaagggcagcagtggattggattaagacattgattactaggcgttcgtgagtgatggggcatgggggctatgctatgacgctgggcaagtggtggtcgcagcggcagggtctcacgtggtggccacgtgccgggtatcgagggagcccgctgcttttgtggtggagcgagccaagtgcccaaaattacatacaaacttcaaagagcctctccccccacgctaggcgcaggttctctcgtgtctcctgtcactttcccggtgatggtaagcgtgcttaccgcttctctcccgcccaaattgacccaaatcgatttcgacttcttttctatctacagggaaatgctactgcacagcactacttgtattacggtacactgctgtagtgctgtaggattaccgtgtttatatgtccatgaactgtgcgtattgtttacggagtaaatgcattgcaaagtcagaaacgattaggatgccatgtgctggtttaattaaacaaccattgcgcaattaggagtagttttcaatcggttacagtttgttgtgttttttttttttgtgtttgactatgacgaagtagagatttatgaatgcgaaaataagattagatcgtgcaacatattagtgtgaaaataaaagatgctatgcatgcaactataattataaagagtgaagataccgacattcacgtatggttcattttgttcgaggaagcaaacctttactacgaggtgatctatcgtaattttaatggatagtgactaccgattttttggttggtatactaaggttgtcatttgcaatttttttttgccacaccttatttaaagttcatgaggtgtggtgccaagagaaaagagagaatcttaccacaagtataactgtaaaccaaataagtagtgatcaacttgatcaaactcgttcaatataagatgtagcaaccttgggctacatgtgacattaaaccttacacaatgcatgtagtgaatgtcgacggaggatacttgtagaccggatatagagggtattggggtatgctggtacgaggatctacgtaatacgacatcaagcaaacagaaaacagagattatactggttcaggccccttaataggcaatagccctaatccagttgatatgggattatatgatggaagtcacaaattacaaagggaataatggaactcgatgataccgacgagatcatagtcgagttgattcgactagatcacccgacgacttggctcctgtaggctccggcttcataggctatggtggttatcttggctatgagatttgatgttttaggtcctcccagggggtcatttttatatcgcaggtcaggcggtttccaagtagaactcggagacatcggaccctgcacgatacagtgacgaccatcgatggacttcgtgatgaatttccttagcgtatacagagaacgtctgtacacgcgcagatataccatattgctgtatagcgtatatctaagggtagaggatatgccttatctgtaaccctgacagtgaactcgtcacccacccataaaacctaaccagcagaatataaaataacccctcactccattttctatttttcactaattcaaataagtgataattatatgtggtgaacgagccgcctatgttttcactgcatttttattttcaacacatgtagataaatatcagtcactaacaaatgctactcgttctccaagctcaacgatgtggatgactctacctgtggtccctgaacacgttgctactacgaatatctttttttttttagaaaaaatgaaaacaacgaggctgctcgttagacgttgcgatcccgataaagacggcggtaagcgcacctccggtggtcaaacccccccaaacccccacagaaaacttgagcgctttttagaccaaagcaccaaaaaggcggcacaaacccaaatcgacaaaagacgccacggtgacccaggcgcccctccgaggaagacgacgacggctgcctgcctagccaaagcgagaagcccacgagctcgcggcaaaccaacctcgtgctcgcccaaaccctagccgccgccccgcacctacctaccccggggctccgccgccgcaatgtcgtcgtcgtcgaggccggggcgggccagcatctccccgttccgatcccgccgcacgtcggcggcggggggcggggcgggggtggcggcggcggcgcatcctcctccggcgaggacgtcgtcgggggggcgaccctcgacgccttcctcctcctcctccgccgccggcggtggccggcccactaccccgtcgtcgtcgtccgccggtggccggcccaccaccccctccgcggcgttcgcgcggtccaccaccccgtcctccgggaggccgacgacgccctcgtcggcctcctcgagggcggccgggagggcgccgcccgtcgcggcggtggacgcggccaatgccaaggagaacatcatggtcaccgtccgcttccggcccctcaggtgcgctgctgctgctggttcgatcgctctgtgggtatgggagtcccctgggctttgttgggtttttggtcgtcacggtgtctccgtgtttcgtggtgtagtcctagagagatcaacaagggggacgaggtggcgtggtacgccaacggcgacaacatggtgcgcaacgagtacaatccgagtatcgcctatgcttttggttagtgatcttcaactcatcctatataaaacattcgaaatgatgataagcagttgtactccataaaaggagggaaggaagcaatctaatatgggatttccttttggaaatgaggatgacattacttggcaattaaaagctggctctagtggaatcgaggcataccgtaaatgagtattatcagtttcagcggtagattgttacagcaatatattctggtagtacaacatagaaaaactacttaggctgcacatgggaagaatgacatggcggcattgtagctgtataatatgtcttactttggttggtcaaggttgctatatagaatgcaagatcaagagcaccagatcatgatgaaacttgcatgatcgttagtacaagtgcatcaggcggtaagaagttaatatgttattgttttgaatctgagtgttatgatactgag

SEQ ID NO: 14991 - DNA, 1336 bp, Oryza sativa
aaaaggatgagagccctagaatttacaagttacaactggtgacatgtgatatctctgcagtttattaaaaccatttttgttgtatgtgttcaccttttcagataaagtttttggccctgctactactactcgtcatgtatatgatattgctgctcagcatgttgtaagtggtgctatggaaggaatcaatggtactttcaagtctccttttggttcttaaaacatagtactaaatactttcaaaccgtaagtgcaaagttactgaactaggaactgtccattgttacatagctatgaacatttccaagtcgtaaatatcaggattccgatgccacctttaccccctcctctttgaaagaaatcatctcccaaggctgctgagatgagggccctaggtaggattatttttgtgttggtaggatcagattatagttacaatggcaggaatgcaagataatttgataacgtcgttatatgaagattgtaacacataggaacatcattataccattctgtgcctaagtgtcatcagaaccagaattcactgataatattttaggatattatgagacagatcataatcctgacaaacttggcctctactttttgctaggacttaaagcattggtagttgatgatgtttatttttgtctcttactctagtatatgtagtttattcagttcagtaatattgttctgttccttgtaggcactgtttttgcgtatggtgtaactagtagcggtaaaactcacaccatgcatgtaagtatcagtaccgttgttatgcttatgcatctgttctctttcatgcatctaatacatgccaatgtgttcttattcattaaacgcgagacatctctatttcatatagctagtatcctgtgtatatttttttaatgactatcgcttcaatttaattaccaattattttttttacgacacactcgaattacagggggaacaaaaatcacctggaattatcccattggcagtgaaggatgttttcagcattattcaagatgtaatctgttcatttctctgtgaacaattaaaatggttgggatcgtatgacaatattatttttttgttcacctcagacacctggacgagaatttcttctacgagtttcatatcttgaaatatacaatgaggtacttctattgccaagccctgtctttgtttcacactaatgtgcaaagatgtgttacctatttagtacttacttaccctgtagaagccaatatgtttccaatccgtattcgtataagtttgaagtcatgtgatccataacttgcgctcactctttttgttgccttgatcacttctaggttatgat

SEQ ID NO: 14992 - DNA, 290 bp, Oryza sativa
agggcaaatatatactgacaatcatcagaggaaacaggccaagaacttcagcatagttcccagaatattgttagtgctagcgagtgtacctgcgatatagagctatcctttaaggcctctactttatgtggaactaaatgatcttcaaaatcaccatgccctagttgaccatatttgctgcaaccataagtatacaaactaccagaggaagaaacagtaattgtatggcgccatccacatgcaataagcaccatcttctctccctacaaaagatcaaataataggacgac

SEQ ID NO: 14993 - DNA, 476 bp, Oryza sativa
acctacgatgctgatccaaccaaccataagtttcttgaaagatactatagcactcctagttctaaagtgagtaaacacaacagctgttacattctgtttgtttcatcaaaatacattgtcaactacacatgctaattcttaaaactaatctgtatatatgctatatggaacgatgaacatttcagttatattattcaattttctttacctgcatcagcattatggctagcatgtataacgcctctagtatacctctagatacatcggtataccattgttcttgcataactgcaatgatctactttctttcaaacacaattggacaggcaatgcttttcgtgagcttcggtgatgacagaatcgagtccttcaagagccagattcatgaagcggccaggaaattcagtggtaataacataagttttttaattggtgatgttgcagacgctgatcgtgtcttccaggttattgtttgt

SEQ ID NO: 14994 - DNA, 160 bp, Oryza sativa
acagtagtctatgcaaagaaccttctccagatgctattagagagagagcatgtgctggagataaaacaacctcttttgttatgccttccacataagttccctgaccgaataaaagactgagggtacagtgaattgcttacaacactctttatatagagga

SEQ ID NO: 14995 - DNA, 1524 bp, Oryza sativa
aaaccaccgtatcctgttttccttggtaataaacacggtaaaacgcagcacagtagagtaattctacggtccttgaggatgtactaaaaatttagtgtaaaatttggtacctcatgatacctcataatacctaggtatcaagagataccaaatttacagtataaaaaatagtacctcatggtacctcctcaagaaccgtaaaattgctctatccaaaagagtaattctacggtccttgaggaggtaccaaacatttagtgtaaaatttggtacctcctttccctatagggattgaggctcctgttctatcactctgaatttatgggcaaaacctcaacaatatgacgaacagatctgcattccatccttaccacctttgtacgtattatgtaggagtatgtgtgtcaagaggtgaacggtgtaccataatgttttaccagcattccatccttaccacctttgtattatgtaggagtatgtgtcaagaggtgaacaatctaccgtaatgttttaccagaatggtaaaagcataagcatgaatgaatgctcacgcttctcgtatggaacaaaattcagctgactgctttgttattttcaatcataccacgagtctcttactgcctgccaggtgaaccactcgctggtctttctaaccaactaactgggctctgtaataatctttgctcagtggtgtgtcggtgcctgtttggatatatattgattatactgttaatttggtatcttttggtaactaggtagaacaaaaccatttttaatggattctacacatttttcttgatttactgagacttgagtgggattaaacggagctcggatgaattagttatgaattttagaagattcactgtgtttattactataacaaaaatccttaaataatttatggcgcaatattaaccagggctgacgtcagcacgggggggagtgcggcgccgacatgcggggcccactggtcagcgactcaagggtgagcggttcaccgtggaccgggaccacgcgggtggtccatcgccggtccacgggaccgacggcccagatcgccctcgggccgatcggacggcggcggtggaggcagccgccgggctcggctcggcatcaaagccgaccggccgacccggggctgacggcggcggcacgcgcacatcgcgttgccggcgacggcatccggcggcggaggcgacggcgcaaaagcgacgcgaaagcggcggcagtggacggcggcaacgaccaaaggcgacggcaagcgcggcggcggcgacgcacggagaatcgaggaagtaaaggaaaggggaaggagtcctcaccgaaggggacgacggcgtccggcgacgaggagcgacggagggaagtcgacacgcggcggacggcgaccgggacgacctaaagaacgaaacgaaagggattagagaggaagagaggggccataggaggcggggatgccggccgaaggcgggggacatggagaccctcaccgtcgcacgactggaacggttcttccgcgac

SEQ ID NO: 14996 - DNA, 1481 bp, Oryza sativa
ttaaatagggggagagggaaccggacgtggccgggagaggcgggaatcgccggccgacgcgggggagtggggagaagagagaggcgggattcgattttcgaatcccggccatctcgggcgcgggcgcgagcgggagagagaggggaatgggcgcgggagattcggcgcacgcgcgggcgtggtcgacgtggcccgggggaggcggagacgtgggcgcggcgacggttgcgggcgcggcggcgcgccgggatcggcgggaggagggagacgggcccgacaggtgggccccacctgtcggcgaccccgagagaggaggcagcggggcggcctggctgccgggctgggcctcggcctgcggccggcccagcggagaggggggggggaggaaaggagaaatgggccgacggcccatttgacaaaaaggaggaaaaagagaggaaaaagaaaaagaaaaaggaaaaaggattttccctggaataaaatattgcttgctcaattttaattggttaaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgtaaattacaattttggcctaggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtaaccttgtttctggttctcctttcgctggtatcaagtatgcgaaccggcttctccacataggttaggtcctcctggatatcaatgtgttccgaatcagcctgttcttcaggtacccttaaacacttctttaattgggacacgtggaacacgtcatggatgccgatcatattggatggaagttctagctgataagcaacttctccccttcgttccaagattttgtatggtcccacgaagcgtggtgccaacttgcctttcgtctgaaaacggtgtactccccggagcggagtgacacgaagatacacgtaatctcctgcctcaaaagtgagctcccttcgacggttatccgcgtagctcttctgtcgagactgagcaatcctcaacctttccctgatgattctgactttctcttctgcttccgctaatacttctgttccgaacagttgacgttcgcctgtctgatcccagaagagaggtgtgcggcacttccggccgtataaagcttcaaacggtgtgtcacgaccggaaatcacccaacaggcgttcctgacgtgcgtgcattattccttgtcccaggaggcaaggtacaccaaaagttgatacaattcagagtttaacaa

SEQ ID NO: 14997 - DNA, 328 bp, Oryza sativa
gacccgtacctgggagcggcttctgagaagagctcaaccttcttgcactgaggtacatggtttgtctttcttttctctccttcaagcaagtcagtggaaaggggattaaaatgtataagttcgatgatgcatgttaatcaaagattccatttaataggagacatcctcagattagttatgatgccactactgagaatgagaagcatggaaagaactctggttctagagatgcagtgaaatgtgatagttcctcttaatgtcaaagttcataccagctccttgctggaaaatgtttcttatcatgacagttccttgctctaatttgttt

SEQ ID NO: 14998 - DNA, 1037 bp, Oryza sativa
aaacatatggtccagacccattgtttatctctctgtcaacttttcctcccatggaggtaaatgcaaacatggagttatatactctgatattgtccatgtagttcctcgatctctttcctttttctttgcacatcagatttgaaaggtaagtaggtggtttctttagtgtaggtaagtcaaccttgccctgtttgcagcataagctaaaagaaggtggcccttttcctttgccacgagttctttcttcataccaaaaaagtgcaccacagtgttgacatgtgcatgtaggcttgccaaaattccattctttcacgcttgattttttcttcttccttggtggtacagcaaccttattccttgtaatgtttccttccttacttactcgatcattcatcttgagactggaagacaaatattttttttcataaaaaaaaagtgatttaaaaataaactgaatgacgatatcatttttataatgtggttaacatacctattcgtttccatgttggttgatgggatctgatatttttcttttctagacctgattttattcatatcacagtcagtgtttattcttaaataaggaaaaatttcctttctaacaattttgttgattttctgtatgtttacctttcaatgtgatttgctggatttgaacaggtcgaactgttgttcaatgtagatccgcttcttctaaggtcaagtttccttttcctgttcagtcttgataagcgtgcgagttccgttgagtttacttcagcagtgaagttcgagctgtgaaaattggatgtcaaaacagggagataactactttttttgactgattctgatgtattgtgcctattcggaaattaattgttattaaatacatacgcttgaactgttaaacttggatctgaaaatcagttcataattgttgcggttgaaataaattgttattaaatacaggaccttcataggtaattgtattcttcgcctataattttacctttgcaggggatttcctgtgtctgcgcttgactcattgttgctcattt

SEQ ID NO: 14999 - DNA, 1334 bp, Oryza sativa
tatattttttttattgtacttgaaaatagattgcatatatatattgtcaaatttctaattagatattttttgcctgatttttacagaagttaattaaattattgtgaaatccatttaaatattacacatttggaaagttcctttgatgcggttttatttagaacatccaaaggtttacaatcatcctaaggagattcattatattttggtaaatactaaacacgtttcattactgaagtactgataatagactgagggctcatttataaattaaaatccactgcaggaccaaagtgtaaaattgcaggcacatcgttatctcctcccaagcccttcctggccacatatctgcgctgcggtcgcgtttgtcttcctgtcccgaatggccacatgagggcgaaggccaggcggcggagaatctgaacatatattcttctccaatctatctagctcactcatcactaccttctcctccactactcatccatcggagccgatttgagagggaatgccttgtggtagcgacggctgaaagactggttggctagatccaccatagggcatccaagtcagtgccttggtagatccaccgcaggatgtctagatcaggagcagtgttagccatcggttagttggctctggtatgggaggtggtatttgtaggaaatggggcagtggggatggcaggtgttggggcagtgcggatagcaggtgcagcaacatcaagcatggctgagagcgaaggtagccccgagagctcatctttcttgattgatttccattttacataatcaagtttttttaatcattaagtttcttgcttggggatttgtattaattaagaattattaaatcaactgatcttgttttatatgcttttaggatatcaacggtagaggaagcaagcagggatcgactcatatacatgtactgaaggtacatgcatgcatttatattgaatgttattaactctctatcttagaaataaacaaagtaatccaaggattcctttggcaagtgcaagttgtacgttacatctgacaatatctaatgaacataaaaattaataggaacatatataatactattcttcaataaaaagtattggctgaaccctccttttaattggttcttttgggccttcttgacgataaattacctgcagacgaaagtccatattattataatttactaatcaaaccaaatctaaagcaccaacattttcccagaagtaatatgttgtacctaatatgagtatcgggtgggtggtcttctaatccttgttgatctgcatcgactggattgctcattcatgtgaactttaatgttctcaa

SEQ ID NO: 15000 - DNA, 931 bp, Oryza sativa
taaaaaagttttatgttaaaatacatgatttatttaacaaatatatcaaatacttcatcatcttgaattgtattttcaattgcactttttgtgcaagttcccatatttgtactattctttccacaaccttttcccattacgtgcacaatagcatattgacattaatggacaaacatgaaaggtaacattaaatagaaagtaaaactcaatgaagtacaatgttagtttgtcttatgtagtgtctgacttttcttttagaagtactggtgtccgccatgaccatatttttattatattcttcatcaaaatcatcatcaagcgaaattggtttgtcatttgctatcttctcacaatcagtagtatatggttcctattaatacccatcaattgtatgtaacatgtcagtaatagtttgacaaatcgttttgtatatgaaagaaaagtaagaattgtaccttatttctctgagttttcatttcagaacattttcctttcttagcctatatcatagtgccatattgaaatggtaaataatttatatgaaaactaaattgagtgaatttggaaagtaaaataaatgaagtaccttgttagatgttttaaaacgtcttgtaactcttcttttagaaggattcgtctttgtactctcctgtgtaaccttttcattgtattcttcatcaaaataatcatcaagtgattcttcacaatcatcatcgattgtgattgccttttcatttgttttcccatcaaaatcggtaatgtatggttcctataaaacatcattattagtgtagtactataaataactttacgaattgttatgtaagaaagcaattatacataccttgtttgatctttttgtacatctcatgtttgatctctctttctttgtttgcgatgattgttcatttcataatcatcactactttca

SEQ ID NO: 15001 - DNA, 1098 bp, Oryza sativa
ctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggaatgtgcggactctggggtt

SEQ ID NO: 15002 - DNA, 626 bp, Oryza sativa
atacaaaagtaatcctcaaaagttgtgttcactgttcgagctcgtttctaaggataggcgggaaaacacttctttccggcctatccccgatcttgttcgtgacctaaggtcacaacagtggcgccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggcagtggaagaaagtgacttggtaagagcaacggaaacacttgacaagcagtgggcagagatggccaagacatccacagcagcaggaggtaatgaaacaactcaagaagaaagaattgctggtgcggtggtggaagaaacagagaaaacacccatgagtgatgtagagcttgctgaattggtccaagcgcaaggggctgtcatggtgagtaaaggacaatatgaggaattgcaaaaagagttacaaagattgcaaaccctacacaatcagacagtaggagcaggaggatcaagtgatcagtgtgcaataccaggggctagggaaaagcaatcagatcaggcaaaaggtgatggactacttgc

SEQ ID NO: 15003 - DNA, 7455 bp, Oryza sativa
actgatcagatggtttatcacctacttcagcaacaattgaagattgttgctgctccatcccatccataggagactcatgttgccccattgtttgcgcctccaaagaccttgttttcctcctagtataaacttgtagattttcttcttcacgtggccttctccaattttgctcatgaatgggttcactaacaggatatgggattgagccaaccacaaatttcatgcttcttgattgtgtgtcttcttcagtacctgatgagccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttgctgtcatgactgcctcactccatagaaactttggtacattcatcgtatacatgagtgaacgagttacctccagaatatgttgatttttcctctcagctactccgttctgtggaggtgtgtcagcacaagaagtttgatgtactattccttctgctgagagaaaactcctaaattcatcattcacatattctcccccattatcgctcctaataacttaacacaagtgttaattgattcctaacccaagcatagaaattcttgaaacatttcaatacttcactcttgcgtcttatgagatatattcaagttattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgattttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatctagataccacaacccattatgcctaacgccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaacagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcaacactgccgctccgcctccgctgtccgacgtcgccgctccgcctcagccgtcgacgtcgccgcagaacccctctggtcacagcgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacagttaaagatggaaaatgtaacagaaaaaggttttggagttaccaaggtgccaattgatcattatttcttgtgatacatttcacttgtcccatggcatctagttccagcaggggtgacatttgcaatattatactgatgttctaggtgttcacaatagagctcaaatggcacagcatattccaactcttaaataactttgtgtatgtggtgtgctagtgcagaatgatatccgtaaaaatccactatttagacaacagttccatgagatgtgtgcaaaagttggagtagaccctctggcttcgaataaaggagcttgggcagaacttctagggattggtgacttctactatgaattgggttggtaacttaatttaagctatcttatttattttgatcctggaagtttctttcttttattattggaccatttatgttctgcttagcatctgtgtctattgcaccaggagttcagattgttgacatatgcatagcaaccagagcgaccaacggtggcttgattgacttgctagatctccgtaaactcctgtgtcagaagaggaaagctgatcttggatccttaacatcagatgattgtttgcgtgcaataagtaagctgaaggcaagtattttaaggaattctacagctacatatttttttggaatcttataattgcattcatgccagttttacaagatcgcactcgaatcgattaattcttggacagatctgttaattcttctgatccttcgcttgtgaactctcaggtccttggtagtggttttgaagtaatttctgttgggaagaaaaagcttgtacgttctgttcctacagaactgaataaagatcacaatgggatacttgagctagctcaggtttgtaatcacagcttttaatagtgtataatactacagtacacttaacaagtatgtggatgctgtcataaccttatcatgcttgcaccgaacaagtatgtggatggtgtataacctttggttggaagtcgtaaagccctatatattccacataaacacttgttttatcatgcttatttcagtcaacatagagacatagcacaaaactatgttaagccaaagctttcaaattgctgccttgctcaatctgtcaccttgccacaatatgaccatacctgcccagttataacatcattcacatgcaggctgaaggttttgtcacagtagaacaagtcaagagaaagttctcgtggtcaactggccgtgccatcgatgtccttgaaactttgctcaaggtaaatcctgctcctgcatttccactctttaggccacctttgtgcttcatttccgtgcccaaagaaaagaaaactgacttcctttgatgcaagttatgtattggtgattagaattctctctgttgaatccacgcttaagccattgcaggattaccttctttttgagctgccatgtataaataaagtacttttcttatgtgcatctctattgacacttgttatgaacgtctttggcatctatatgcaactctgatctctattacacaaacaggaagggcttgctatgatcgacgatgggcacagggatggcaagcgcagatactggttcccgtgcgccactctcagttctgactcgattggtgccgatgccaagtcatgacctgttccactccattgttgtcacctgtatccttttttccattggttcatttctgtacagctctggaagaatcacgagatagcaatacactttcagtgctgggctgccggcaaaaatgttacattgtgattcgtgcatcaggcaggattctgaacgtatttgtactagtggtctatactatactagttcttctttcacgaaattctactcgtaattgtaaattttcaatgctaatggcctcatctttcctcatattttcgcttatgtttatgccatcagctagaatttgaatttttcaactttaaatttagagttgattttgagggtttttttcattgaagtttatttccagccacgtatataaaaattctatttataaattatttttcgtttgtaaatatgggtattccacgccgtaagttgctaatgtgagcaagagaaatgctcgcaataaaaatgattaataaaaaccatattcattcggcccacgggcctcagccctcaaggcttctaccaatgacaattgacagccggacaggagtaattggcaagaagaaataaaagggaaaaaagaggcggaaattcatttttgggaaatggccaccacagaggcgaagcgccggcggtgattcctcctcccctactccggcggccgccgccgactcgtcgttaccgtcgctagatctcatccctgacatagcccgccgcttgacgtccctggaggatttcttctccctgcgcgcctcctaccgcgcgctcctcccggcgttgcgccgcctcctcgcctcgcagtccccgctcctcctcgtctccctctacccctccttctccgaggcgctcttccacccgcgcctccgccgcctccaccgcttccgcctccctcccatgggggcaccacctgcccccctcacgctacaccctcctctacgcccacggcttcctcaccaccgccgccaacaactacccgccaaggctcctcttcacctgcgagcagctccgcctccccaaggtcttcgcacccttctcccgcgtcatcctcacggcggacctcctcgtcgtcatcttcttggccggccgggccaccgtccagcactgccaccccggggacgcgctctggcgcgtggcctccgcccctgcaccccaagtgttcgacgatttgatctctgtcaacggcaccctctacgcgctggttggcctccgtcttgccacgctcgagctgtcggagagttcactggagctgtcatttctgggggggagagcatgatgacgcgaacaggccggagggggatcatcggttcatgctccgggagtgtggaggtgaggtgttgctcatcagcgtggagcatgaggagagggttgtgtaccgcgtgttccgttgggtgtctgacaaaaggaagtgggagatgatcaccaacttgggcgggcggtcgctatttcttggcttggatggatttgcagcttgcgttgatgatcatccaggggttcgagggggctgggccacgcttgggtgagtggcatgagtattccttggctgatggaatctgtgatgtctgcaatgctgactatccaggctcaccacccctgaacaaacagttcactcatcagaccatcagtttggatcttccccagcttgtgctgatgcaagcctgagaagggttcatcctagatcaatgttgaagtcctattgctcagttgctcacaagagaaaaaaagaatggtaatgcttgatcattagcttgcttactaggtcatttatgtaaacaatatattcatacggtgatcagtacttgcatcttattcgaccagtcaattgttgttttggtcgatatagtgaatacttttccttaggattttgaccacaggagcaaaataattttgttcccagcattgctttatgtgctatgcaacttgttgagatattatgaagcttcttttgcgtttattttcctttgatactgcagtaatagtgagtaaatcacataatatatcaaggaatatgctagtaccataatgttaattggttatatttgactatgtccctgtgcagaatctggaatttgcatgattgtaacttttgtagggtaggcagtagctgaattcttaaccctgtttgttttgtgatttatacaatgctgcaaatcctgcggagttgtcacagttatttcagtgatagtgagaaataaggccaggaataacacacgtccaatggacaatatcataaattatagttgatcatgtttttgatttgtactcctaaaaatatgacatatgccaggtcttagaaccgcttatgtatatgattttccactcctataaggctataactgtaagtttcattcctgatagaaacctgtggtgtctgacctccaaatagtctacgcaatcagtagttggcagcaagcagatgtgaaggggttgggcatgctcttttctggttcatcagtttacgctttatgtttaaagtgttcttcagttccgtgttttaggaccgcccttcagtttattcttttttcgggtctcctgtctctcccttccttgttcttgttgagtgctgacacaagacacaacttggttctcttgtggttgtctgttttgctaggtcccttgctgtttctctgtcttaatacgaagttaagccaggcttttgcgtgcttcctgtatttcagaactcctcttattatctaaaaaaaaaactcttattattgacttcagagggatttggaacaatttcaagtttgaaagcatgattcgctgtacatatggacctcaaacatatgtctgtgcaatgttacctggcatctcattttgttagcacttgtaaacatgaagtctggttacctgcaattcttaagaacggtcttatgacctctgactcgtgtgcaggttttcaagtttattttttgacctttggatggtatttgcaatgagattcagtcatatttccttttacttgattcagtcatgtttccttattacttgaaagttgaaactaactttgagaatgatcaaaacttcaaatacttgagatcaaaaaaaaaaaaacttcaaatacttgctctacctacttggtgtattgatatttgcatgtgtgcccaagaatgttcaagtgcagcatcaatttgtgccaggatgccagcgtaactgagtgcatgtttgcgatttcaagtctgtcgatgacatacacccaaccagagggcctgcatagttctgcattattcactattaagaggagtcttatttaccaatcatatactcccttcgtttcgaaatgtttgacacc

SEQ ID NO: 15004 - DNA, 18677 bp, Oryza sativa
atgtgctaaaaagtcaacggcgtcaaacatttcgaaacggagggagtatatgatcgattgatcgatcgatgcagctgtggatgagcaaaacgagtacgtactagtcgtcggggtcgtcggcaacgactgcgtcccgctcgcctcgccgtcaccatctaaatatccaggttcagtgatgggattcagaaattgctaaaaaaacagtctaaggtaaagattaactaatgaggtgttaaatttgtacgaaatttacatagtaatttaattttttaaaaaaacattatttacaaatggaacactccagccggccagagtccagatcttaacactcccttcgtttctaaatatttgacgctgttgattttttaaaatatatttaacaccattcgtcttattaaaaaaactctcaaaaactaaactaaactcttaaactcttaaaaactctcagaaactcttaaaactaccagctgacaactatcagctaatcccagctctatgtgtcctcgagcttcttgtcctagacttcagctgctctgctaacatgatccaacagtcctacctcctcagcgtgtcctaatatcttccgctgcaaaaggtgagaaacaatttgaaaagggagcattagtggtgagtaaaccaatttagatctaaagatcatattattcctagtagtccagaggacccaacatacagcttcccctctcatattcagggatggccggaaaggcacatctgcggggtttctggcatctggaaattgctcaaccgtctatcactctgagacaagaaatgggcacacatcagccacatttgagatttggcacacctcaacttttttgtaaagcaggcaatcatagtgaaagcagcaggccaaccactcccatatactacctccgttttttaatagatgacgctgttgatttttttctcacatgtttgaccattcgtcttaatcaaaaaatttacgcaattataatttattttgttatgagtcgttttatcactcatagtacttttaagtgtgatttatatcttatacatttacataaaatttttgaataagacgaatggttaaacatgtgagaaaaagtcaacagcgtcatctattaaaaaacggagggagtatccaattagagttcaccaaggaatgagacagagagatctagagggttcatgtaaagatcataagaagaggtgaaccagtataataaacagccagagcagaaagcaaacaacctttggaaaccaaaatgagtggtgataggagaactagctaactaggatcatcttcttcattatacagttccaaagatgatcaccacctacatggcgatctagagtctagacacaccatttcatgtacaaacaaagctgggatccatggctgaactagtagggtacgcctccagcgcgaggggactgatcaagatgatcatggccaccgtgcagacggcgaagcggaacaagaagcagtgccgggagctggaggagcgcgtcaggatggtctccgccgtgctgagccgccaccgccgccatgagctgcagccgagcacgacggagacgacgatggcggcgcggctgccgccgggggcgagggaggcggcggacgggctcgacggcgtgctccgggaggcgcacgagctcgccgtcgcgttcagccagagcggcggcggcggcggcaagaagacggtgcggcggcgcctcgtctgctgggcgcggcgggtggtcggcgcccggcgggacgccgagaggctcgccagcgtcctgagcaggatcgacttctacctctcgctctaccccgccattgcccacgcagacacggcgtgtcgcgtggaccggctgctgtggacgaccaccgtgaatgtcgtcgtctccgccgccgtcgccttcgccgggtttgttgttgtctccatctccatggtttcacgcaagaaataatctgatcgacggacagtagtgcaaaccctggctgatatgtattgatacgtatgtgtgtgcaaaagaactctcagtgtagtcgctttaccgcgagttgcatgtgcagttatgggaatatctatacatatttcccttttttattaggatacgataaggccaatagttctaatgagcatctccgagagagatagtcagccgtggcgatgagatcgataatgatgacatcaaacaggtaagggcggaacatgaccagaatataggaccaagcataatgaaggcggttgaagagatcggaggaggtagcactacgaacaacgcagcctatgcacatggggatcgtggatatgccgcgccagggaaaagccggtgagcatggtgtgacgccgtgaatgtgcatggccgaggacgacaaggtcatgaacggtgaatataagttttgcgactgtggtgtatgcaaagacacgtacaatacgtgcgaagtatgactatatatgcacaagtagtatacatgtggggccagcaattggaggttggccggcctaacacatggggccaattggccccttcttaggttaattggccacccctttgttctgccggccatcctgccatccattaatacggttgtgactttagacggcttggcttaactcttgacgtggattggatagtcggtttgaacaaatggtcagggccggctggacaagagatgggccgtcagcctgtgcagtgtggttagccagcctaagcggctagcaggggcgaatctagcatgaggtgacggggactcaagcctccactgttgacaataggaccatgataggtcccgtgaagcacttactagaactttttgtcatataagaggatctaatttattcagacttcttattatttcaccggtataagtggtggtaccctatgggaattagcttggatgcattaactcgttaaaacaattgtctaccataacgtgtttttaatccccgagacagaaatgtttgctatggtaaagtactcgtaggatgcaaatacgcaatcctacaacccgcatagcaacctgcttactagcttattttctattttctactataaagtttagaaggaaaaaaagtaactaaaattatgataagcggtaaagaaaaaataaaccgcttcgccacgctttgcttccgtacggtcatactttgtgattataaactctgatggtgacgtgttaagccgttgaaacagttgtgtacagagattttaggttatttaaccaagcacttttggctagacaagcttggagaattatagatagaccggagagtctgtgtgctcgagtgctgcgggctaaatatttcccatctggctcgctagttgatactaaatgcttcacccggatggagggcaatagagtatggccttgagctactgaagaaaggggttatttggagggttggcaatggtcaacagatcagaatttggcgtgatccctggatgcctagatgccattctcggaggcccataacgccgaaaggtacctgtagagttaagtgggtctcagagctaattggtatggatggcagatggaacgaacaaatggtaaaccaaattttctggcctattgatgctgagatgattctgaaaattcagctaccgacgagggaagcagaggatttcctagcttggcatccggatagactgggcatcttctcggtaagatcggcttacaagctgggcctttcgcttgcaaatgtggatagcagttctagctcgtctgagattgagaccagtaaggcctggaatctgatttggaaatgcaatataccgcaaaaagttaaaatttttgcatgaagagctgccaccaattgcttagcaaccctggagaataaaaggaaaagaaatcttgcggtgtctgatgtctgttgtatctgtggggtagagaaagaagatgttgcgcatgccctgtgtcgctgcccccaagctaagagactatgggatgttatggaagttgcagggaagaaagcgaaggatattgtcggaagttatacaggtgcaagctggattttggatcagctacagttagtaccaggggaggagcaaccgaagttcctgatggtactttggcgtacctggcatgttcgtaatgagattacacatggtaaacgtccaccccccattgaagcttccaaaagattccttgaaagctatctctcgtcattactggaggttaagcaacatccccgagcggatttatcgaaagggaagcatgtaattcagtatggacagcagcagaaaataaacctcctaaaaggaccaatatcagctccctgtcgctgggataagccacctcagggatggatgaaactcaatgtggatgggtcctttgttcctaacactgggaaagggggcattggcgcgatactaaggaatagtctgggagaggtaatcttctctgcctgtgggtaccttgggcgatgcaatggccctctgtaggcagaactactggcatgtaaagagggcctcaacatggcccttcaatggaccttcttaccaatcatgctggaaacagattgcctagaagcaaagaacttgctttgctcctccaatagtgagagatcggaagttgcttttatcgtcagtgacatcaaggaactgatgtctgggaatagggaggttgtcgtcaagaagattcaatgaaatcagaacaggattagtcatattctagctaacaggggccgatgtgactctgtcacggagttctggccggataatagttgtaactttattgatctccttgctacagaggagatgttagctgagtaatataatcctgttttttcccacaaaaaaaaaaaacagttgtgtacagtagccccgaaataatgcgaaacaatttatgaaaaaggaaagaagagagttgggccatgttgagccagtgggcttgggctgctttggttggaagagctagctagcaggtggatcatgcgtgcatgcagcaaccggccttttgccttggcccatttcgccggcagcagcagcagcaaagcaatcagcagcaggaaacgatttttttgtttttatatttattttttaaaaggttccaaaaataaattcccatttcaaagttttacataaatataaatcatcctacagtaggacaatttatatgtcgtggcacctcacgggggaagcgtgccgtggaacaggtagccccttctcaccttcttgtaggaggatttatcatcggaagggagccaccttcaaaattatcatggcgcgtcccatacatcaccaactaaattgcactataggagaatgagaaaggaccgcatgcaaaattgctagtatatcacatggcctgtcctaccgtaggacgatttacattcctcatcataggtcacataacctaccctaccgtaggacaatttatatacccaatcctagggtacagcgggagtatatttttttaaaaaacggtaatttatattcataaatctttttaaaaatcaatataaaaatagaaaattcatcgagcaacaccagagcagcaacaacatcgtgctgtgatatttgtttttagaccgtgggagtagttccctagtcacggtcacccctcagtccctcaccactgcgtagaaaaggaagaggtcacgatcacggacgttgaatgttcaagggggttatggcacctgtcactctgacttatcacttcacttctcatttctcttatttttttaaagataatttctcatttctcttattgtcagcataaatatgaattccctccgttccaaaaatataacatggattatcttatatttgaggacgaataagtatcttagaagaattgcaaaatattgcaaccaagaagaaatatctcaagctggtattggtattatcacatcaaaggtaattaaacgctgaaagtagggaaacacatggcagtatttacacatggaagatgtttacacacaaacacacttctttgggttgtcgctagcccttgataggagccagcaggctagctgacacgtaccggtctctggtagtactaacagagacagcaagctactaggaacagagtaacaagataagatagcaacatactagataattaattacgtattagataaccacaaggaccagcaaacgtggcgtgacagagagatcgaccagcctccgatcaatgggattatttagttcagcgatggctgctcctggtctcgtcgctgtacagcctagatgatgagaagatgaacaggtcaatatgatgattcagttcaatttaccaatcatatatatggagatatagatcgatgcagctgtggaatatatggagtattagttcggtcgaaatttttcaaaatttttaatttttttcgtgaattttgataatatttgttcaaaaatttcggtgagatccgatcaaaccggctaaaccgaaaggtttaaccctgtgcagctgtggatgagcaaattataagcaaagcgatggataccagtcgtagacggtgggggagttgggctgcgggcggtcgaagaggttggcgccgaggctcttggtggcgaggttgctccccgggtggaacacgctcctccacacgttgctgccccgcggcgtcgtcgtcgccgtcgtcgtcggagacgaagacgacggcgtcaccggcgtcgtcggggtcgtcggcatcgactgcgtccgcttgtacgccgccccgctcgcctcgccgtcgccatctaaatattcagaggtttagtgatggatcggagtcagaaattgttaagagacagtctaagatttctacgaatttatacatggtaatttaaaagaaaaagagcatgatttcgaaggtacaaatggaacactccggccggccagagtccagatcttaacactcgttaatatatataagcaatatttctggttacgacgctcttttaaatttgttgccgtccctgcttgtttgcttaataaaggtaatatattttctctgtttcatgttatgagaccgttctttattttgaatatcttatatatagtccaaatttatattgatgttaatcaatctaaatgaacgacgaaacgaccaaaacgtctcataatttggaacgaaattatattagcttgttagttaggagtagtaagcatctgtacaacgacgtaagctacctttgttgatgacaagggggcgggttgtagcggccttgcggagcttctccaggccggtctccggtcgaggcccggccaccacgtcgtcccacagcttctccagcatcttcctgatctctgcttccacgcactcaacaactgatctctctcttgcaactttacaacaactcactgcctcccaagtaattgagctgagtgtgtgtgcccctccttaaatcattgagtggatatgaccaggcgtcaccgcaccggctggtcgtcttaccgcaacaatcacacccagtaccttccacacgattttggccgtatgcatcggattggatgtggaggctaaatttatcttttttttaaaaaaaataacctttcacgtttcaagtataaccatatttgtaatcttctcttcatgtactaattatgatcacacgataactataaagatgctattatgtattatcttcgtcctaaaatataaatataaaatattttacggttgaatatagttattaaaaagtaaatagaactaaatgttaaatgtaaaatggttgtggttgagctagaagtgaatgtaactagatagatgggcaaattgaatggtggatgatgataattatgattggctggaaaaaaaatttggtggagaaattgttatattttaagataaattctaaatgttaaaaattattatgttttaggatagatgatgtaatttttttatacatttaggtgtatatattgatttccaatttagatgggggaaatagataacactgctttcagaatgctgtatataccagtgtgttggcttagagcaagtctagtagtacagtccactactagctccaattcatttatagccaattcatataatagttgcttgctatactattaatatatggtcccacctatcatatacacagtgtgtcttgaagttcgtgctgcagctggctacaaatctgtagcccgctactcttctctctcatcgtttatctcatcaaaatatggttatagttggctaatagcctgctattatacctgctcttattacccatagaaagagactaatgatggggctactactgtggaagtgtggagtggccactgtcctttggaagtttgttaatcactgtcaatgtggttagctgcaccgacggtgagcagaccgaaagcacatcttcaatgatgactcatcgttaacggataaggatgaagcttttgggtcccaccccatggggatggcccacggcccgagagtgatgtttccgatctgacgaaaaatatctaaactgaagatttcagtatttcttccggctccaaaatatggcaacataataattatgcagatttgtactaatacgacttatcgcatctagtactcacggttgataatatcgtttaaacttatcattttagataaatgcacgatctagaaaagataaattttatcattatattttattacaatatatatagaaatattaaattattgatgtactttataagactaacctatgcatttagtcactatatttctaaccaatttttttttaaaaataatagtaataaaaataattatgtggtaaatatgggtttaaaattagagaaataggaaggacactcttttctggagtgttcagaggtggacgttgttacgttgttacggagtctacatgcggacgtccaccgtgatttcgtaatggtcaccgaaattttcgatcgactgatcgccgtttttatataaggggtatcgttttcgattgtaccgtttttagctatttataaattttattttgtctactatattgagtagtttaaacgataaatatggtcaattaccgatcaatcgaacgttgttttcgaaaagatgctaccgattccgaccgttttcacatacagctgcgggtgtttttttcaaaaactgatagtatcggactgataattgtctgatagtacaagaaagggaatcaaattcgaataatttctcttggaaacatataaacaaatacataccagtaaggctgtgttcgggaggggttggaacccctcctcccggcacgcaaaataaaacatctattattgtatgattaattaagtatttgctaattttttggattaatatgagttttttaaacaacttttatataaaatttttttataaaaaacacaccgtttagcagtttgaaaagcgtgcgcgtgaaaaacgagggagggaggtagcgaacggagcctaagtatggtatccggtggacactggaatcagtcttgttgaagttagatcaacaagattgaccaaatttgtgattccactgtccatcggacacatcacaaattacggatgttggatcaacaagaatcacaaatttggatctaacttgttgaagtttttcaaacttttttcataatacagtttagaatccactcccatctcgcatcacacctttcatttcataaatcattgtgtgcccaagccaagccaatggcgacgatccggattttggtctagtaggggtcgtcggtatcaatgtctgtaccggacacaaactagccccccccccccccccccccaaaaattaagaccgtcgctcgctgagctccacgacatgctccggcgagcatggcgcgcgagctcgtcgaactcgatcgaattgtgcagaaacgggtctcatctgatctgatcatctcgtgtgttgcgctgggccgcgcgcgccctaagcgacgcaacgatgatggcgacctcttgctgcgtgccacatcgaccaccagtcaccagatggcgtgtgcgtacgcgcgcgctcgacgtgtttgcggaaatgccaggccggcgcgcgccgcggcgcggccggggtagcaagcacgtacgcgtcttatgttacgcgctagcttaggagctaggtgcatcaggaaattacgtacaaaatgcacagcggcttactctaatactcgatccagtcaatttcataattcaggaaatttaattatatcgatttccaggacaggtttttcacaaggacacagggggcgtacacgtataatcgtatatgcgatcagagtatatatacgcgcgttttagcatctgcttaatcaggtcagccattttccttctgtttacgaccatttcttttgcttaatagttaatcagtttctatacgcgcgttttccatttcttttattttgctaccacgtcgtgcgtggacgatgccatcatagtgtcgtcttggagctagtcaacctatttgtgtcaccgctatacatgtactattataccagttcattagattcacgatgtattttctatatgaccgaacaatctattatataattaaagtaatagaaaaaggagcctccatattcgctctcacggcttagaaattctcacattaatcgaaagaaaataagagaaaaaaacaaaacaccaagtgtattaggattagaattctcacattaatcgaaagaaaataagagaaaaaaacaaaacaccaagtgtattaggattaggtcatgcaaacggacaagaaaaattaaaagttaaaacggacagaacaaatagaaaaaaaacaaaggatattataatgatagtgtgtaaacagataatgattctttggaatccgtatgagagaaccaaccataatcatattctgcatgcccatatgcgtgggccaccatgctatttatattattaaaggaatagaaaaaggagcctctatattcactctcatggcctagaaattctcacattaatcggagaaaaagaaaaaacagagtccatatagaaatacaatttagaaatagctgaaattcggaattaaaaaataaggaatattagaagaggagactagagtctatatagaaatacaatttagaaatagatgaaattcggaattaaaaaataaggaatattagaataggagactagagtccatatagaaatacaattaggaaaaaactgaaatttgggaattaaaaataaggaatattagaagtagagtatagataccatatagaaatacaattaggaaataatataaattcggaattaaaaataaggaatattagaagtagtgtatagagtccatatagaaatacaattaagaaaaaaatagaaattcggaattaaaaaaataaggaatattataagtagagtatagagtccatatagaaatacaattaagaaaaaaaatagaaattcggaattaaaaaataaggaatattagaaatagagtatagagtccatataggaatttaaaactaactaaaattcagaataaacataacaaaattaaaagtagagtttagagtccgtataaaaatacaatttacaattaactaaaattcaaaattaggaaaaaacatgggaagaagagtttaaagtcaatataggaatacaatttagaagtaactgaaattcaaaattaaaaattaaaaataatgaaagatgagtttagagtccacatagaaatacaattagaaataataaaaattcagaattactagagtccatgtaggaatatatataatttacaaataactaaattttgatattaaaaataattaataactaaaacatatataaaatacaatatgaatattacacatcagtagtttcataaagttattgcaaaatttaaaattatgttgtcatttttatatatttgaataatataatgagaaaacatatatactattatatgagagaaaatataatgatgctagccgcgcaatctgcgcgggccaccatgctagttctaataaaataatgaagtttatacgctccccgcaaaaaaaaagaaaaaaagaaaatgaagtttcacgcgtaaaatatttcaacacacttctccaggatgccttaattccgaattatccagagtgatcatcagaaataagagatactaactatttcttgcaagatactataatcactggttctagcaaattaccaagaaacaacataacgctttccttgcctcaacaatcgcgtatcgctacatacatatatatacacatatatgacaaatgtttctgttcatgtgtaaatagttgttccggcaatttaacctgtttgaaatcaagtctcgagaatttgattaggatcaacaaatcaagatagaaattaagtttgttttgatcaatggagacccttagcctggtgagcggcgtgaccaccatcgtcaagctggcgaacgacatcgacggcgcggtcaaggcggcgagccggagcaagaagagctgcgagaagctcgccgagcgcgtggccgacatcggcgacctcctcaagggggtagacacctcctcgccgtcgacggcggcggtggccacgaggaggctggtgggcaggctggagagggcgctccgccgcgcgctgctgctcgtcacctcctgccagtccaccagccgcatctacagcctcgtcgccggcgggtggcaagccgagcagttcgacaaggtgaactcagagatcgaccggtgtctcctcgacctcagcctctccagcctcgccctcgtctccaccattgatcacaagctcaacgccgccgccgccgccggtgaacggaacaccgtcgaggtcgtcgcgccgcccccgccggtgaagtgcagtcacgatcatgatcaggatgacggcgaggacaagatggcggccggcggcgcggctgagaagaatggcgagcttatctgcttcggcggcgagcaagacggcaaggctgagacggacgccggcgaggtcaccaccaccaccaccaccatcggtgtgccggcggccacggcggcatacatgcactaccatctgtcgcggctgccgccgccgcggtgttacggataccacttgcattattgccactgcacccatggccactgtcactgcgccggcggccgccactactcgccgtcgtactactccgacgacagcgctgacgtcaggctccggcatatgttcagcgatgaaaatcccaacgcttgctgcatcatgtgactctgagctctcaaacgtgataggccaattagttagaaaactaggaaggtcgcccgcgcacatgcgcgagcaccttatttaatgctgatttagtttttattacgaatgtttaattcttttagatatactcattttattagtcttactaaaatgtttgaatgtttctatttagaattaataattttttgttcaatttacatttcctttcatctcttttttgggagaattccactctatgaagcatccttgaaatgctttgatcactgtaattcgggatgaaaatatgtgggttgatcccatagcacgacatggggtaaaggtatccattctaagttatctctttccaattaagtaagaaaatttaaaatagaggtcatagttttttttagcaaattaccacttaactgaagtgtcatgtaacaaatacacatttctagattgttctatgctaaatgttaggaattcatgatgtaccgtagcaagtttaaatggacattttttaattcctatatggaattaacttatatattgctaaggccacaacatggttatttcactgttaggattccttggtgtagccaatgtgcttagtacgatcaatatgatattcaattggtcatgcgacttcatatatcacatatataatttagatgctatgatcatcttaagattatttatttatctcttaaaatatcatttattgataaaagatcaatatcaaattgtatgggtaaatagctcttatatacatgcttagagaaaaataattaagtcgatggaaagtcattagatgtttaatggaatataagtactgggtctaccagttttatgaaaatttaaggtgggatattttgatttttagtgagaaattttagaattttcttttatttagtggaggcctcaatatggaagtgggtccagaatgtaaatttttgttagcaaaatatagtcaatatggatattaagttattgatttcatataaaaaaatatggtaattcaaacaaatcataaggggcatagggatagctggctagacctaatatgtggaggttcaattgtggtcttttcttcaaggtcaaaaaaaaattgtggtcttttctttgcccataaagataattttaattttaattgttatagagatagaaaaaatagaaaaaagtaatgccgcacaccgcacatgaatagggatggagggaaagttgggatgtcttttttaaaaaattgatctatctaatgatctgaaataatgtgttgatgtttaagtcaaaaccgatggttggatgtttttattttttttcagatttattaggattttctgtaatttaagcgagattagtagcagcttagtaaagcatttatgtactttaatgtcctaattgtttgggatttttttaaaaaaataaatctaataacaacgtaaaataatgtatcaatcgatttaagtaaaaaccaatggttgaatgtttctctaatttaagagtgccacacaacggttagaaacgtttatagtatgtttaatggacatatgatgtctatttgtgagtcttttttccataaagataattttaagtttaattgtgattaggatgaaaaaaaaagaaaggagcagaggtagcgtacaatacgtgtgtgctgcacggaggtgcggacatttataggttttggtttttttaaagatacatctaacattctaaaataatcggtccaccgatttaaagaaaaattgatggtcagatttctttattttattagaataccacgtggcggcttaggaatatttttaggctgccacatgacggcttgagagcgtttgtaggaagtttaatgggcttttagaatataataatagaaatatgtaaagataaaattagggtgcgtaaaaaaacaattaggacatgattatttgattttaattattgcgaacttgaaaaatggatctattcaactttttaaaacaactggcaccttatataaattgtcaaaaattttgtggcgttaggattgtgaatattttgaatctgtccattgatgaaagaatatgaattttaattataaattcaaattttatctttgagctccgtaggatatataatttgctgacagcgtcttgtatgtaggagatataatttgctagtcctgtaggagtaactaatctggcttgcttttgctaagagatagatttggtatcttatatgaaagtatcaaactaatctacgtgagatggatgcatcgtgctgggctgcacatgtgggtcctcgctttctatacacaagaatacacgatgcatcgtacggggctgcaaatgtgggtcccgatttatcttgttgtgccatgtggcggcttgagatcgttttgaggatgccacatgtcagcttgagagtgtttataggaagtttaatggacttttagtatataataataataataactaggaaggtagctcgcgcagttgcgcgtgcatattatttaaactatcataatttttgttgttattagaaagaatttagggtttcctttgtaacacaggatttttagaaaagaatagaaaatggtatataaatgattttgagaaaagaaaagaaaatggtatataaatatgatagaaatgaatgtttaaaatatagtatggaatagaatggatgtttggatagagtgtaaaaaatttaaaatgtattaacccagttagatcaaattatcatctggacaaataataatcaaacaacctttgcattagtagcttgacgattgtctcgatggtaattttttaaaattctgttatatgcaagatatatatcttgcatgtacgtacagatatcgtggagagacgagtgattatgtacgggagggaggtggaatggatttgtatttttaaggattggtctatcggatgtaaataattgttttaccgattaaagttacaatggtcatattttttttcttatattttatatatgttttttattttgaaaagatataatgtaatggtccaaaataataggtctaagattttaaatcatgtgatagcgtaggattttttagaagcatgtgtaaaatagaggatagagaaaagtggttatctgaattattaacacatagattattaacaaaacaaattacataatccgcatataaactgtgagacaaatttattaagcgtaaataatcggtcattagcaaatgtttactgtagcacggcattgtcagatcatggcgcaattagttttaaaagtttcgtctcgcaagtacaggaaaaacagatgattgttaaattttgttaatctatgtagatgaaataattatgcatttgtgaaaaaaaaactgcacttaaccaaacaaattttgcatcactttgctttgactaaaatactaattagtagtaggcaactaatactctgtaactctgtctaagctaattttttttgctcttcttttctattccgctatacgagtatacgtatggatagcaaggagagagtgacagaagaggggaaaatggaaaggatgaggtctgaggggaagggcggacgaggagggcggatggcggatggcggatggcggatggcgcgggccggaggtgcgagcggagagctttgggcaggggggacggcggcgcaggcggcagggatggcgtgggttggcggcgtaggcggcggggacggcgtcagacggcggggatggcgtgggttgctggcgtaaatggcggggacggcggcgggcggcggggatggcgtgggttgcgggcagagagcggtagcggagagctgcaggcgctgtggacggggggacggcgacgcgggtggcggggacggaggtctcgatctgacgtgcgctcccgcaaggttgtggagtgcgaggccgagctggttgcgccgccgagctactgcatcgccaaccgcttcactcgcgattgggctgtacaacgggcgctgtcctcaggtattgcatcgtgcatccctgcatcgtcaatgtgtactgcactaatgtcctgttgctctgttcccatgtctttgctctgtatcgatttgtctctgctttacgttcaagttatccctcttgtactgcatatttgagattttttggcccatcatgaagggtgtctgtatggctctgtataattgagctttcgtagttaactaattgtagtaaaaaaagcttgtaacttcaaagtaaaaaatgctttcaatttgataattttatatataattaccataccagaccttcacaaaacttcatatggtaggaggcggggatggcgtggtccgcgggcggagagcagcgagtggcggggacggcgtgggtctcctgtagtttcccgtctccctccctccagtggctgttgcaggcttgcagcgccatgtccatatccacctcccatgttccgtcctcacctcaacatcctccttgaattatctcctagctcagtgggtgggttggcggctgcggtgtgtcgacctctctatcttccttcgtctgtattggttatgtcctctctattttccttgattagtggatttggcatcagctgctggggtgttcgccaggggacaattggcagcaatggagttgttgttcacagctctatggaaagacggtatgtgcataatacgaaagattgcggaattatgatgtgattaaatggctcattggctgtgtacatgtattttggatgtttaagcctgtttaatccattgtctaaaaaaataaatggttcatggatgtttactttctggggaaaaatgttataatagaaggaaaatgtaattatcctataactttatatctctccatttctttttgtttgacgccggttagttcaaaattgcactaatcaacgtcattcatttgaaaacagaggtagtaattattgaatatagtacaaagatgaaatatattgtttgtgaaaggaagatataatgtttgaaatatcatcctatttcagctggtaaaaatactcactgtaaatggtaattttgaattgcagcctttcgctagagtatgttgtagcacaatcaatgttgtactggagagaagcaggaatagagcagctgcaatgaatatttacaatgataaggtacccatgagtagtttgcaacatagtttgtatgatcaatatagatgaatgagaatgatataataccttctagaaaatctctttgtacactatgttcctgaccatatgttcacctgggctttcattgtcatctagcattatccgtagcccatctcgtcttgtaactctggagaacgctacgtagagctgcccatgcgtgaatacttgcttaggcagatatagtcctaccatgtttagagactgtccttggcttttattgatggtcatagcgaagcacacactgagtggatattgtcttctttttagcaagaagggccatcctgactctgttggcgtcattattattctagggatatataccttttctcctacatgtgttcctgttatgatctgtgcttcaatgaatcttttcccgagctgagtaatggtcattcgtgtaccattacataaccctgaactttggttaatgtttcgcagtagcatcactggaaggcctagtttcagtttcagcacatggtttggcattccagggaagtttagactatttagaaat

SEQ ID NO: 15005 - DNA, 1421 bp, Oryza sativa
atcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttttttttccgcttagatttttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcccttgaccctaggttatgccaaatggttacccatagaagccttctaaaaatattggaaaagtagaactgttctcctccctttctcttttaattaaaccaaactaatggcacatgcacttcataatttttttttaatggttctcattcaaaatttattccagtgttattagtactgtacatctattactgtactaatggctcattttatcagcaaaagttttacaatgttgttttatttaatcttgctgcaataaaataaatttagcatgttgattttataattttctttcatttcttttgaaaccagttattcaaaattacaaaatttgtaacttcgtttccaactgtttcaacttatcctgcaagtttggtttactttatttacttaccttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggattcgggactgcccctttttatgcccagattcctcatgatcgtcatgaagaaaagtgccgagtcaaagtcactttgaacagtaatagtgaagatatcccctcagtgatgtttgaagctggaggaagaaattacatccatgcatgtcaggaggtggcaaggatcgccataggagagctccgtgatcgctacagtgatcaattggccgacactgagtatcgttaccatcctcgtcaaccacagggaagtgaccgtggcagttatcttgagactgaaggaattgagaatgatgctaccacaaggcatttggttgagatgctgtgggctatggatgaaagtcgtgcggagactgtactagcagctcaagatcgtgaagaccggaatcgtggtaagatttgcaagttagaagacaaggtggatcgtttggagaaggaattagccgcattgaagggagaagcaccgccgcagaagg

SEQ ID NO: 15006 - DNA, 909 bp, Oryza sativa
aggtttgtaccgcaaaagaaaagggaggactaggaatcaaaagtttaaagactcaaaatgaagctcttcttctcaaaagacttttcaaccttttctcagataattcctcctggactaattggatttggaaagaatttgatggaagatcactattaaaatctctaccgttaggtcaacactggagtgtctttcagaaactgctgccagagcttttcaagataactacggtgcacattggggacggctcgagaacatccttttggcatgatcgctggactggcaatatgactcttgcagcacagtttgaatctctcttctcgcattcaactgacgacttagccactgttgagcaaattttatccttcggaatttacgatattctcacccctaggctttcatctgcagcgcaaaacgacctacaagaactgcaaaccattcttcagaatttttccttgacaaatgaatcggatactcggctcaacaatcgccttggcaatttaacaaccaagacaatctatgatttaaggtctccgcctggctttccttcaccaaattggaaattcatttgggactgcagaatgccattaaagatcaagctctttgcttggcttctagtcagagatcgactgtccacaaaattgaatctcttgaaaaagaaaatagtacagacagcaacctgtgacatatgcagcaccactgatgaaacagcagatcacctcagcttcaactgcccttttgctatcagtttctggcaagcacttcatatccaaccgatcatcaatgagactaagtacctggcccaactaaaggcaccagcaactatcccaacaagacattttcagagtttcttcatgctctgctcttgggtcctgtggaaccacaggcatgatgttgtattccgaggaagac

SEQ ID NO: 15007 - DNA, 693 bp, Oryza sativa
gtcgccgccgccgcgcttgccgtcgcctttggttgttgccgccgtccactgccgccgctttcgcgtcggttttgggccgtcgcctccgccgccggatgccgtcgccggcaacacgacgtgcgcgtgccgccgccgtcagccccgggtcggccggtcggctttgatgccgagccgagcccggcggctgcctccaccgccgccgtccgatcggcccgagggcgatctgggccgtcggtcccgtggaccggcgatggaccacccgcgtggtcccggtccacggtgaaccgctcacccttgagtcgctgaccagtgggccccgcatgtcggcgccgcactccccccctgtgctgacgtcagccctggttaatattgcgccataaattatttaaggatttttgttatagtaataaacacagtgaatcttctaaaattcataactaattcatccgagctccgtttaatcccactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaacatgttgatcctatattgccaatg

SEQ ID NO: 15008 - DNA, 4076 bp, Oryza sativa
  unsure (1)..(4076): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagaggcaaggttgtttttgcaaatcttttgttttgaaatcattttgaaatcacaaagtgatttatttctttctaagtttgggtcgaaaagagacttgcgtctcgattcgaccttaagagatgtttttcaacagctcatttggtaatgtaccgacctcccgggtcagatcattacttctcggctcctagagccattccacttgattaatcggctcccagagccttttacattttctcggactcacagagtctagctgcccagcagcacaacaatccgcttccactcgggaagcctagtctatgatgccggtagacatcccgaatcacacagattcatttcttgaccactcaggtcatccatctgccacataggctgattctggtaacaattcccacaccacaacaacttttcacaaagcacaggcaaacaaatctacgctacaggaaacacctcacatccgcccatgaccgcgggcacggctgttcgaacagttagttaacctctgcagagggggtacactttacccacacgacattactaacccggatcacccagcccgtgagattagccacgtcgggagaccctaaggctttcataacaaggcatttcgaaagccgacacaggtttaccatatgccaacgagaggggtcccagaccaacaccaggttaggtcccagaccataccgtgccaggaagcccgagggttctccctgacaccaccccgttgaatccacatgtctcttggcatcatggctcccccgattagctaattactcagccaggggcgtcccattgcacccgtgtggtcgcacttattatatgctcagatgaatttcccacaggaatcggtccttatatgcgaatacaggacagtaccacataggcacaacccccgcatcgcgagttttttcaaacacaccgacgccacatgtcgggttttcaaggcttctcaaacccatttcccaaattatcgacaaacaacggtgtatgtggaatagttggtataagtgctcagagagcacggataccgaagtaccacaagggtggagcgacaaggaatcagggtaatacgacctacaggaattagtgcgactactgggtaggtccgtcggtttggcacgcaaaccgaggccaagcatgttaagtgtgtgattctaataatgtgagctgcaatcaaaataataatgattttccaattataggagcaattggtcaaagggtgacttgcctcgctcaaggtcttcacagagcttcacgaatcttcgagaaaacccgcgatcgacgaaaatccgataaccgcaactttacgcaaacaaacaaaaacctaaagaaaagaccaagaaaaagaccctatttagactaaataatagtgccattaaatagatctcaattttacggaattactggaagttgaacgaagtcaatcgggtgagcggttgagaagatatggattttctaaggattatttgattttctgtctaaaggaaaaggaattattaattcccttggaaaagaaaaggaaggagggatcggatttagacttcctcgggcgacttaggcgcagcccgagggattcacaaggcttggccggccattgggccgagcgcggccacggggaggcggcccattagggggcgcggggagagagggaggcccaacggggtgggcgcggtccgccgcgcggggtcccgagatgggcccgcatggcagcggtcgggtgtatggtggggagggcgcacgcggggacgggcgagacggatcggtggattgggtgcggatgcggtgcgccggtcgacaaggaggcggtgggcccacgtgcagcctcatggctcaccggggtccgcacgcacggggatgaaggggcgagggcgagcggctgaccggcttgactgggtcaagccgacgtggcacctatgccaggccacgtgggcggcgagaggaggaagaaggggggatgccgagatggacggcggacggtggccgagttcaccgcagtttgatgcagaggtctagggccaacgggagcacaccggaacgatggctaggataagagggagtgagcctccggctcggattcgccgggggggattcgatggcgacggatttcgacggtggcggccggcggcgatcaaaaggggaaatcgcggcggggcgacgagaggtcgattcaaggaggagggagcatctccggggcgcggggaactcatttccggcaccggatggggcggaggactgccgaggagggctgacgacggcggcggcctccgggagcgggcggcaacggcggcaagcctatggcgggcggcggcgagacctggggcggcgtccatgcgtgttcggggggctagccgagctaccacgcgagctagggagggagagggcgagcgagaagggagaacggagggtggcactaccaagccgggacgggcgcagtgacgagcggccgacggctcgggagcgagctctccggcctcgggccggggaaggggaagaagagggatggccggagtcctcgtctcgcgtccacgcatgcaccggcctctgatgcgtgcgacggcgaagagacgaaggcaagaggtgggagtggcggcaaggcgtcaacaatggcgcggtgagtgtgaggcgagcgaaaacgagagaggaaggggtttgggggcggcttgggttttatagtggaggcgatgtcggtttggggagggagggaaaccgaccttggtggcggtcaaggagagcgagctggcggtgagctggtgcagtcgcacgaccagcgtccgcgctttggccgcgagcggctgggaccatggatgatgtcacaccccgaagttttcctcccaggccaaaattgtaatttacaaatgaccccaagaaaatgcaggtgaaatcaggagaaaaccctaagaaagtaatgcaaataataatcggacttgacatgtggaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctcctttcctccccccccctctccgctgggccggccgcaggccgaggcccagcccggcagccaggccgccccgctgcctcctctctcggggtcgccgacaggtggggctgtcacaccctgaaaattcaaaatatataaattgttgtttaaatggaatttttagaaataattttaaaagtcttgaaaagaaaatctaagtttaattaataaattccaatataaaatggggccagataaaatttcattaaatactttgcttaattctataattcctagatttttctgggatttatttgagctaagaaagtatttgtaataaatggaattgcatttaagaaataattttaattgaaaaaggttttaaaaagtcttcttttggctttgggcccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcggcgccgccgagcccccgacgctgtttccttccaatccgggccgttcctttccttttccgg

SEQ ID NO: 15009 - DNA, 801 bp, Oryza sativa
gcaagacgattgaactcgtgcagttactcggtaactgagcgagatccctgagtaagcgacctgaactccttcttctcgagagacactactcctgatggtatatgcgtcttccgaaaagcagcggtgaattcaagccaagtgataggttcagcagtaatcctattcaggcggaagtgatcccaccattcagaggcagggccatgcaactgatgtgatgcaaatgagaccttctcctgatcagtacactgaagcaaatccaacttcttctctatggcatgcagccaatcactagcttcaacaggattagtggtactagagaaaacaggcggcctcacacgaagaaattctgctaacttgttctggggaggtgcatgattatttccttggttttgctgattctgaaattgctgcatcatcatgttcataagctgtgtctgttgagcaagaacttgggccagagtgggattctctccattgttgttgttattggggttgttgggaccattcccattgctgcgagtgttcaccatctgacatggacagggcacaagaagagaaaccggggaaactacttaagatagagaattactttaacttttattgctcttaactgagtttcattattacaaactgaagactctcacaccactaaactctccaacttcctaacactcaaaaacaaacaaacgcatgcaattacatcccaccactgatgtaaatcacatgcgagccacacacaagcaaactttaagcaagcaaactaacacaacgatataagacaacgacttaacaagtcactct

SEQ ID NO: 15010 - DNA, 184 bp, Oryza sativa
aatgtctacagacagacaacaagctgcaaaaattgaacttgaaaagttgttgaaggcgaaagtcataagagaagtgatgcacccagaatggctggcaaatccagtgttagtaaagaaggcaaatggcaagtggagaatgtgcattgactttacagacctcaacaaggcatgcccaaaagatgat

SEQ ID NO: 15011 - DNA, 8978 bp, Oryza sativa
cggcgagagcgagcggcgagcggcggaaacggaagagcggagctcgagggacgattttatagcgtcggaagggagagaaggcggccggggaggaaggaaaccgaccgcggagttttcgcccgccatagatgcgccggcgacgattacgggattaaatccgagcgaatccgagggagagagagaggggaaaacgggggaaacgggagagggaatcacggggagtgattcccctctctttaatgcgtgcggggacggcgggatgcggcgcaatccgcggcggcggcggcgctagggcacgggcgcggcggcgggcgcggcgcgaggagggagatgacaggtgggccccacccgtcagcgagagtggcgggcgggcccgcctgtcagcggcgcgcgcgcgcggggaggccgatgggccgcgggagaggagagagagagggagagggaagtgggccgagccggcccaagagggaaggagggggaaaaaaagaacttcttttagggttttctttttataaaacctttttaactttgtttatttcttttcaattattatttgtgctctgaaaattccactaaaatttgtttaagcattttaggcttttaggaaatatacaaaaatcctccaagcctcatttgacttttatctttgcacattttaattgttggaggctttcacatgaattttaattattctttgcacaatttcgaggatagattttagagtcgatttgggacgcgacaaacctaccccccttaaacggaatctcgaccccgagattcggaagaactggcgaagagaccgggatgggctgccttcagctcgtcttcgcgctcccaagtagcttcttcttcggcgtggttgctccactggaccttgcaaaaacggattactcggttcctggtcctgcgctccatggtgtccaggattttcactggcctctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccacgtcgagcgatgatacggaagggacccacataccgaggtgcgagcttcccttttgtctgaatcctgtgcacacctcgcaatggcgtgacccgaagatacacaaaatcatccactgcgaattccagatcacggcgtcggttatctgcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggattgatagctgttattgtaggagaactcggcataggggagactcttatcccaagtcttcccgaaatctaggacacatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataggtggtcttcacaggaatgaatcgagctaccttggttaatcgatccactattacccatatagagtcatatccaccttgggtttttggaaggccggtgatgaaatccatcccaatttcatcccatttccattccggcacttggagaggttggagaagtccagccggtcgctggtgctctaccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggtacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaaaatccacgaccaactatgcttaggttcagggcttccatctgttgactaagctcgggcggaatgctacggacgttgagagtattgcaatggctcttccgacttagagcgtcggcaaccacgttagccttaccagggtgatagtgtattcccacatcataatccttgatgagttctaaccatctcctttgccgaagattcagatccgactgggtgaagatgtatttcaaactcttatgatcagtatatatttcacagcggttcccaatgagatagtgccgccagatttttagagcatgaaccaccgctgctaactccaagtcatgcgtagggtagttgccttcatgaggtcgtagttggcgtgaggcataggctaccacatgaccgtcctgcatgagcacgcaccccaatccttggcgcgaagcatcacagtacaccatgaaatccttacgagtatccggcaagattaacactggcgaggaaaccagcttttctttgagagtttggaacgccttctcgcattgcgggctccacacaaacttctcttcttttttcaacaactgtgtcatgggtcgagcgattttggagaagttctcgatgaatctccggtagtatcctgccaaacccaagaaactgcgaatctgagtgactgtcttgggttgcttccaatcggtgacggcggtcactgtttcggggtccacagcaactcctttagcagatatcacgtgtcccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggtcaagccgaacgacatcaccgtgaattcatacagcccgtatcgcgtggtgaatgcggtcttcggaatatcttcttcccgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctctacaaaaatcacaggagcaccccatggggaagtactcggacgtatgtaccccttttctttcaactcttccaactgtttctttacttcggccagttcatttgctgccatacggtagggtcgcttgtgcagaggagtggttcctggagcaagatctatccggaactcaatctctcgcttgggcggcataccaggtagttcttccggaaacacgtctccgaactctctgacgatggggatttctgacagacctatctgatgcagttctgaacttctgacagaggttggaggtgcaaagaaaacaaccggttgttctggtcctcggtacatagtaacagtgcgtctcgcgcaatccactactccttggaattgtgccagccaattcatcccaaggatcacatccaagttctttgtgtctagaagaatcaggtccgagggaaaaggaatcccctgaatttctatagggacggcagggctatagtactttgctgtcataacccctccaggggtggtgataagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggcgcttggccttgctgacgccttggcttcgggcatttatccgcaaagtgcccgggctcgaagcagttgaagcacagccgctgcggacctgaagcgtccctgcggccttgaacgggctgcccagctggcgtaggaggacggggcgcacgagtcccttgctgattctgctgctgttgctgctgtgggacgcgcaccacggattgaggtcgaggcgcggagcgaggttgctgctgctgctgttgctgctgcgaggaggatccccctgggtagggattggtgtagcggaccctctggttagcaccctgctgattgcggaagttcgccaagcggcgcttgtgcgattccagctccttgtgcttggcttccaagcggatgctcttgtccaccagacgttggaagtccgggtagtctccagagactagacgaacagacagctcagggtccattcctgccaagaacttctcttgcttctcctcatcttcccgcacatcctccggggcataacgtgctagattgttgaactcatgcaaatactccatcacggagcggttgccttgcttcaactcccggaattccctcttcttgagagccacgactccggcgggcacatgggttctccggaaagcggcggtgaagcgagcccaagtaatcggctgcccctcgggctgcgtagcctggaagtggtcccaccatagagatgcgggcccctgcagctggtgggcggcgaagatgactttctcttcgtcactgcactgcaccgtgtctagcttcttccccacggcatgcaaccaatccaaagcatccacggggttgttggagctggagaaggtaggtgggcggatgcggaggaactcggcgagtttagagtgttggggaggtggtggtggagcattctgttgtggcaggttttggaggtggtggaggaaagcggtcatcatgttggcttgctgggcgaggatttgggtgagaatggcgttggtgtctggtggtggtggtggaggtggattgccttggtggttggggttgctgccctcgggttggttgccttcaccggtgttaacatttctcctggtcgtcaccatctgaaaaccccacacagaaccagcaagcagagaaagagagctgacgattaaaactaaccacccacgactactattattcttaaatttatcactgctattaaattggttcattaaagttcaagttgcttaggcaaattaaaaataagacaggctccgacatagttacaccacacaccggcgtaaccatgccccacacgactcaacaagaagataaacgagaaagaacacacgcgcaggcctactaactgctcgtctaacgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacggacaagctcgggcctggaggtgctcttgcgggcggtgatcttctggctgcggcagacgcggcgacgcttgggacggctgtcctctccctgggcgatcttgagctggtgcagctgcgcctccactgcgtcgaggtccttcttgagctgcaggttctcctgacgcagctccaggatcttcaggttgttctccaccatgccacgacgcaccatctgatggaagtcgatacgagccgcgtcgtacgcctccaccatgcgtgccaggtgcacgacggtagcgtcatcctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggagtccccacccgctgtgactgccagcgaaatccgctcgggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgtccaaaccacgacgggtaacgctgccggccatctacaaacaaaaacaaaagaaaagcaacatttaaaagatcagattttgacgataaatgaagcagcaagacaaagagagaatagcgggttttcacaaataataaaggatttttatttttttggaaaatatagccaaggcttgggatctacggctcgtcctagggtcaagggaggctctgataccaacttgtcacgaccggaaatcacccaacaggcgttcctgacgtgcgtgcattattccttgtcccaggaggcaaggtacaccaaaagttgatacaattcagagtttaacaagcggaagcgtatataaaattattacacgggcagcgaaggcccaacacacaaagacaaacgagaaacagcggaagactagggcgacgaccacaggcgcttgacggcaggcacgagctagacaccaaagccttcatcttcaaggaactcctcatctgggcttgggaaaattaagcaagactgagtacaaccaccgtactcaacaagacacacccacaaatgcaaaataaatgcaagggagtacaagggaattataacataaagggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctcgtcctaagccaacccaggccaaccattccatattttagttgttaagcaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccacgcaccccgagcccagcctaaaaccattttaggggattttgaatagagggggcggtgtgaagccaattccacaataaaccaacaattccagagtatccaagtgatatgaatatttcccaaagtctaaagttgtaaaaccacctaaggttacctaattagattgcgaagcatctacctaaaatttatactagggataccatgagtagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttatatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggtggagcggcgcccgagagagaggagggaagggggaaggcgaacggcggtcttcggctcaccccggaacaacgacgatgacgagaacggcggccggagcggaggaagacggcggcgcgggtcgggatgacgatgacgacggtgctccggcggtcggcgggcgaagcggagcggcggacggggtcggcaaccactcggcgaagcggacggaggtgtcgccgagtaaggaggaagttcggagcggcggcggcggcggaacggagctcggcggcgatggcggagagagcggagcacggcgcgagcacgaatccgacggcgagagcgagcggcgagcggaggaaacggaagagcggagctcgagggggatttta

SEQ ID NO: 15012 - DNA, 13296 bp, Oryza sativa
tttcgaggatagattttagagtcgatttgggacgcgacacagtgccatctgcagattggcctggtagctgttgttgtaagagaattccgcatatggcaagcgtttgtcccaagctccatcataatcaagagcgcaagctctcaacatatcctccaagaattgatggactcgctcggtctgaccatcagtttgcgggtgataggccgtgctgaagtttaaacgggtccccaattcttcctgcagtttctgccaaaactttgaggtgaactgactacctcggtcggatagtatcttcatgggtaccccatgcaaacacatgatccttgcgaggtacaattctgccaatctctttcccgtataggtggtatgtactagtataaagtgagcaaccttagtgagtcgatccacgactacccagattgaatcgtgacccgatgatgtccggggcagtcctgttataaagtccattccaatctccttccatttccattccgggatttgaagaggttggagtaaacctgctggtctttggtgctctgctttcactcgttggcaaacatcgcagagtgcgacgaattcagctatttctctcctcatgctgacccaccaaaacctttctttgaggtcttgatacattttagtgctgcctggatgaatggagtactgggtctgatgagcctcggtgagtatcagatccttcagttccttgtcgtcaggtacacacaatctttctcccatccagattgtgccatgctcatcctcaaagaaatcccgagcctttccgactctcatgttctttttcagctctgctatttccggatcatttacttgagcggctctaacttgatccacgagcgtaggccgtgcctccagagcggctacgaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctgccctcttgcattaggacacatccaagtccgtgacgggatgcatcgcaatagacctggaagtctttcatctggtcgggcaggatcaaaaccggtgcggatactaatttcttcttgagctcctcaaagctcttatcgcactcagctgtccatttaaacttctcatccttcttaagcaactgagtcatgggtcgggcgatcctggagaaattttcgatgaatcggcggtaataacccgcaagtccaaggaaacttcgaatctgcgacacggtcttaggtggggtccatttggtaactgactccacgttcgatggatcaactgccacaccctgagctgtaatgacatggcccagaaatttgacttccgtcaaccagaagtcacacttgctgaacttggcgtatagctggtgctccttcaacttttcgagtaccagacggagatgttgctcatgttcttcctcggattttgagtagataagtatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctctttccggattcttcaactggtggtagcctgatcgcaggtctatcttagaaaacactttagttcctttcagttgatcaaataaatcgtcgattcgcgggaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaattttctcaagttcttctctacggtgtccactgggatttccgtctcaatctgattcaacgagacccctttctttggcgagactagagatttgtacaccacggtttctcccttctcgttggtcaaggtgactgtgcgactcgcacaatcgatgactcccttaaacttggtcagccaatccatcccaagaatgacatctaggtctttggattcgagaagaatgaggttggctagaaatggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgtgttgcaccagaatcaaaaagtactgttgcagggattgagttaacagggaacgtacccagtacgacctccggtgctgtttgtgcctcctgcgcagatgcgtggttgacacgagcctggataaaccttggcccggcacgcctgggcttcgggcatttgtcagcgaagtggccaagctcgccacagttgaagcaggaccctggttttgctccagtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctattgccctgatggagtgcacgaaattccctcttcttttgtgccacgaccccatctggcacctgtgccttcctgaagctacggcagaactctgcccatgtgacttcagtacccggtgggcgggtggccatgtggttgtcccaccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctgacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcgctgttggggtgcacaccatcagtgcgctcttcgccgttgctgccctcgcctgtcgcgcgactgccagtcctggtgtagaccatctggagggaaaagcagacgggggaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagctgctgctggaggtgggttcctgggcgcaagctggatgcgcacaggtgcagtcgtcgtcttgcggggcgtggtgcggatccggactccttctggcgctggaagaccctttagctgagcgttctccttcttcaggcgcgctatctcgtccttcagagcgacgatcctcatgagcttcccatcgttcaaagccttggtcgccttgtgcaagtccgagtgcatcctgtccaatcccctcatcacagcacacatgtgaccaaaggtggtgtcgttctcgccagctgtcggacggaaggagctgacgccatcaccgttggctcgacgggggtggtagcggtacgccgtgtcgtggaagatgtagttgtggcgctcccgtagtctggccatcatcaagtaggctgcctcctgacaggcgtgatctgctgtgcctccagatgcctcgaccgccatgttagcgaggcaagtccccacgtagccatggacctccaagcggacacggtgaggaagctcgccactaagcagcggaatcgtcgtgtactccggcgcattggggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagacccaaataagggaaacgaacaagagcgaaatttttatgcatagatcattttgcatgagagcgaataaacaagacagacccacataacgataaaataatgagaaattagatacatactaataataacgataagagcataaacaccttgcaactcatattcctgagctaggacctaatgcatttcacccatcaaaccccaactgactgacgaataaatcccaataattttactaaaaccctagactgacttgttttgaaaaaaccccgcttaaacgagcgaccaagattttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaatagaggtatgatgcagggaatcatcaaagaagagctaaagtggttcatttgcataaagcgagcatttataaatagagattgaaggatttaaacagttgtaaaaattaagcagtattaatcatccactgtccaacgctacaccacgttgcaacaggcccaaccaaccacctataccatccaaattcattagactaaactaatgtgattctaatcacggtgaatctggttgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgcataaccccctttagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactaaaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattaccattagaactaacagtctaaacattaatatgattttccccattgtgatctagttgaactaagcaaggctaagcaattcctagtccaaactctaatcatgttataacccaagctaacaaaggagcatggtatccaaaaagcatggctgtaacaataggtaaccatcccatagtaatattataaaacaatacaatatttgaaaggaaacaatagagcattggcaatataggatcaacatgttcaagtgacaagcatgacttgccttgctctgctgctgggggaacctcggcgactatctcgaagtacaccggagcgtcggagggatcggaatctagcggcatacaaagcaaacattgcaaacaggctataagactactgaaacagagaacaaaaccatttttaatggattctacacatttttcttgatttactgagacttgagtgggattaaacggagctcggatgaattagttatgaattttagaagattcactgtgtttattactataacaaaaatccttaaataatttatggcgcaatattaaccagggctgacgtcagcacagggggggagtgcggcgccgacatgcggggcccactggtcagcgactcaagggtgagcggttcaccgtggaccgggaccacgcgggtggtccatcgccggtccacgggaccgacggcccagatcgccctcgggccgatcggacggcggcggtggaggcagccgccgggctcggctcggcatcaaagccgaccggccgacccggggctgacggcggcggcacgcgcacgtcgcgttgccggcgacggcatccggcggcggaggcgacggcgcaaaagcgacgcgaaagcggcggcagtggacggcggcaacgaccaaaggcgacggcaagcgcggcggcggcgacgcacggagaatcgaggaagtaaaggaaaggggaaggagtcccccccgaaggggacgacggcgtccggcgacgaggagcgacggagggaagtcgacacgcggcggacggcgaccgggacgacctaaagaacgaaacgaaagggattagagaggaagagaggggccataggaggcggggatgccggccgaaggcggcggacatggcgaccctcaccgtcgcacgacgggaacggctctccggcgacggacctcgacgaaagaggggtggacgggatggatctcggccacgcgaacccgacggcggcgacggcgcggtgcggcggcgagcctagcggcggctagcggcgaccggagtagcggaagcggcggcggcgggtggttgcacggcgcgggagcaatggggagctcgggaggggtcggcgaaatggggaaaaagtgagagaggacgacggcgatgcttaaatagggggagagggaaccggacgtggccgggagaggcgggaatcgccggccgacgcgggggagtggggaggagagagaggcgggattcgattttcgaatcccggccatctcgggcgcgggcgcgagcgggagagagaggggaatgggcgcgggagattcggcgcacgcgcgggcgtggtcgacgtggcccgggggaggcggagacgtgggcgcggcgatggttgcgggcgcggcggcgcgccgggatcggcgggaggagggagacgggcccgacaggtgggcccctgtcacgcccggaatttctatccaaaattccaaacgcttacatgtgtgtgaacccttgtccaggaatcagccgaggcacacaataacaaattgataatagagtacaaatattactctaattaataagcgaataaaatgtcattacagaggtagatagttcctctcaatcaataaaaatctaagcagcggaaaaaaaaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctctgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagttatcccataaatgtactaatgtttctaagcatggctaagcaattatatctagtatctagttggaccaatataaataaagctcaactagtcaaattataataacctaaggtatcaaggaataaggtaatcaagtacgaaagggccataacaaaggataggtcaattccacccaatgacattcgaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgactaaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgactcaataatgaattatttttgaaaaggaaaaggggatttattgcgtcagcgggctagggtttggtggaccgggcgcacgggcggcggttcacgcgaacggacggccgagatctaaccgatccaagatggacggccgagatcgatcgggtccacagcggctcacggcggacgaccccgatgacgtcagcaatgacgtcaccgacagcggcggcggctcggcggagcggacggcgcacgctcgccggcgaacggcggcgcgagaacgcaaacggaaggcaccgggacgaagcgggcggcacggcgaactcaccgacgaccaaaacgacggcggagaagcaacggacggcgccggcgacgaggaggaaacggcggagttcttcggcttgacgacggcgatgatgctccggcggtctccgacgatggcgaagcggcggacgaggacggcgacgacttggcgaccacgatgacgtccttcccgagcgacggcgacggctgaaacgacggcggcacacggctggagcggcggcggcgacggcaaagctagggcacacggcgctagagctcttccggcgacgagaagcgaaggcgagggtggcggcgagaagagaagactccgggggtccttttaaaggggctcggaggcggcggcgaaggcccacggcgacggcaacggcgaaggaaactcgcggcttggagagaggaaagccgatccgattcgaactcgaatcaaactcattccaaaccgattgagccaaagattccaaaggagaaaaggtagaggagatcccggagattgtttcccctctaacaaatcggccggagaaggaaaggaacggccggattggaaggaaacagcggcggcggctcggcggcgccgcgctagggtttcggcccgaggaagacgacggctccgacaggcgggacccacctgtcagcgacagcgagggcgcgcgcgcgcggctgactgggccggctgggccgaggagagagaagagaggttttgggccgactttcggcccaaagccaaaagaagactttttaaaacctttttcaattaaaattatttcttaaatgcaattccatttattacaaatactttcttagctcaaataaatcccagaaaaatctaggaattatagaattaagcaaagtatttaatgaaattttatctggccccattttatattggaatttattaattaaacttagattttcttttcaagacttttaaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccactggactttgcaaaaacggataactcgattcctggttcttctctcacttgtttccaggatacggattggtttttcaacataggtcagatcctcttggacttctatctggtcaagattagcttcttcggtaggtacccttaaacactttttcaattgcgaaacatggaacacattatggactcctgccaaagattgaggtaactccaactgataagcgacctctcctcttctactgacaatcttataaggtcccacaaaacgcggtgccaattttcccttggtatgaaaacgatgaactcctcgaaaaggcgtgacacgaagatacacataatctccttcttcaaaactcaaatccctacggcgattgtcggcataactcttatgacgagactgagccacacgcaatctttcttgaatgatctttaccttttcttctgcttcccttaggatatccatcccgaaaacctgacgttctcccgtttgatcccacaaaagtggagtgcgacacttccgaccatacagtgcttcgtaaggagccatctgaagactagcttgataactgttgttgtatgaaaattctgcataaggtagattcttatcccaacttccaccgaaatctagagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagaatcatggcctgatgacgttctgggtaaaccagtgataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcatgagcttctttcagaattgcatctttcaaatctttgttgtcagggacacaaattctttcacccaaccatacagttccttgctcatcctccaagaaaccaatagcttttcctcttctcatattcttcttgatctcttaaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttttgtagcattgcaatagccttttctgctaagagcgtctgctacaacattagcctttcccggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcacgggcggcggttcacgcgaacggacggccgagatctaaccgatccaagatggacggccgagatcgatcgggtccacagcggctcacggcggacgaccccgatgacgtcagcaatgacgtcaccgacagcggcggcggctccgcggagcggacggcgcacgctcgccggcgaacggcggcgcgagaacgca

SEQ ID NO: 15013 - DNA, 859 bp, Oryza sativa
gagcttctttcagaattgcatctttcaaatctttgttgtcagggacacaaattctttcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttttgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtatatacctctgtacgagtaccgaaaagataatgacgccaaatcttcaacgcatgaactactgcagctaactcaagatcatgagtagggtagttcttttcatgcggacgtaactgtcgagatgcataggcaaccaccttcccatcttgcatcagaacacaacctaacccaagtttggatgcatcgcaatacacttggaaacccttctttggatcaggcaaagtcaaaataggagctgatactaagcgattcttcaactcttgaaaactctgctcacattcttccgaccacttgtacttcatatctttctgaagcagtcgtgtcatgggcttagcaatcttgaaaaaattctctataaaccttcgaacaacccatacctagtggtaaaagctgtcttaggtatatcctcc

SEQ ID NO: 15014 - DNA, 4874 bp, Oryza sativa
gccataatactactgcggtagatccaagcctacttgtgaattatcatatagtaataaggctgttcttgctaatgtttacaaggaaccatgtacaggactatgcacacaaatacattaagctgattgagttacattggcaatttatattcaggtaccaacatagatgtcatggtggatgcactagttactctagggtgttacaaatgaatggcagcatctttatatccatttataggtgtatcattttgacatattaatttggtactatatgatcagattcaacacagaaattctcaacgcgactgaatttggtgatcagagtgtaactcaatgtccagaagtttttgaggaaaaacgaagtgaacaagcatcaagtatgtcaattcgcaaaacaattttgttttatttttgtctattagtattgacaagatatagttttttaatcaatcagtcagaagcctgaacctggatcaactagttgttaatgatattggaaaaggagcagtgttgactttttcacagatattggctgctacaaacaatttttcagggagatccttaattggacaaggtggatttgggcctgtttacaaggtactccgtagttctcttcaaaagtaaaccttaggagttaggatgaagaaaatcctgaacttttgaagaaatagtaatattagaattctaaatttgcagttcttacactcgctggatcaaatgaaaaatttttcagccaataattttaatctcacccacataactaatctttctataatatttttttccataacagcagtacataaataatgcggataggatattttgaaaaatttcagctcctcccatgatcttgctttagaacatgttgtcatgtcagcttcttgtaacatgtataacatccaggaatgctttttatggcattatctagaaaatctatgaatgctttgaatatgcgcatatctgaatattttgatttacaatgcttagatgtgctttattaatctgaatttaaactttctcagggaaaacttcccaatggacttgagattgctgtcaaaaggcatgatacttcttcacatcaaggtgaagaagagttcatggctgagattgacgtcataccaaaacttcgacgaaaaaatataattgagctgattgggttttgtgttcaaggcaaagaatgtattcttgtctatgaatacattccaaatggaagtttggcttctaccattagcggcaagttttctattttgactaagaccaatgcctccatttttttttctctaaatgatatctggtatttttgtagatgaaacaaaaaggatattgctaaattggtctaagcgccttaaaataattgaaggaatctcagatggtcttctttacctacacaaccattctcccaagtgcattgtccatagggacataaaagcaagtaatatcctcttagattatgaaatgaatgctaagatttctgattttggtctggccataaaattagctccgaaagcaactacagaggtgcttgttcgtggcacatggtagatactctcccagtctccctatactgtaaactagttagagatgcaactctcatctttcccttgataagtgtagctacaggtgcactgctgtgacgatctactgtcatctttcaggggttatgccgatcctgaatatgttgctactggagtaatctcggagaaaaccgacgtttatagctttggcattgtactgcttgagataataagtggaaagttgtgtgtatctggatataatgtgaagagcagatctcgacgaacaatatttcctgaatttgtaagtattccataactgcacctctatttttatcaatgttctaagggtgaatggtggtatcttcttattagaaaatgtgaaaatggtactactctctggtagtgtggttgataaattccaacctgagagcgccaactgtgaatagggaaacgtggcgcggtgggatgagagggcgaggcgagaggggcgacctggctggcgacgggccgaccaccgcggctgtcacctccggcggccgctccagtgccctcaccattgacttgccgcctctcctcccttctccggcaggtatctccaagctgcgcctcccttctccagcccgggctcttaacctctctcaagttcgaccaggtgaagctttccaaaacctcatccttcatctcttccactgccctgttacccctatcgccactacccttggcccgtcaaaaatcatcccaactcctatttggctttgcgctgctccctctaagccgctcaactcgctctatgtcaaaaatgctcttaatttctggttcagttcttcgttttcgtctttctctgtttcttctttgggttttggtttgtttctttctcatgttgcgaacaaagatgtggctacctcgttgtttcttgcgggttcgtctgttcttaagtctgctggtttgtccatccatttgaccaaagattcagctgcaaaggatattcaagaaaatgttacccggttcttggttcagtttgaaggcagttcgtccgttccctctctggtgggtgaaaaagttgttcccgcgcttcaaacagttaagccagcctttactgcaacgtcacgtcatattggatgctcccaacaatccagcaagacctctaccccctctgtgccgacaggccctgcattgaagtctgtttactgccctgtaacaaactccttcagagacgctctcctctcacagccaaaacctaaaccccccgctcgctcagccacttctcgccttcctagcaggggcagaaaaaacctcaccatgctcaaccgatgctttcgctgccttggttctgatcatcaggtcaaagattgccgggatcccttgatttgcgcatcctgccgtcgagcaggtcacaggcaagattcttggcggtcatctatggcttccaacatctcccctcgccgctcatcttcctccttccacccatccacagcaaactccacctcccgcttcactacccgctgggtcaggcgtgctctaaacactccagccccacctccgcctcgcttacctactgccccataccctcgatccaaccacagctccccccctccagataacctagccattgttccttatgttcctcctctgactcatgtggatgcgcagctggaagatgtgattgccatgttggagagcagtctttgttcctctccggtcagatctgttactgctggacctctggtccccatggaggttagtgagaatgcggtcacttcttctgttgcttctcctttaccggacgtaagaaatgccctagtctgtgtgcaagatagttcaatctcagtggctgccttagttccagttcttgcatgtgctgttaatgatctagagactgtctcaactgaagtggtacctgcgactgtttccttggtgtctgttatgcctacaagagctgctgcggttgctgaagttgctcatgctactgttgagtccgttgttgttccgtcctctgtcagcgaagatctctcgccagcggtcaaccttagcagtatgccacctcgtctcagatgcaagaataaaggtttcctcgcttggtacggcgcctgtccatcttcgaggcagccaagctcggtccccccacaggaacctagggatatcttcgtctgttcggaacagttgtctgccaacccaattctgtctccacctcaggatcctgatagcacgagatcgccacctccgacattgagtggcccctcagctgctgagcaaatcagaagagctctagcaggtctaagtccagaaggatctattcactctgcttcactctctccaggtcgggtgccagtcattacttccaatgacactactgctgcgcaggactttgcttttggggaaccagatccagttaacatatcaggagacagtgacgatgatattcttgatatctttatcccctttgttgacatgagagtaactgctcattacgccactgcttatgttacccctccatgtgaatgccctggcagagtaattcgaaaagcaatgcaggatgctcaccctcgttttcagttcactctcatctcagcttgtagaggtgcaatgactctaagatttattcacagtcaggacagagactttgcagttgatcaccaggagaatcttacagctgaaggccacttggttaggcttgaacggcctgaggacagtgcggctcgcttcattcaacacaacactatgctgtccgaactagactgtattgacttcccgccagagatgttgttccctaacaagataagaaatgcttttgaaaattacggcgagctgatggaagtagatgatcaatgcctctatggggacgaacaatcctctctgcgtcttgttgttctgcactatcctggcaagaggatgagccctagatttcggctgcgctacaatttggggattgtctgcactgtctatgtcagggttctaagaacatgggagctggccatgaacgtggatgaagatggaaattacattaagcattatgaacagtttctattccctcatcagttggatcctccccgttcaggaccaactgttggaccagaggcagagttggacaacttgaatcaggctccttcaaatcaaatctctaacaaccaaggacttcagaacaggggaagattgcttgcgattctgcctgcagctagcactgtcttcattgaggaaatctctgatacacctgaaatttttgtccctccgtcaatccattctgctccctccagtatccatgactgcctccaggacctcgtgccctcagatactgaaaatgaacatgagctttcagcccggaaacgcagaaggcagaagaaacggacaattgattcagatgtcaag

SEQ ID NO: 15015 - DNA, 688 bp, Oryza sativa
tttcaaccaaacaataaactccataagcctgtttgaattaccacttccagacagactatacacctggtcgaacaaaagagaagttccagtcctggcaaggatagaccgagcttttttcaacaatgcttggaacaacaccctcccaaacacctccctctcttcttgcactagaaccacctctgaccatgttccacttcttctcactgcttctacttccattccaaaatcgaaaactttccgctttgagaatcatcttttggtggaccgagattttcttccttcagtcatgcacaggtggccacaacagctcaatatgaatgatccggccgcttgccttgctgccaagctaaaacagacaagatctatcatcaaagtttggatgaaagaacacaggaaacgtagttctctcaatgaagactgtaagttcacaattgatctcctcgactatattgaagaactcagacctttgaatgatggggaacgctgcctaagaaatcttgtacaggagaaattgtttcaggccatccaaagcaaggttgcatactggaaacaaaggggaaaggtcaagcggctaaagattggaattgacaattcggcattcttcaaggctcatgcatcaaaaaattacaggaattcaaggatcagatcaatcaagcacaatggggcagaaattgcagatcacaatgga

SEQ ID NO: 15016 - DNA, 636 bp, Oryza sativa
tggaaattggtcaaccgtctatcactcatatgatatttgaatatttctaccctgatggatgccgacaggaagtatgcagggagagattgctgttgagaagacttctctggatttctcaaatttgtcagaattgatttcatcaaaccgaaaatcggctgggagctcaaaatttgcaaaattttcataagcaaaccatattctagagtcctttggaaatccatcatagaagttgccgaaccaatccttaaagagttcagccaataacttggatccggcgtatgtagatgctgcctctccaaaagacatacatcggcgagttgtgatctcttggccatcctcatctatgatcggctgggatcttgggaattcagccttagtcagtgctggtctatcaaccaccctcgtggtatgcaaattcaaccaagtctgtaacaaccaccatgggccaccagtattgatagcagagcctgaagcaattcttgctgatgccaaatttagggtctggtacagatatcctagcaagaatttacccaaaggaaattgtttcttctcttcaagggcttcgactacatgttgccagtttgtggtgggaccatagcttgggccacaaaacagaaatttttctgaccacattag

SEQ ID NO: 15017 - DNA, 1473 bp, Oryza sativa
atgagaaagatgctacaatagaaagaagaaaaagggaaaattacgaaggagaaaaaccaatctaccgcaaggagaagagatttttgccaagggaaagagaggggattggaggaagaataaataccaaacccagacattatactcttattagaatctcaggtacaccgttttgcaagttgagggactcatcatatttggtattgcagttcgaggatgagattcgaactcggcgatgatctaaactgaacttgttccaatttaaaaagttgtatacactttctgggccttacaaagtagacgggccagagtcacaccagcgtcagcgggcgaggcccaataagccccgtggcaaacaacgccacgtcactgcctgacactgtccaccacactaatgtgaacttattccatttaaatttcgttgtggatcagacatttggtgggccttattcggattccagcccagcaaatgatgggccccgcagtggattgactggggcccaaacatcatcgcctcttgccgtcgtctcgtcttttcctctgcggctgaactagtcgctgatccaaggccgtcgtccactcgccatcccaccggccaccgcctccgccgcctctcaccggcgccaccgcctcttaccagcgtcaccgctgctctgcctccaccgccttcttcctctccacaagccccggtcgcccagtacgcatcccacccgtcgcagtcgacctagctgcctggtggaggtggaggcgagggggattgactcggctccggtgctccgattgagcccgcaggcgaccgatctggagacggtccgctccgcttctcgccggaggctgtcacgaacccaggtaacatccccgccctaacctctgctgcttgcgctatgttcgatcgattagaagtttagaacacacgcagaactcaggccacatcgaatcgatcgctgttcacgagatgtgctaattaattccatcggatttttatgggactgcagccaatttagactaggaagcatgaggaggcgaccgggaatcgcgggtttacagaacgcggcggctactcgcgtatgtggacatcatcttgcttggatagcttataatgttttttcttttcctgtggatcctgagatgagtgtgctcttggaaaatttaaggaccaattccggctggttggggaaaatgtggccaaggtcaggaccgatgtaatgaaggagcagcttgccacatttcggacacaactcgaagaatttgcactcaagcataaggtgattcttactcctgtattctagttgagtttgacagaaaatcttatcgtcgctattcgtatgtcccaaattgaattacacatagtgttgtgaccttaggtcacgaacaagatcagggataggccggaaagaagtgttttcccgcctatccttagaaacgagctcgaacagtgaacacaacttttcaggattacttttgtattcaagatgt

SEQ ID NO: 15018 - DNA, 1061 bp, Oryza sativa
ccttctcctctcaacattgtttatcccaactcttttctttcttctttgtagagtttgtgtgtaacttgttataccttcttaacatcaaataaacccttcctttcttcttttctttataaacgctctttatttcaattgttcaagcacccttaggtaaactacgtcctccttatctttggaagaagttacgaaatcgaaacgtactttatctcgtcacgtgcattttccgccttttgagctcgagcgaagggaaaatagagttcgagcattctttagttggtttttttggactaaggcaaaatagttcgaaaaccaccgtcctcctcacctttcgaaggagtgacgaggtcgaaacgtattttacctcgtcacgcggattctccgctttttgagctcgaacgagaatagagttcgagcattctttagttggttttttggactaaggcaaaatagttcgaaaaccgccgtcctcctcacctttcgaaggagtgacgaggtcgaaacgtattttacctcgtcacgcggattctccgctttttgagctcgaacgagaatagagttcgagcattctttagttggttttttggactaaggcaaaatagttcaaaaaccgccgtcctcctcacctttcgaaggagtgacgaggtcgaaacgtattttacctcgtcacgcggattctccgctttttgagctcgaacaagaatagagttcgagcattcctgagctcgttttagggctaaggcaaagtagttcgaaaaccgccgtcctcctcacctttcgaagaagtgacgaggtcgaaatttgctagtcgaaagtatctgactcctagcgtgaggagttatattttgtggactttgatagtcgaatgtatttgactccgagcgtgcggagttctattttgtggactttgtcagtagaatgtatttgactcagagcgtgcggagttctattttgtggactttgctagtggagagtatttaactccgagcgtgggcagttctattttgtcgaactttgctagtggagactatttgactccgagcgtgcggagttctattttg

SEQ ID NO: 15019 - DNA, 286 bp, Oryza sativa
caaaatgagtggtgataggagaactagctaactaggatcatcttcttcattatacagttccaagagatgatcaccacctacatggcgatctagagtctagacacaccatttcatgtacaaacaaagctgggatccatggctgaactagtagggtacgcctccagcgcgaggggactgatcaagatgatcatggccaccgtgcagacggcgaagcggaacaagaagcagtgccgggagctggaggagcgcgtcaggatggtctccgccgtgctgagccgccaccgcc

SEQ ID NO: 15020 - DNA, 368 bp, Oryza sativa
attcctctccatccgctgatgttgttttgccatcaccaatgttcaaaatccattgtgcgaaatctgcagtccttttttgctcatcttcatctcttgagatgcagctcaggcgcatgttccttgtaagttttaagatgtggaagtgctgccataggtaggaccgttttattgatgcatttactatttgcgtgcgtcttccctttcgcacaacaggaagaatctggcggaagtctcctcctagaaccacagtcataccgccgaatggctttgtgctgttatcttcacccttggaccgtagtatgtcccttagacttctgtctagcgcctcgaagcaaattctgtttgccattggagcctcgtcccacagt

SEQ ID NO: 15021 - DNA, 14079 bp, Oryza sativa
  unsure (1)..(14079): unsure at all n locations
ggggtgtccagtgtgaattttggacctctacacaaattacgaaaaatattatttttttaacaaaaaatttagggactgaagtataaaaattaaagtcacttctaaagccacttacactgtgacactgtgaaggattaagattttagaccagtgatcttaatttatgtggcactctgagctcctcaaatgagagggacgcatgaatggccttagcaaccaaccaatcctccgccaccaaactcccctacctacccacagccgtcaactcttcaacggcgactcccctatataacacgcacagtcgcgtcgcgtcgcgtcgctcctccagcaacaacgaaccaacggctgagagtagagtacgtgaagttaagtgaagtgaagagacgctttgcattgcagttgccaccgcttcccacgcggccgtcgtcgtcgccatggacctcctcttcgtggagaggctcctcgtcggcctcctcgcagccgccgtggtcgcgatcgccgtgtccaagctccgcggacggaagctccgcctgccacccggccccaccccggtgcccgtcttcggcaactggctgcaggtcggcgacgacctcaaccaccgcaacctggcggcgctggcgcggaggttcggcgacatcttcctcctccggatggggcagcgcaacctggtggtggtctcctcgccgccgctggcgcgggaggtgctccacacgcagggggtggagttcgggtcgcgcacccgcaacgtggtgttcgacatcttcaccggcaaggggcaggacatggtgttcaccgtgtacggcgaccactggcgaaagatgcggcggatcatgacggtgccgttcttcaccggcaaggtggtgcagcggcaccgcgccgggtggtaggccaagaccacggccgtggtggacggcctccgcgccgaccccgccgccgccgcctgcagctcatgatgtacagcaacgtgtgccgcatcatgttcgaccaccggttcgagagctcggacgacccgctgttcctccgcctcaaggcgctcaacggcgagcgcagccgcctcgcgcagagcttcgagtacaactacggcgacttcatccccatcctccgccccttcctccgcggctacctcaggatctgcgaggaggtcaaggagacccgcctcaagctcttcaaggacttcttcctcgaggagaggaagtgagtactcctccatgagcgagactccatcaattagccaccagaaatcctctgctcacgtcgcatggtgggtgtttctttcttgtgtgtgtgcaggaagctagcgagcaccaaggccatggacaacaatgggctcaaatgcgccattgatcacatcctggaggcgcagcagaagggggagatcaacgaggacaacgtgctctacattgtcgagaacatcaatgttgccggtacgcgtgcctcggttcagttaacagtttcttcttcttctttttaatttattttcgttaaccatgttgcttgcagcgatcgagacgacgctgtggtcgatggagtgggcgatcgcggagctagggtgaaccacggggagatccaggagaagctgcgccgggagctggacacggtgctcggcccggggcgtcagatcacggagccggacacgcacaggctcccctacctgcaggccgtggtcaaggagacgctccggctgcgcatggccatcccgctgctggtgccgcacatgaacctccgcgacgccgagctcgccgggtacggcatccccgccgagagcaaggtgctcgtcaacgcgtggtacctcgccaacgaccccggcgggtggcggcgnccgnagnagttccgtccgganaggttcctcgagaagaagaggaacgtcgaggccacggcaacgactttcaggtacctgccgtccggcgccggcgacggagctgccccggcatggtcctcgcgctgcccatcctcggcgtcaccatcggccgcctcgtccagaacttcgagctgctgccgccgcccgggaaggacagggtcgacaccaccgagaagggtgggcagttcagcctccacatcttgaagcactccaccattgtcgccaagccgagagcgttctagagtgcacactaactagacagtgaactgcatcgtcttctctgttcctctagaagtatcaaccccattgtttggtttactcgtcgaataagccaaacgatatatatatttgtaaactagaactaatttgtgaataaaatttttatatatatgttattggtgatctaaaagcaaaggctgaaaaataaacttcgataaaaaaaaccctaaaatcgacttcaaatttaaggttgaaaatttaatttttgagtgataaacataaacataaacataagtgaaaagattattgcatcgctagttctctacagaagttccattatcatgtttcatgtataaatcttaccaccatcatcgtcatgtgcttaatgccgggctaaattcttgaaatgatcgtcagtcagaaactttgaaatggccaaactgaaaaatggtactcgtagaatttcttccgcataaaacacctaactcactactgtaatattttgtttcaattagtacattccccaacgttgtaatgggggataaaacgttggatccgctggttacgtacgtacgctacgtgtgtggacgcgcgatgggtgaaagtgactgaaggaggatgaccccgtttttaaattactagaatttccttctgtcttggaattcaaatttccacggtccgcaacactggtttttttttcagattctagcaaagcaactgtggttgtgggcagtctgctttggttgtgatgtttcagtttctgctaaaccacttcttctcttctggttaccctgacttctaaaatgcttgtgatatgtactagttgctacatagaattttcatcgatgcctgaccacatctgttaatcatcacatttcactggccaaatacccgtgctttgctacatattaaaacaaattaatactgaggtttttgggataattttgtacctatggatgttatactgtacatctgaaatatgatagaatatatatttacacggattattttataacattaaagtacatatgtaattggtactttctccgtctctaaatataagagattttgggtagatgtgacatatcctaatactacgaatctgcacatgtattcaaaatcccttatatttagggacaaagggagtagataacatgatggagcatgtggtaaataaaaaaaaagtaaatttcagaaaactgcaactttagtgataaaactatcaatttgttgcaacattagcgacatgtttcagtttgctacaacaatagcgtgtgaaattatcacaaactgtaacttttatgttatatgatgctacagtacaaataggtgacaactgaagcatcatatagatattataatgtacaaatattgaatatgtaaatacctgtgcacttctgatgtatttttaaaccacttattctaagttattttcagtttatttttcaaaatatttaattatcactgtaatgaacgcagttaatccgatcataaatcaatctctagcatggtccgatcaaaagtttagaccttactaaatttttagataacaaaccaaacataatctaaacattataaccataccacaatatgataactctcgggaaaaaatatttattaaaaagtttaccaaaatgtagtaaggtctcaataaaaatgtatatcaaccttccctagtcctttagtattatcaaattttagcaagttttatttgccataaactaaacatgcccaataatttatcaagacaaattgagttttctagtaaaattgtacttttaccaagctcaagagggggagaaggttacattgcaaattgcagtacacacaaacacatacttgaatgtttgacgtttaggataagattcaatcaaaattttaaattttgataatttcttgaatgttcaaatgttcaggaaaaaaagaaataatatatgtggatttgcttcaaactgtaccatatcataatatcataaatctgtatgttagaaatttaaaggtttaatcacatgttttttttctagacattaaatatttctgacaaaaaatactccacgataagtaatcgagagtggcagggacctaagagcaaaggaaatagtggactaaaagtcaattataaaattattatatgaaggagagagataaaggaaaatattgagtgtgggctctcaatgcaagatatgctgtaaaataaaatgcattaaattcatggtgagagaaaagaaaaaggagaaaaatgaaactaaccttataaataacttattatacatgttagctctaatgtgaagttatagttagtgttagctctagtattaaacttgctctaaacaaggttttccctaactcttgcactacctttggtatgcagtagcactgggatagaaaagtttccaatttaataagggcctcagactcagagaccttcatatgcaccctgcacagcaagtttctttgatcaattttttacatcagggtgcctctatatgtgatacacacgtgcatggtaaagtgcaaactttgcaatttgacatgtcaaaacacccacacataatcacttctttgcatgcatgagctgccagcctgtccgtccaataatcatcagaggtaaaataaaatcatcagccaacaaagggcaaaaacgcaaattatttttctccccccgtcttcctcgcctttcctgcaggtaggccccccccaccgagccctttgttacctccccccttttctccgcttcaccagacgcctcttcttgcccgccgggatctacctcggccccgcgtcggcgggcggaacccaccgccgaccgcgcggggagaagccgatctaaaaaaccgaaggggggactcgcgccggaataatcctaggccacaatgttcaagttcctcaagacggtggtcgcgggatccggatcgggcctcaaggacttcccctacaccatcggcgagccctacgcctccgcgtggggctcgtggacgcaccaccgcggcacctccaaggtacgctctcctcccttcccctcaccgctcgatcgggggcgcggatcgatttgatagatccccatgagatggggcggcggagatatgcgagagcgtgccgctgattcggttcggtggtggtaagctagtgagtgatccgggtcaagctaagtttgagttggagctgatcgtgcgctgattctaacggcgagtctgagtgggtgctccctgggtacggtttggagctcgtgttaggtcgatattagcttgagtaatacctcaggaagtagaattggtgggctcagtgctgagtttatttgaggctgatctggtttaagggagcctgtgatttctgccagattactgggagttcgtcattgctcactgcacagttgcatgccatctggtaatagtgaggaccttactgatgtcagcacttagtcattagatttttttttttggctgtggaattagattattcgtgaggtttccttcatggttagtgatgttattgatttcagttggtggtaattgagcatccaaataaaagttatttttgatgttgttgcattgggatgctggagattgtgtcaggttttatcttttgttgactagtgggggcatgccttgtgcatgcgtgttctgcaaatggtgctgtagattagcacactctgatgatatatgtgacattggaggcctcatactgatgcttatgtcgattggagatcatggctcattcaactagggatgatcagatgtctaattatgcctaatgtacctgtgtttgggtggctgttaatggactaaaagaccaataatccatttctttttggcagttatggatgacctttcagggtgcaatgatctaagtcaagatggattgtatgtaacttatagtggcctttgtgtagttcaatatagagatgtgtagaacattcatgcgtcaattttaccacccagatggttgtgatgtgatgttgatcaaaattaggaggtctgttaagtgtgttatctggttccatttctttttcgcaagctttgatttatttgcgcagcatactcttttcccccaaatgattacatattgcattaattttacaacatatgtatatgatgctatcaacataattgttgccttgtcttttctgcaggatgatgggtcgcccgtgtcaatcttttctctgtcagggagcaatcctcaggacaggcacttggttgctggtcggaatggtgttaagagattacgaacagtaagttactaatgttgatcttaaatatttgtaatgtctacttgtactgcaagtgtcttattttaacagatgagaatggagtctatggtgatatactattgagttctagaagggtacaacaaaaacaaggaaaaaaatctgcacagagaagattcaataatggtggcattatatcatgccatattggcatttttttaaaaccaaaggccctttgacccagctttataagaaagccaaaaggttcttgcaacaatagattttggtttttgctgggatttccagcttacattaaagagtaggcaggaaattccatctgggcattagccattaggtacgaggttatgcatgccggtccacttttttggcatctcgcattaaattttctcagtgacttgcttctagtggacatctttacttaaatatcactttgtagtgcaattgagttttgcttttgtcatcggtttcattggacttctttactctcaatatgacacctgctaagttagttcagtgttattgacctgctgcacttattgcaggtgcgtcatccaaacattttatcctttcttcacagtactgaagcagaagttcctgatggacctgccatgaagcatacaatttatattgtaacagagcctgttacgccactttcagaaaagcttaaggaactgaacctgggaggcacacagaggtattatgagcttcccctatcctttggtgtttaacattatgacatatatatttgtgcagatatggagtacggttgctgcttaatttagtgtgagcaatatgttttttttgcttaatagtctagaactattggggctaatcaattctagtgcactagtcttgtcagagttgccagtttgcatgtttactgcaccatattgccagtagctatttctcgagagcaaaatttcatattgctcagtttttgtttacaatcatatttattctcactattgctgataaattatgggccagagatgagtactttgcttggggtcttcaccagatatcaaaagctgtgagctttctcaacaccgactgcaagcttgtaagccctccccccccctctctttttctctcacacacacacacactctctctctctctctctctctctctctcaaacggagtacaatcgcataatgcaagctgttaatgtggctactacttatctcacagaacttttcaatttccatcacaacaaaattatttctggtgggcataatttgctcatttttaaaattttaaaaatatcaatttatatttagtataagttacccttggaattagattgcacaaccaaattatcgtcaggatcttcttgtttacatgccaaattcttttttatccagatgagaaaagtatcacaatcagccagcttatactgtgtcatttcttcttgaccatttgatttcagaatttgtacttgtataactttgttgatatgatgttttactcttattttgttaatggcggataatgaacaatagtcaatataaatgcatgttcttatttgtgcaaagtcatgtaatgacacacgaaaacaatgtatgttggaagttctttggtcataaaatttgaaattgtcatcatcaatttcaggttcacgggaatgtatgcgtgacgagcgtagttgttactcaaactctagattggaagcttcatgcttttgatgttctttctgaatttgatgctaacaacgaagcctctaatagccccatgttggtatggtctcttaatcacagtcccgcacctttatatatagatatagaactattacaactctcttttggacatgtttggtgaatgtactgaaacaaatgcttttacaccgtgcttgtcatgttatcgtatgtcgagtttccattgtttctagaaagtaagaattggtactctttaatatcagggaaattcaacatgatagagggagatatataccatacttctttttacatacttatgttcctttgcagcaatttgaatggttagttggaacacaatataagccaatggagctaacaaagtcagattgggtgtcaattaggaaatcacctccatgggcaattgattcctggggactgggtaagcagagctaactccttttccttcattacattcttgtttgattgttctgtttccataattttacaattcggaaactgttcaacagttccttgtcggatgtgcactcggcattattgtactttaattgcaaaagttgtttattttctttaaatggatatctctctatgggcctgtatcgtagtttcaaatctttttatggtaaatactataaagttttgcactatagaccaggtcaagatcgaccaagaaaagacatgtctagagtcaaattaataaactatggttacctgaattcctttgttatttgcattttgcttttgtttgctttgctgcatatagactctctttaatattatttccagaatgatgaaatattgataataaatggcacccagcggaggatatatttttcgaattagagaatccattgtttgtaatcaacaagaaaaaaaatgggaaagtaagacaatctaaaggcaaaacacacagagaatagtcatatgttactaagctgaatctctttcacataatcacattcaaggagcacctgaaagtttcttatagcagtatttaacagtaaaaatggtttttagactcatctccaaaaatattgatctctggactcattgcagggtgtttaatttatgagctcttttctggtgcaaagctaaccaggacagaggaccttcggaacactgcttcaatcccaaaggttagtttgcacgatcatggtcctgaatctgtctctatttagctattgattttttttgttggtaatttttgtattgcttctccactgtttgaagtctgtaatgtagagcattatgctgactaatctatacattgttcatgcgtatcataaagttgttggtttccttctattttgctgcagtctttacttccagattaccagaggctcttgagttctgccccttctcgtagaatgaacccttctaaacttattgacaacagtggtaagttcaacatatttttctctcatcatttcaggaattactttttgtatttcgacacttattacatcgacgcccataaccttctacttttgctcttaatgctgtaattctatgtcaattatttggattactttaaataagctgcagggacaattgtggttcttcattttcagagtttttccagaacaagttagtagagaccatacagttcatggaagttcttaacttaaaggacagtgttgagaaagatagctttttccgtaaactaccgaacatagctgagcagcttcctcgtgagatagtcctgaaaaaggtaatgttcaagtcatgaatagaacccattattcccccggttcttgtttatatgcttatcggttggttactctgtcaatagttgctccctgtgctggcatctgctcttgagtttggttcagctgctgcaccagccttggttgtattgttgaagatgggttcctggcttccagctgaccaatttagtgcaaaggtttgacttcatttctttcgttttcacccaatattcgttagtcattccagtaaatgtgtgttacgatgttataacacaagttaaaaccactggcattttcaggttttgcctacaattgtgaagctttttgcctctaatgaccgagctatccgagttagccttttgcagcacatagatcagtttggggagtcattgacagctcaaactgttgatgagcaagtatgctatcatttcctgtatggacatctgcatgtgtttctggaatgttgatgcttgacaggataaatatctctaatgcaggttttcccccatgttgccactgggttctctgatacttctgcttttcttcgtgaactgaccttgaagtctatgcttgtattggcacccaaagtaagaccctcccaaccctctgcatgatcaacatttgcaccccgaacaaaatccttgtggatgtctttcatttttactgattgtgctgtgttaacagttttctttttaaaaagtgttctaaatttatctatcgctctctctggttgtgtgcacagcgggcttttaaagaaaaaaaaatcctgggattgcaaatttctgtggtattattttttcaggaagattattgcttctttatgactaattcaccaatctgttactgtagttatctcagcgtacgatttcaggatctctcttgaagtatctatctaagctccaggtgatgttctgttctaactgaaatgcctcagatggactcagtttgacatgtgaaggtatacaatttagttaaaagtaaaaaaaatcattgttatctgtgttcaggttgatgaagaacctgcgatcaggacaaacactacaattcttcttggaaatattgcaaactacatgaatgatggggtatgtcctttttattgcttttttactaattttccttgaaatttcactgtagcaagctgactttaagataggtagccagtatatctggatttctgaccagcaagtttctcaattatttaaaatccacatgttttttgtaccatttatctccatggtctgtgataaactttgttaaaaactggctggttactggagattactgatcatagtgatcctggctagtataaggccaaggaaatgcataaatgcatgatagtaaagaaagaaagacaagaggaaataataatcacctgaaaattactagaaaatatgtttttgagttttgacccaaagaaagcaacacaaatatatcctggagttctccattcccttgcctagatatcgagttcattttctgtttgtactaaataagtaaatagtcattcctaacaatgtttggctattttgacagactaagaaaagggtattgatcaacgcatttactgtccgtgcattacgtgatacctttccccctgctcgagcagctggtacattgccctgtagaagtggtctgttttactacttacaatgctatatcgtactaattattgacaagaagtattgctttaccatttgtctggcaggcatcatggcgctaagtgtcactagttcatactatgaaatgacagagattgcaactcgtattctgcctaacgttgttgtcctcacatttgatcaagataggtataacatacagcatttagctctcagtctctactttctcattgttgcttgttgtagcgagcaattaaaggctcagagatctgttagtttgatagaatagattattgtctcactaaccactagtagttatatccaagtaaaattcaaatggttggtaccctttccaacatgaatcatagcaccattgctcaatgttttgcatatgctagtagctatcagtctgatttgactttttttcttagaagcaagctttgcttattaactttctggcctaactgtcattgcacgattcattagcatatggtttccagaactaagacatctttgtgcattagatgtacccatgcacaattgatcgaaaaaatgtcctgtatggatatattataaaagttgatatggattgaaatatgaagtttaacagacaagacagttaaaactaacatgggagatttttgcattgacaatactactttctttaagttataactgtacgatgcatcttattttggtctttcaactaaggcatccaatggttttgtagtgatgtgaggaccaaggctttccaggctactgatcaattcttgcaaatagcaaaacaacatcatgaaaaggtatgcacatttagtcatacagtttatttgcttataatatatccactattctggaccgtttgttacactactggtttgctctagatggcatgctaacacaatgcatgtgtgttatgaccataatatgttggtagataacttactgtcactgtaaaatatcttttgtttttcattttcttttgctactaattgtatcataggttttagatatgccattacttttatccggttgtcatttctccactagtttagaaatgccagacgacttccaatggttttggctgttagaacaatgtcaaaagtctgaaaaaatacctcctctggcacatagagctataccccacatcctttttgcaacactagtctaaatactccaatctgtgttcatatatttttcatggctttggcactgtacacttgttgcttcaatttattgacatagcttcatacttacacttattgtagcttactatgggagacaacagcgcagccgaagctactggtatccagttaaagcctggaaatgctggtttacttgggtatgttgcctatgttccaatcactatatgcttgtttcatttcttgatattggagcctcatagatttataggctatcctctatcttacatgtcaatagaaataaatatttctttaagttgattgtcttgatttgatccagtcgtttttctaattactatttgaatactgggacaattatagtgaagtttctcatcctatcactaatacatttggctgcctcgtataggatgtgcatatggccagccttatataataaatggcttggtaacctctctaatactccctccgtactcgtaaaggaagtcgttttggacagcgacacggtctccaaaacacaactttgacctcttgtttctataaaaatatttattgaaaagtgatatatgtatacttctatgaaagtatttttcaagacaaatctattcatataatttttacattttcaaactcaacaacttgagagttattcatgatttatattcccaaggtttgacttaaacattgtcctaaacgacttcctttacaagtacggagggagcatttgataataataaataggaagctccttctctaagaatatcccttcctgcgtcatagatttgtatctttaggtcacagtacaacatttttttatgcttctctcttacacatgctgatgctttatagacatttatgctaccttccttttttatgactatttttcataatgtcttgtcctaagttctgatgcttcgtttacaagcaaatagaatctgttatgtatgatcctgaggtccatggttgtcaccggccattgttcttgttgaacaccaagttttggaggggccaatttgtcaaatattctgtgctgtgctgtgggatcccatttcatgggccctgtaatgtaggtttttctctagtcagtatatacaaaagaagaaaagaaaattgtaggtaaattcgtttctagttagccatcagccaaaggaattcataatttgtttacgtgtgtggaagtcatcttatgcttttgcagtttattatgatcctgtatgcaattgaattacttattagaaacatatccatgtacaggtgggctatgagttctcttactcagaagggaaaaggttctgaccatggtccggtttctagtgcaaatgctagcaactctcaaatttcagcaacctccagtgtcacatcaggtattagactttttttcaaattgctctaatcatgagtattaagctcagttttcatcactagatagggatcacgggctataaatgaaagaggaaaaatgtaaatatcttaaaagaggattaacaaagtatatgacgtgttacagttgaatgtgagctcttatcatttgtcaattctactgtcacaaataatagatcttccaccgtagcatatgcaccatccacttctagctctcttgatcaaactgcaccaacatcaacaag

SEQ ID NO: 15022 - DNA, 582 bp, Oryza sativa
aattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtcaaaagtaccggacacccacccagatcccaata

SEQ ID NO: 15023 - DNA, 27088 bp, Oryza sativa
cacctgccatttttcttcttagcatgtgtttttcccctgtacgtcaacggcaacacattcaactcttcattacgaattctcccatattaactctcacctaatatactttgtcaatctaaatcccttcctgaattaaaatagtgcgtgcgattatctgacgaactactgaggctattaacttaagcgcaaacgcgggaaattcgatagttcccgcgaaattttgtgcgttttgcaaagactactgcactcttggggcagctggtgtgctactgatcacgaagcatcgaaaattcagagggagttgatgacgaattcccagtcgaagctgccattcaagaactcccacaccggcgacgccgacgagtcggctccggcgaggtcgaatcccaccacgtccagctccacctccgacgagaaggagggagaccacccctgcgacgtctcgctgggagcgtcgccgtcgcagctcctccgctcgacggcgagcgacgacgccggctcacgcgaggccatgttccaagcggcggcgaagctcgacgcgcccggagttgatgacggcaggtggcattagttccccgtcccggcacgcggcggcggcggcggcgtcgcctccgcaggtgtgctcgccgtagtaggcgatcacgaacgccgcggccgggtcgtcctgcgactacgactgctgcacccgccgcgtggcgaggcagccctggcccctgaacgcgcagcggtagtagagcctcgggtgcttgcagccattgatctccttctgcccgtacttcctccagatgaacccgtccgtcgtcgtgccgctcctcacctccctcaccgcctccgcgccacgcgccctgcgccaaaccaagaaatcacctgttactaccttgcatgatagagtacaaaaccgtaccgttaccacacgattatcgcggttatcatgcacggtaaccttttcgatttttaataccacgatatatcttacggttaccacacggttttttcgatttttgataccacgatatgtctcgcggtagccgcgccaaaaaacaataaggggaacctcaccttcttttggtcggcgtgacggggagagaaggggaggtcacggcggcggcggcggcggactccgccgccttccgcttcttgccggtagtagcaccagtggctcctccccggttcagcttggcgatgacgcggtcgcagcagcggaggatctccgcggcgagctcctgctgctcatcccctgcctgcgccggggacgccgcccggagcagctcgccgaggtacgccgccgactggtaccccatcgtcatcagctccagcaccaccgccgacgagctccccagcatcgccatgctcctcactctcgcacgacaactctcagcttgggaaaaccgcgacgccgtgcagtgaagtgaccccgcacatcgcgtcgcgtcccgtatttatagaaccccgcccccaccaacgcggggtgggaaggaagcccgcgcgaaccaacgccgggtcgcaacgggcccaaaggcccaaggccaaccaacgcgactgacaagggagcaaatcaggctcagcgaccgagcacccgctttgctgctgcgcgatcgacaccgagatctccgccccgccacttcactcggcttcggcagctcgatcacctggccgcaacgtgattccccttccgctactacagtacacgtaactactctgtcgatgtccccaattatggcgttgtcgcgacccatcgatggagcgaggagccacactgtacactagtgctactcggtcactgtactcggctactcgatcgatcgatcgctgatgatgatgataaaactatggcgagagtcacgacgacggccgcgcgtagaagttgccaaaaacgtgtcgcggccaagtttttaattatgtgtcctcgatcgtcgccacgttacatcatcacatggttcagagtcctgtgttccatgtggatctctcatctgatcaactgagggcctgcttagtccaaaacaaaatttttcacgttgtcaccttaaatatttagacacatacatacagtattaaatgtagataaaaaaatcaattacatagttcgtcagaaaattgcgagacaaatctttcaagcctaattgcgccatgatttgacaatatagtgctacagtaaatatttgctaatgacggattaattaggcttaataaattcgtctcttagttttctagcgaaatctgtaatttgttttgttattagactatgtttaatacttcaaatatgtgtccgtatatccgatgtgatatacaggagcaaaatttttttccaactaaacagcccagaactagcacggtggccacatatatgttttctcaatttattattaaaatatattaaaatgataacataattttaaattttgtactaactttactaaactaccactgtctcatactgtattgtatatacgtgatagttattaattatttttaatatcaaattttagttatttctaaattgtattcttatatatggactgcagacttgtcttccaatattcctcatttttttagttctgaattctcgttatttgtaatttgtatttctatatagtctctaggctcttttttcaatattttttttaaaattttgaattttcattatttctaattgtttttctatgtggactttaaacccatctttcaatattctttttttttatttttgaatttcagttacttctatattgactctagactcttcttccataaattttttaatttcaaattttaattatttataaattgtatttctatatagactctaaattctatctttaattttaatttttattccgaattttagttcattctaaattcttatatggactctatactcttcttctaatatctgttgttttctaattccgaatttctattatttcttaattatatttctatatgcactctatacttttcttctaatattttttattttttaatttcgaatttcagttatttctaaattgtatttctatatggactctaacttaattttaattttattattgtttaatttcgaattttcattagttctaaattgtatatcgtcatgaattctagtctcctcttctaatattgtttattttttaaattctgaattttagctatttctaaattgtattctatatggactctgtttttattttttaaatatgagaatttctaggccgggagagcgagcgtggaggcttctagtctcctcttccaatattccttactttttaaattgtatttttatatggaatttgtttttatttttctccgattaatataataatttttagaccgtaaaagccaacgtggatgcttatttttctattactttaataagttaatagatagattgttcgattggtttcaataagatacgggcgatcgattccccccgggtcgtcgttggcaggaacagatcaacgcctaaatcttttctactaatgatcaacgcctaaatctccttctttagtaaaaccaagattacgatcacacgtgcacacgtaccagatgtacagagcagagagctcatgatcgatcgatcacatgcatacgcgcgcagggaagggcgcatgcaggggattgggattgaccgaaaaacaaccgcaagtgtaccacacagattcgctccggtcaaggtcgctccaaaatgattcagattcgagctcactgtaccagatgctaacttttttttagagtagccaacttctcggtgatgaacttttcgaagtgtcgtgctaaaattttactcatcaaactgatcgaagtatcggagtatctgtagataacttagggcaagtactatggacattcaaacataaatcccaagatgacacaaaagactaaatagtgaggtggaggagagaagaaggatgagagagaaatagtcacctctcatgcaaggggcagcccctacacaaacttcaataaacatgtgagagtgttagagatattgggaattatgtgatagagatagcctattatacatatcacctcttaatttaattatgtatgtcatgtatgaaattggatatggtagtcacctctaccataaaacttgcccttaaggagacaccaagttcatggtaaggaaataaaaattcccacattaatcggataaaaggaaaaaaaaaggttcaaatagaaatacaatttaaaaataactgaaattaaaaataaaatttaaacttagaaaaaaaaagaaaaataagagttcaactagaaatacaatttaaaaataactaaaattcgaaattaaaaataagcaatattgaaacaagagtccaaataagaattaaatacgagaaattaaaattcagaataaaatataaaataaaattcaaaattagaaaagaaaagaagagttcaggtagaaatgcaatttcaaaataactgaaattcggaatggaaaataagcaatattgaaagaagaatccatctgagaatctaatacgagattaattaaaatatataataaaaaataaaataaaatacaaaattaggaaaataaaaaagagagttcaagtagaaatacaattttgaaacaactgaaattaaaatataaaatagaaaataaatactctctccgtcccataatatagcaatatcagatgggatatgaattcatagtataatgaatctggacaagagggtgtctaaatttattgtaatatgaaatgtctcatccgatactaggttgctatattatggaatggacggagtattaaaagaataatccatatagaacacaagggtaaaggttaattaaagttcgaaagaaaaagtaaaataaattctgtaattagaaaaataagaataagagttcaactatagatataatttataaataactaaaattcgtaataaaaaataaaaactattgaaagaataaaccatatagaacacatgaccgagattaattaaaattcagaataacaactaaaataaattatgaagagagaaaataattataagattttaagtaggagtacaatttataaataaaaatatcggaataaaaatatggaatttttttaaaaaagttcatataaagcacaacgataacaacaaagatgggagaagcaactggcctataaaggagtgagtgacggcagttgatgggacatctagaaactattaacgaaatctcaaatataatcccaatgacgattaaaagaagggacgacggatagactgttaagagcataatcacgacagttggcgggacttctaaaaagtaaaaaaaaaagctcaatgttaatcatgttcgattttaaaaaccttaatgataatcatggtttctagcgtacaatatggtgcatccttttaaattgttttaataatatatagttagatataatattaggcggagtaaataattggtttcttcctagaactaactgagatacgtgtgatcgattcccgcgggtcatctcaattctcagccactaatcaacgcctaagatggtgtttggattcagggacttaactttagtctctatatttagacactaatttagagtattaaatatagactacttacaaaactaattacataaataaaagctaatacgcgagataaattttttaagcctaattaatccataattagagaatgtttaatgtagcatcacataggctaatcatggattaattaggctcaatagattcgcctcgcgaattagtctaagattatggataggttttattaatagtctatatttaatatttataattagtgttcaaacatccgatgtgatagggacttaaaatttttaacaccatctaaatagggtctaaagcttttctagattgtgatcaacgcctaaatctccctcgtcagtaaaccaaatattacgatcacacgtgcacacgtacccgaggcccagagcagagtttaattatgatcgatcaatcacaacacaggtatatcacagattctctcaggtcaagatggctccaaaacgtttcagattcgagttcaatgtatcagatgctaactttttttttctagatcaacttttagctaactgcagacgagttttggccttttgggtcttctaccaaataaaagtcaccaaaaaagggaacccttcaatgcaacgaacataacctcctaactctgagcgtaaatcattcgatgtaccactgtgtagattctctccaatttaagaatcattcagcgttcgcaagtcttgcgccaagtacattgcatctcattgtctacaacaaaagtacactgcatttctatatatttgtcttttcagtcgttcatgcgattctgatctgaggtgataaaagtggatgttttccagctttatgtctaactacaccgtaacctcctaactctgcgcgtaaatcattcgatgtaccagtgtgtaaattgtccccaatttaagaatcatccagcgttgaccttccaaaaaagaaaaaaagaatcattcagcattcgcaaatcttgcgccaagtacattgcatctcattgtctacaataaaagtcgtacactgcatttctatttgtcttttcagtcgttcatgccattctgaggtgataaaagtggatattctttccagctttgtgtctaactacaccgtaatactttacgtgtcaacccggagtgattgggtctaatccttttttccattgcacaagttgacacatgccatgttcatatcatatttaacgtacgctgactctcattgggacgtgagaacaatgactaggaaggtctagggaaaaaatatatatataacggggatagtgatgctttctcaccaggactacggtctaacgggacatgtgcagcaactctcgagattaccggttgcagtcaaaatttaaattttaaaagttaatttgaagttgattttagtttcgatcttgtacttattttattttttaacattgggttttaagtcaataaaaacatacacataaaaagttttacctataattttctttttctaatattaatttgctacggcttataagctctaggcgaaacgctcgggccggcttaaacaggtttagcttatactcctagttagtgctaattaaactcgttttgtactagtaattaactaatatctcggatcagtaccgctttcagcatgtagctggtgagtgacatattctataagttggatctccttattgacattggaccaagattgaaccgaacttggacaaataatagtacgggtcgttgggcatatgtgcaacttgatctcagatttattagattcgatttaaccagtctccctaacgcgctctaacatgacgctgatgttctcttatctcatatcattggccctggtatctgttggttgctagtgctctgatctcgacttagaaacctctccaggctgttggatgtgcatccaacggctgagtgcttctttcttaacctctccaagataaaatgaaaacggttggaaacgatatcatctctagaaaatagttcttgattatttgattttttttatttataaatttaagtatttgatgacatctttaatacgacgtcaataatattataaaataagtcaaatttatatatggctaaaatagaaaacggcttaatataatccatccttacagaaatgatactcacttaattggtcaggaatttctagcaccattatgttttccagatctttcttccccccgtgttctcaagattcgtgctcgaagcatctgacggctaggccgactcaggctaatcgtgggagagatgacgcataggcatagacaagctgaataattaaagacccgtgcacggtctggtttttctacggcctggaccggcaagcgcatttgacccgccagttttttctctgtcaactccagcagattgcatggcgagggcccatcacattttagaatgttccatccacgcatgcgtagttagtttcacgcaacaatacaaaacaacgctcaaaatctctgcaatttatattataaaccgctatgaagtcgctgtagcttgaggtctctgacagaaatctgttctgcaacacacgtacgtgtgttttgaccaaaaccggtcggggaaattaaatctcccttgtgatgaatatatactagtttgtttttaaggtcgatgaatatatactagtataaaaaactgcgaacacgcgcactgacgttctactgaccaattagaatttctcttctgtaggagtagttttgacccagatcttcgcatttgtcaatataagcataatatatatgtattccctggaaaatggcttccatggacggtgcgacgagctcggagttacttactgagtgatgcttacgcgatggcacgcggcaactaagcgactactcgcttcgtcgacttcattatatttgtagcaattctcacacatatcagtcatgtaaaatgaccatgatacctagggtttatattttcgatgcacgaaatctcgaggttttgacacgggttgaaagtagattatgaatgtaattttgaataattttttagaatccaaattggaaacatgaaaattcggatgaaatttgatcaaaaattgacaaaaaaaaatgttagactgctaggggtcgagatctggcatcaattggaaaccctaggtacgtacccactaattaatactctttgttaattgtattttctaggtagacttcagttaattagatgcattagcctgatttgcaataatccctagaaatcgtacggtgatcgatcacaaattttgaacgacttagtgggatagagggaaccggaatattactgtcagcttgacactaatattttcctattccattatctaacaaaattagtgtcagtctgacttagctcaatgattttaacacgcgctttggccagtaaaaccatgaagcccttggtaattaccagccaagaaagtgacgctactcaaaagtaagactggtgttgtttcagctgtctgcttgtgccatatgtaccatgtcaaatgtagcgtctttgaattcgtccaattgtccagctgatgccgacttaacgatcgagccacggccatgcatgtacggaagaaacggcgagatgatggtcggcaggtcattgatttggcaattatcgtgtttcttaaaccaacttggtgagtttcttctgtgaccagccagacgcccagagtccccagaccaacgttgccagcgttcagtttctgttgatacgacatgccatgcaaatatggaattgcagtaacaatttataactgacccggtaattaactcgagattctctgaagagaactcggacgccatttcagtgaatggctagctgcacagttcatccgggacgacaccaatatggtcaccaaatatctctatcagaaagacagacagaaacatggaaatgaacctctgtttcgagacccgggaccatgaaatggccggtgctgcagtaactgaaggtcacatcgcgtctcggtaggcagcagcacacactggagcggcacacatttttgcaggaaaccgtgtgcatgaacctgtcgccgatctgtccgttggtccgatgtcataggttacggcgggggggacgcacgtgtagcacgattagctagccgagtttgtttgcacggtttcattcaacgggaccgcggttcaacaaattctctcctaatgaccagcttagctagacatgcaggagtagcaatcatcaggcttaggccgaaatgggccggcgagacctgactaatcgactgattatggtaaaggggaccaacaaatggagctgcatgatgtgtggagtgctatgtattgtttagaacttttgggatagtacaagattacgtacgtttcgtaccttgaagatgtcaaaatattatacttctgaagaaaaaaaaaaggagtcatcgtcaaatttcaacagtaaagcttgtagagtcggccaaggacagtgaaaccgacccctagagagggagtagtaaagtcttcctatatgaaaaaaaaaaggaaggaaagggtgtagtattgactgtactaacttgaatgaagcaaataataccatggctgggaagtctatttgtaacaagtcccggatgacttactggtggggacaatgtgtgattgatcgctgcttttaacacactgttggtcacataagggcattagcagtgcatccggcttgtttcgtgtgaccatgtgctcgacatagacaaaaaagtgaatgaagccacacataacaaattttaatctcccacagtacgccgggctccctctcccctccccaggtcattcccctaacctccccaagccgacatgtctcctcccctttcccaccaccactggcacaactccacttctcccgaccgtcggtgcagctctccctcctctccgtcgctccccctccctgtcggcgcctctcaatcgtggacgccgcttgagcccagctcgacggcttgcggcggatgctgcctccgacctctccctccgtcgtttcctcctcgtttccggcctctccctccaccgagctctctagatccggcccgtgactcaccgaatctggacacgataagcagcaatgggccggcggctcgatgacgatgctggcgacggctccatggtaggcctacggcggcctctcccttcttccctccggcaccggcgcgacgtccctctccgttgctgtaacgtcgcacctctcccaggctgggcccacttacatctggcagcttttccagatccggcccgtggcttctcccttcttccctccggcaccggcgcgacatccctctccgttgctgtaacgtcccacccctcccaagtcaggcccacttacatctggcagcttttcttggatatagattgccctcacagaccaacacaagtcttttctgcacactttatccttacttgtgcacctgaaaagaatttcctggtcggtcacccatcccaaaattccaagcacgcttaaccacagagttctttggagatcggcttccagaaaagaagttgcaaacttgttgttatgagtattctattaatctatcaagccttgggccaggatgtcacagttgcgaatcggagagactggccgacgagctcggcggcgcggagaggagaatgacgagcagggccggcgacgaggttccctctccggtgctgtagcagctctctccggcgtcgcacggggccacgaagcgcgaggccatgacccccacagagcggccgtgccgttcttccctgcgtcgcacgacagcttttctaacgaagaacgagtgcccaatgtgggctacgtgaaccttgttcggtcacgctccaagctgagttggcggagaatctcgggttagccgaacgccacgcacgcgcattgtgaatgccctaatgacaaatacaacatatggtgccctcccctttctcttctgttgggaaggaaaacaaagagagcgtaaatgtcacgccccgaacaagtcccgagcggaactagcccgtgacgctccaaattaacctgttaatcgataccagtcccaggaaacagtgctggtatcacaggaagacagaatatcacagcaacaaaggtctctttattatagagtaggagtacagtcatgttgggctgcggacagatcccgagctcacaactgcattacaaaagggaagcggaagccaagacttatgggaaataagtgtttaatgcaggcttcaaggaaaggctgttgttttttttttgcaattgattttatttgaactcttttctaaaacaactaggtgagtgcttctcaaacgacacggatgagacagtgcgactcatccggtcggagtatgtgcaatgtatcagtcttttgaattgatcaagattggcacccagccaacagctttcaaacggccacccgggcctggctgatcccatcagccgcagattttccaaacatcaatcccgaaccacatcagcaaatttcacaaagcagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaacggccacgactagagaccttaaggctttcatgacaaggcatttcgagagccgacacaggttcaccatatgctgacgagaggggtcccagaccaacaacaggttaggtcccagaccatactgtgccaggaagcccaggggtcctccccgacaccaccccggcgaatccacttgtctctcagcatcaaggctcccctgtttagctaattactcagccagggatgtcccattccacccatgtggtcgtacttgtcttatgttcggatgaaattccaaggaaacggtccttaagtgcaaaagcgggaaaccgtacacccgatacgttccccggtccgcgattttggaaattcatttaggttcgcaagcaccgacccaggtgtcgggttttccaagtcttttgtaaaacccaagttttacccaagatgtttctcaaattttaagtttgaaggcgaccgtcgatactcgtgcagagtgcacgattaccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagttcaaatataggctcaagatgttcaaaggtggcttgccttgctcgatatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttagaagttgaacggagtcaaacggacttacggttgggaagatattgaatttctaagattattggatttttggtctaaaggaaaaggatttatttaaatcctttttgaaaaagaaaagaaaagaaaagaagaagggaggggaattagactttcctcgggcggctagggcgcgacccgagagaaggggtggctcggccgagcttaatgggccggccgggccaagaaggcggcccaaggcgcgcgcgcgggcggggaggggagagagagagccggtgggccaggtccatcccgcgtgggcccaggtgggacccgcttgtcggcgactcggctcaccgtgagcgaggtgcacgcggggcgtgctagggtttggggagggaggcgcggcgcatgcgtgcggttcgcggaggacccggtgcggcggagcgaaccatggcgatacaggcgaaggcgagtacaccgggacgttgcacaggacgaggggagacgagccaacgactcatattcaccgagggtgctcgacggcggcggattgcggtggcggcaatcggcggcgggagaagggaaaaacggcgatgaggtcacgaggggccgattcccggcggtgagagcatccacacggctacgggaatccaccccttacgccggattaggaggaatcgcatcgagggaggccggcaacgagaggcgcttcctagctcgggcggggacgggggcgagcacacagcgagcgacggcagcagtcggggcggcgccggctagctacggggaggctatacatgctactaccgaaaactaaggggaagagatggattgaggagggagaacggggagatgcactaccgtgcggacggggcgcagcgacgatgggccgacggcacgggagcgatctctccggcctcgggccggggaagaggaaggagagggtgcgtccggagtccccttccgcgtcctaacgtgcaccgactccttcggcacacgtgacggtggcggtcggcgatcggcgatcggcgagacagaggggacgacaatggcgcgggcgaaaaacggggaagattgggaggggaaaaggaagggagggcgcctgggtttatagggcggcgatgttggtttggaaaccgacctaggacggtcaagggagggagctagcgctcgacggtcgcggccaaagcggcgacagggaggggaggatgacgccggcgggagggaaaagggaaaaagggggagagaaattgggcttgcctccttgccactttggggaaaaggaggagggagagggagcgatgcagcagaggggggcggggctcagcctccgtcccttggaagccagcgcgcggcggtggcggggccgggtcgatgacgacggcgatgacggcggaccggtttggagtggagcggcaacacgggcgacagacgcggggcaggcgcggcaggcgttgacggcggcggcgactggccggtcggccaccacggcgcgcgcgcacgcgcgggcggcgcggcgatttgggcggcatcggcgggaatggcagcgagagcgggagggagggctctgcgcggctcacggaaaagcggggagagagagggattcggcccatcgaacccgagggaggtaaaatagacttttgcggagggatttgatttgggaaggatttggattcgggattgaactcgacaatagattggggatttgaggtctgagatggcacggacactagacaacaagcaaagaaacagatttcgcaactagggtttttaagagatagttttcccgctaagcgccacgacggaacgggtgctacagtaaaattcctttcttttatgggaaataacaagataggctcctactgtggtaatatgttaaaaagggaaagatatatacaaagaaaaagaaagaaagagtcaggggttgaacatttagaccggcgatgagcgctcattcgcatgtgctaccactgtgcaagtgttgtttttgtattagttacatgaaagttatatatggattatattatagttgcatgcaagcttatgttataaggctgtattcggtgggaagggctagaaacccttcctacgggcacgttaaaccaagcagtagattaatgcgtgcttaattaagtattattttgtcggtgacatgggaccgggagtatcatgactagaggcttgggcagccgcgatcacccacgtggcctgaccccctcgggggggggggggtcgggcccgagggtgatgtggccacacctccctttgtctccccgaggggtcggactgctcccgtttcgaccccgagggccggggcgccccgaccccctgtgggtttgccgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcaggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttaggcgggaggaggcgctcgagggggtcgaaagatccgcgacttcgccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaaggccatgaagcgagagcttctggccgcggcccctacccatgaggcgatgcggcgtgcgtggtggtcggaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgctccgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccgggatggccacggggccactgcgggaaggccgcgcctgtcgccttctgaccccgaggtcgtcagcacagaagccgagtgcgccccgcgcggcctctcggagcgtgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccccggggccactgcgggaaggccgcgcctgtcgccctccgaccccgaggtcgtcggcacagaagccgagtgcgccccgcgaggcctctcggacgaagagcgccctggagatgcggcccctagtgaagaagatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagccggcccaggccctacagacaatacctctttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccggccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgaggcgggcggctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctcacgaagggacaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccggcgcccagctcccgtattgaaggcggaggtcgtcctgcgcctcgttcatcactgcggtggcgatgagggaagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagcacgaccccctcctggggtagattgttctcccctgcggctcccgcccgcgccatcgtggcctcgaggagcccgctcctccgacgccccgaccgccatcatgatggtcaggatgttggcacgatctggatcgctgcagagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcgcaatccggcgacgaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttgaaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggt

SEQ ID NO: 15024 - DNA, 3091 bp, Oryza sativa
tggtatgaccatccaatcggagggtcattcaacagcagccatgcaaatctccgccaataatgagggaggacagggctatcccggtgtcagataaaagtacgaccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtccaccattccgcgttaaagcgttttcccgcacgggctgagctggtgcacctcccacgagccttctcatcccctccggcccatccacctcgcttcgctagctagctgctctccccacctatataacagcgagcccgcccaacacccgctcgccctcctctacttctgccgcgccaccaaccatccatcgctgacgcttccaacccaactgaattcaaacgaagcgaacaacacgaaccatgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagtgagttattctgcacgtgctatacagttatactggaagcataaataaatgcctagctagctagcttccagccgcagaactagtagctagctaatcaattagtacaagatcagctgggttaaatatgctataggaattgagtacgagtttatctgattcatcccgtgcattgatccacaggagattattgacagcctctccttacgacgatgggtaccagtggaggaagtacggtcaaaagaagatcaacaacaccaacttcccaaggtttaaattaatttctcaaccccgtgcctgcaggctagatatatcatataccttaacccatggattaattaatcgacaaccctgctcatgtcaaaatgctcagataattaaccatcgcgactactcgttttgtttttaaatgtaacgagattatggttacgaatttagatacgcatgcatcttctcttgtccagattcatagccataatttttatatttagaaacggaaaaagtatatatttagcaaaaatgggtaatttaccatgtcgttgtaaataaaaaaccaaggtgagtacttttggaccatgacggttctagctagctagagacagcgtataggagaaaaggtattattcgtgatgtattgattggactttgttggatagcgaaggcgtggcaccggggacggaagagacaaacggaaaatgtcgcttgacacgcaccctacaactttatagattcttttgagcagccaggcgaattaattgatcgccacatgtttgaaaccatccataaagttaagccttatcagttggagaaaccaaagttaagctgattttttttctgtcatgtggaaattaagctgttctgttttcttcacatgatcattttgtccctggtgtcacgttgtgtagcgcgagcaaataactgtggtttatctgcgtgtatcactgtgagctctctgctagtttaaagctggagtttgggttatattatatcggaagcatcttgtgacgtcatcacctaataattatttcttgtgatgtgacctcatcaggccagcttgcaagctagccgccatgttcttgaattaggttacctaattatgtatacagaacacgaatcttaattaaatctaaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgttgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgct

SEQ ID NO: 15025 - DNA, 17862 bp, Oryza sativa
  unsure (1)..(17862): unsure at all n locations
ctactactactactactactacattttgcatgaatcgtatactacgtacaagcgtactactactaatttgcattacgtatgtaccttgtgtgttgtaaaattaaatcaaccctgtgttgtgcaactattatgattgcactaggttatatgggttgcgtagttgattaagtttggtccggtcggttggagtggtttttgtatgcacacgtaccaatatgctgtacgtctcactgtctcggtgattctcacaccaaataggcaaagtgcaaaattagcaaaggctgtgtttagatttaaagtttagatccaaactttagtccttttccatcacatcaatctatcatacacacacaacttttcagtcacatcatctccaatttcaaccaaaatccaaactttgtactgagctatacacaaccaaaatacacaatagtgttgtatgacgtgtggctttccctatttgtcaagcaaatagcaaatctgatatacagtattgactacttgtaccactactggtataaaagcgttctcttttctctaaagaaaaagtgatttggatccagacctgtttttcatcaaagtagacatgtgtctaatcaaaagtactactctgtatatgaatataaggccccctttgaatcaaaggaaaaaccataggaattctagaggattttatcctatgggaaataatcctacagagtcctttaaaacaaaggattgtttcctatcaattcctttgaaattcctatggaatgaaccttactagagcaattttggaggaaaataagcatgagatctcacctcatgttttcctcttcatgtgtctaaggttcctgcgtttttcctgtatgctaaccaaacgacagtttgaagactttcctgtgtttcaaaatcccataggaatccaataagcgtggtattcaattcctacgtttttcctattaatatgttttctcaatcttgcgattcaaagaggccctaagagattatgagcttttttttttgttaaatgatgatggatgagagaataaaatagtataaattatgatgggtgaggagggtaataaaccaataaacctttcctcctagaaaaaatcaatttcgattatgagcttctttttagaagttaacgaagtagtaaaaaaacaaagcatggtacaaataatgatggttgagagaataaaatacaaaatatgatgggcgagggtaatacacctactcccagaaaaaatgattttctttttttcataaatgcgtaaaagaattgtacgtcaatatattagaagaaagcaagagtttttattacacaacacaatcagccagacatgactatgcctgtggagggaaaaagaaaaagaaaaaaaggctgctgggcaaaagaaaagaactactattcaaacgctactccaataatgcgggaagttggtggtagagccacactacactgacaataaaccctccaaaagcagcagctcctgcagaagaccacagacgactttccagatggattgaccccataaccactaagatcgaggagagcgaaagatcaaacaccctagagttctgcttcttctataactgccaagagatcaagaagactaggagccggagcctgcacgaagatgctcgaataggcatatcctagaagacagccatcagatctaaagctaaaaaaatactctttttgaaaaaaaatgataaatgagaagtagtaaaaaagataataggtgaggagtaaagcacggggtgagtatgagtatggagtagcagtaagccagtaacacaagtacccatcaaaccagaggcgtcgccaagataggtcaacgggtcggattctaactacagattagtgcatcatgacatgatagcctgaagacagaatttcctttctctgatgatcgcgacgattgccacagtgaccctatcggtttgaccaccgcaaggaatttcgctgcgcggcacgcctgcagcaaaagatggtggatggccgaaacggggacgaaaggcgacacggacaggtgagatcaatgtgcgtgtgaacccacgcctcaatcacacgcccggatgcccggaatcccgtggtaattaagctcgattaattaataacaatactaacagtagactactactcgtagtacttggggtaagtactatgggcatccaagcacaaaccccaaaatgccacataggactaaatagtgaggtggaggagagaataaggaagagagagaaatagtcaactctcatgcaagaggcaacctctatacaaacttcaataaacatatgagagtgttagagatattggggattgtgtggtagagataacctattatacgtatcacctcttaatttaattatctatgtcatgcatgaaattggatgtggtagtcatctctactataaaacttgcccttattacgttctccctccgtaaaaaaaagacaaaccctgaattttcgtgtccaacgtttgactgtccgtcttatataaaattttttataattagtattttcattgttgttagatgataaaacataattaatattttatacgtgacttatctttttaatttttttataatttttttaaataagacggacgatcaacgaacgttggatacataaacctaatatttgttttttttttatggagggagtaacggctatcagcctatcagcaaaagaaactactggaaggcaatatatacacggcagatgcacggatctgattagccggccgggtagtacgtgatttgaccgtatttctggcctcttcggccccaccccgctctcgcgctagcagcctgccgcctgccggctgcgtggctggctgggctggctcgacggtgacatcacgacgcgggcgtcacgctgcgccgctgtgggcaacgtcacccgtgtgggcgtcgccccgagttccccacttgccgccgtgcttcgtcaggcagcgctatagctgccgatggcgaagtccgcggatcgtaccgcgcccaagtgagcagaggaggcgaggcttcgcgggccacgtgaagttgacggatgagaaggcgatgtacgttcctccgcttccgattccgcgcgcgcgcgcgcgctcgtgcaaagcattgggcatactgggcggcccggtgcttgactgaaatcgacgtactgtacgtcttttttggtactgtacgtgcggtgcttggctggctgcaaggcgatgtgtgcggtgcggccttggccgggcgtcctttctctttacggtaaagacggggagacgttggctgtgtttagtttctaaaaaaaagttgaaagtttaaaaaaaagttaattttttttaaaaagtttaaagtttatgtgtgtagaaaaattttagatgtgatggaaagttgaaagtttagggtagttgggggtgaactaaacacggccgctattgctacaaccacctccatcagctcgaggatgtgaaaacacacctgaataattgcatatgagcgatgatggtaaatgcgtatgctactacatggtggatgcatggatgtcaaaaaacgggggcgttttttgttctatgtgtttttggaaggccgaaagggtagatatgaatgctctgcggaaaaatgtacgggaagcaatatgatccgtcgccgcggcggccagccggccggcaagtcatccatcggctcatcgtcagacagtgatgagtgatggactgcgaggacggatggcacatcgccgtcgaacaactctacatcttgcgccgtggcgtttcttccatttgtgcttgggctttgatcttgaacggcgcggttcatacttcataccataccatgccgcaatggtcgccacgacaccgagaaaactgggccggcgcggagccgtcatatgtgtgcatgtgtggacgtcattcggactttctgagtttgtcctttggcttatcagtcagccatcaattgctacctccttacttatatatttttatatcaaacgtttgatcgtttgttttatttaaaaaatatttttttaaaaaaaatagtcacacataaatttttatttatgttttatttttatgttttattatcgaataacaataaaaatactaataataatttttttcaaataaaacgaacgatcaaatgctgaatataagtagtacaaaattagtatagttatttagcttacccgagccaagtcaaccaactgacccaaccaagccaattcattgttgtcaatgatagagcgtacacatccttagggtacccacaatggttatctataggctctctataagagatccatgtcagcatattttcctacttggaagagattaaatgaagagagagagagagagagtaaagctatctactaacctggagatagtctatagagaaaaaacgagacaatgtattagagagctatagatacccatatagacatactattgagatggtttactattaatttagtctattgttgagatgtacatgttttatagatagcaccttactttaccattgcgggtgctcttatttctgaaggcaatggaaacaagctagaaaccccaagggaaacaactaaataaattttaggataacttaactagttagatttcttatggtgcaatctaatctacttaaatttaagttttagacttaatacatatgctcatatttagaataattattctttcagcagtagacgacatacctgttgagagtaggacgtatcttgatttcgttagtctcaaaatatgcatgtccagttttcgaaggtactcatcgtgatagggtgaaagtgagagcacgcacatatataaacacctgatgtctgtagtgacttcgctatctcaaaatatatatgctggcctactttattgaggtgcatatagggattaggtgtgagcgtgtatgcattaataacagtggcagagtgcgcgcgtgtaaatgaggacttgtgtttttacggtattgaaaaaaaaacctcttgttagggttgtgtaactaaggaacagaaggtgattttctcaatgccaacctctatatatacagaggtgaactctagaaagggaagagactctctctcttttttttttcccacgttggttggttcaaccattttcccttagcttaagggtacacgtacctacttgttatttatgcaacaacaattggcaccgtctgtgggaaagatgtcaagaaatgttaggtatagatcagcgaagctcaaaggttgttatgttggacgaatgccgaaatgttcgacgaagcttaaaatatgacaaaaaccgatcgatatgatcgacaaagccgaaaatttccgacaaagaccggtataagatcgatgaagaccacatatggcctcgaaaacctattctctaaggcttcctccaatggtgccatgtaagctatctcataacatgtccacgtcatcatgtatcctatgtggaggaaagagaaggcaaaaaatcaatccatctatctcctattcccacgcctatctcgctcagttaccgatgccgtatgagcctgcgcaagagacaacagtcgactcttccacgccaaaatcagatcccgtgctcccttcccccaaattgccccgccgcacctcccgcccacccccgacgctgcaccccgttcaagcccaatcccgctcgctgcaattcgctcccccaccccctggcgcgccaatttgctctcctccgcgcaaatcctccaaccacccgcgcgccaatctttcccttgcaccctccctcttttcttctccagtgtgtgaaatcttcctcgtcggcgtcgacgtatccgtttccacgagcccaacgacgaatccactcctcttgccaacgacgacgagctgtagagcaggatgagctgccggtccaaacgacaagtagctccgcggccgccgccgtcgtcgtctccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaaccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactaatgagatgaaagctgagcacgtgatgggtctcaagatgttgagggagaaacttcttggcgatataatataaggtattttctgtcaatcaccatgcactttatttttagtcaatgttcaacaaatgaccatgtattgtaatatgtattcttagtcaatgtaccacaaataaccatgcattgtaatctgtattattagtcaatgtaccacaaataaccatgcattgtaatatgtattcttaatcaatgtaccacaaataaccatacattgtaatctgtattcttagttaatgcaccacaaataaccataaattataatttgtattcttagtcaatataccacaaattaatctgtaccatgtgactatatattgctctgttatattcagcctagcaaaacaatccagcactgtcctcctctgttccttctatccagtactattcttcctattctattctgcctcatttgttccttccatctagtccaacactgcctcatctgttccttccatccagtaaaacatgtcggatgagtttgacaattccatagacccagccgagatttacactacagatatgttcatggcagagcatagtgtccttaactcttttgccgggcggatcgacaaaaggattaaggccagattggaaggaggtacatctaggcgtacaagtggtccaaggaagtacatcaataggaaccatgaaggagcccatgatcaactatttgctgattattttgctgaagatcctctctactctgctgcaacatttcgtagaaggttccggatgagaaggcatgtgttcctacacattgtggatgaactaggcaagtggtcttcctattttacacatagagtagattgtactggacgccttgggcactcaccattgcagaagtgcactgcagcgatccgtatgcttgcatatgggactgctgctgacgctcttgatgagtacttgaaggttccccagagtactgctctagagtgcttagaaaattttgtggaaggtgtcgtcgaggtatttagtagtaggtacctgcgtcgccccacggctgaggatctcgagcgtttgctccaagttggagagtctcgtggattccctgggatgttgggaagcattgactgcatgcactggcgatggaaaaattgcccaaacgcatggaagggacaatatacccgaggtgaccaaaagtatccaactattatccttgaggctatagcttcatatgaccttcatatttggcatgcattctttggtattcctgggtccaacaatgacattaatgtgctcaatcagtcccctctgtttattgaagcaataaaaggtgaagctccccaaatccaatttgctgtcaatgggacataatacaaacacgggatattatcttgctgatggaatttatccggaatgggcaacctttgtaaagtctataagatctcctcaactagagaagcacaagctgtttgcaagggaacaagaagggaaacagaaagatattgagtgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttatatccgagccaaaccaatccatagtcagcttaaaaatgacttaattgagtatatttggcaacggtttcaaactaggcaaaataattagtcactgttatttcagtataatgtaagctctagtgtacaatttcattgtaattttatcttagactgactgtatttatcactttcacttactgtacatgtttttctctctaccggggcgaacagattcgatgtcttttacttgtttttgtggctgcggtccagcttttggtgatcttgttcaaggaatgggataagcacttatggttgctgtccagcttttggtgtttgtcgaactcttctatcacttctgtgacgtgatgcagtcttttttttcccttcagtttgctcttttccgcattgtactaaagtgccatgatatggctatgatgttatctggttgctgtagtggaccgtgagttggaagaattgcacttcattgttatatactctaagtcgatgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagacagttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccggtcagcggcacatgggcgccggtccaccgtggaccgggaccaccgaggctgtccaccgccggtccacgggaaccgacggctcggatcggcacaaagccgatcggacggtcacgaggcggcgcggctggggcacgggcacggcatgagaccggctcggccgagccaaggcgcggcggcggcatgcggccaccggcggcagcagccggcgacgaggaacggcggtgggcggccggaggacagcggcgcgcatggggacggcgacgcaccccaagaggcggaggtcggcaagaaaggggaacgggaaaaaaaggaagggaggagaggtcctcaccgaaagcggcggccggcgcggaggaagatgatggcgacgacgattgcccgatggcggcttgcgaggacggagggcggacggggtcgcccttgaccttcagaaagagatgagggagttagggaggggaggaccgatgcggggtgaccggtaacgacggccgaccgcgacgatgtgagaaggatctcaccgatgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggtcccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaagtattcccggccaatgatttttaagggaaaattttaattctcccattatttcacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaactcaaatgacaagtaattccaggaaacctgcttgacctgtcttttgtctgaactgcaaccgtccctgatgctgcttctcaaagctgaactattgacctggcctcaccggtgtacctcagaattcaatcagataacttgagatcggtgtaactctgctgacaccttgcaactggcttcttcaagtactacccggattgttgcactgggttgaaccttcaactaaaacagcgatgaggtgagccaaaactcatctccgagacctatccaccttacagggagtagtcttactttcgcctgactgggaacaattagactattgtccttgaaaaataaccaacacttctcttgcttacaaggaccctcactttgaaaactgaaacttcaccgattcatcaaaatagagcaatgacgacgcactttcatcccagcaagatttggaacttaatcctcagttgctgatgggagattccacataaagaaattctcgtttagctcctgattggtacaactttcttgcttctgacttgatttttggtgtcataagcctaaacagattgcatagttaacattccttgaaacaagcactgatcacccaacagatccaactcaagaggtcctttccatggcatgacatttcacttctttgaccatcctttgctaactcttcctgggttaacagactatagatcctgtaatagcttttcgaaaaatactgcaatctgatcaactatcggaaactgactttgatgctgccgagagtttctgcactttgatcataacaacttcgctttcatatgttcggtaaagatggtttgttgaaaagagattctatgccatataccttgttgactacacatttctatttctggaccaaactctcgtatcttcctgactcatgtatggaacaatttctttttcaacttctgggaaacattgagagttttttttttctggaacttatagcggttgccttgaactatggaaaccattcttgtttcataatcacaccactagggtgtaattgccgcttaccattctctaacagtttccaaggatagagattccttgtatgatgttacttccgaatatatatttttttttccgttactccttacacttgaatacccttggtactgcctttggagagatttcatagtgtcgagcaccatggatccaaccattgtcactttcaaatattccatcactcttttcatttgagtaccactgatgctgcctttagaaagacctcatcatgtcgaggtgttgagggtctaaccattttcactccgttggttaaccattcctctattggctcgcaaacaggttttggagctcaacagaattgcgatgagttagaagagaaactcttggtttcttgagacaccgacagatacacattttgatttacttttgcatgctgaagatgaatcttaaaaggagaggaactggctgactcatattttattcaatatttccttttcattacatggctgccataaacatatacgtacaatgagaagtactacaaaatcaaacaattgtagactgctgctgattagaactgcccttttcacgactgaacttgaaaaatagaagtcttgtctagaattgctattgcttccattattcaaacctgactgacttgttcctttagttcctactaccagaagtctcaccgggaacgttgctctgcttgttgatcttcgatggtggaggggcaactgtcttgtcagctgtaacgggtaggatcttcttgcccgtggggttaccgagcggtgatttgtcgatgggcctccagattggagcaataccaggtgcattgctagaactgacaacagttggacgacctggtgctgacaacacttgccgcgggtgctgacgaaggagcgtaccacctctttgtagctgtagcgagctgttgttctcctggcattgcttaccctgctggcgttggtgctgtaggcttgaaacggttgccggtggaacaatgcgacctttgacggtgcccttgacgataatccgttgaggcggaggttgcacattcaggtgtcgattggtgtcatgggcaatgctggtaacttgtgaatcacgacgaactgcctttgctgctcttggaagaggacaatcactgaaacgatgtcctggcttacgacagttacggcagaatcgacttgcttggtcccgaggtgcaggcttctgattatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcgttcaactgacagtccttaggcacatgatctgttccttcacacaagaaacatgttaccttccttaaagggcatgcatctgagtaatgggtatattcaccacagcggcaggtggggaggcataaactagcagtgtgtccgactatcccacatctagcacatgctttgaactccaatcctctttccatgaaactgttaagggtcgtatcatcatcgtcatcagtatcatcatcatcgtcatcagcagcaaaccgctctcctgattcatcatcttcgggtctgggcggaccgtactttatgagatgtcgggttagctggcgtgctccacggaaggtatttcttcctctctgacgcttgggtatccttgctgcgtcttcaggagtaaattctgaactggtgatgatcatggtcctgccattatccatcttaccatatcaccttcctgttcgctccaaagttgtgctgcagagtaccatctttcttgttagtagactgacttggagcttggttacttcctgggcactgcttctcgtccttttcaggtgacctggcgaacaccttccatggacagttccttatataatgaccttgctcaccacaatcataacaggtagcacttactttcctttggtctgacattgacttggctgtcgttatcttcggggatctggaccgcattttgacaggggtcttcggtgccgatattgggaactcctgactctgactcggattcgggtcccgggctggcatctgatctcgcacctgtggtgggtgacattgacgtgactcctgacattgtcgttgcatctgttgcatctggtatatttggtatcgacgtcgcatctgttgtaacaactctttcactgtctgagtttgattagccatgacttggggttgaggctgatcttcaagaggctgacgtggaatattattagaattgcactgagttgccccatgaaactgacggggtcttgatccggcgaaattgttccttttgcagaccatctgctgcaggcaccaaaaagagggggaaacgggaggggttactagagatgaagtactaaaccacttgcctattgatctgttgcgaatggattttatgattcaaagtggtgaagcaaacaacctagtatggtcgcatccccaccaatgacgcaaaccatacccctacacacaaaccaacaacacacgatctagaagctaacgaaactactcttctgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccacttcacaggcaaaactcaactgaggtctgagccttggtcttccaacttcgtcttcagctcagaagcactacacttctgaaaagggggaattataacaaggctgagtacaaccaccgtactcagcaagccacaccatgatgcagacgtgcacagggatacaaggacgggttgtgggtattttgataaaggccgtntgtaaacattttatttgagcaaa

SEQ ID NO: 15026 - DNA, 6024 bp, Oryza sativa
ggttccacctgtcgggaagggagagaagaaggcacgcacacaagacttttgcgagcgggccaagtgagaggggagccggcccgagagaggcagaaggcgcgcggtccgcggaataggaaggaagacttgggccgaaagaggcccaaagagaggagagaggattttaattgttttctttttatttaaattgattaaatgaactttgtgactttaaaactatttctcgagctccgaaaattctcggaaaattccggagagtattttagggcacaaagaatattgcaaaatattcccggccaatgatttttaagggaaaattttaattctcccattatttcacttgattaaattgatttaacttttatttaatttctagaaaatgtattattaattgatttttaaacccgaacgaaaatcggagcgttacaacaattcattagagaaactatctcttgttctatctcttagatgatgtgtacgatttatgagctagcagttgtcttcaaaggacctttgaaggaggcctaacatggggaagactagggagtagtcttgtctagtcagtgacaatccgataatatcaaatgcgtaacaacagcatgccgcatgcgtggctgtctacatccccgggccgccggccgcaccacagcgtttcatctgtgcggtgtttgggcttcgatcttgaatactagcggcataccatgcctcaatggaacgaatcacgctgcctatatgtcccatccaattaaaagttgctatattttaatatggagggagtagaatggaggaagtgtcaagtgtcaaccagcttttcaaactaatcggggtagtcgttttcgttgaggactagcacaaacaactagagtggaaaataacggcgcatgagacaagctattactgggccgttttcgagaaaggctgctgatacttgtgctcaaatcggcccatcaggaatagtgcgtttggccgatgatgattcgacagttcttaaaaataaggaagatgatgtgagactttttttttaaccaataaagatgatgtgagtgagacagttgccagttgccacggatgaagcttgggattgggagtttccgaatttggtatcaataccgagctcacatacgtacgtggcgagggaccacagtgttgatacatacgtgcagtcattgctagtgctaacacaactcgcgatccacgagtcaacacacccatacatgcacgaactcaaccacaatcccatacatgcacgaactcaaccacaatgattaaatttcctagctaattaagccagacagctactgtgacgaccggctgcctgctcgtcctggtacgtacgttcacgtccaaccggtcggcctgatgtcacagtccagtacagatgtcggcctgatggaacgtcctctcgtacaatgcaacacaattgcaaatgtacagtgttgcattgcacgagagttcgttccatgcactggtaattcttaaatttgtaccatatatgcgtacgatcaatcgatcgatcctctcatcgacgacgtcccagcagtctcccatgcactcgtgtcgcgcgtgtaccgcggccacaccgtgtccgcgatccgcgccgcgacgatgcgctgcacgtcgccgtcgtcaccgatcaacacacggtgatccgctgctgctgccgccccgaacgttgactgatcgtactggccgaaacagtagtccatgtcggccatctgcgccgccgccgcctcgtccgccacgctctcgtccgcggcgctcggcgagtgtcccgccgcggacgccacgaacgccgcctctggggccgatgtcggccagatcaacggcggcggagcggctgcggcgcctcctccgctgatgaccgccgcgaggcacgtgacgatggcggcctcctcttcggcggcgctgccgccgccgccgacggcgtggggtaaaagaagacggctaaagaggccggcgccgttcatcgtcaggtccaacatttccgccggcggggaggaggacgactgtcgttgccggctcgtcgtcgtcggcgagctacctgcagtgttgggcgtgccgggaacagcttgcggctgctggcacgtgtgctcgttgaggtaggtgacaaggaacatgggcggctcgccggcgtcccgctgctgcacttgcttcttcgccgcgcaactccgctcgcggctgaacgtgcacttgaagtacaacctgcatgcgttaggtgacacgacgggatgagagtcctctatcataaatgttattatcaggatgtggattttcatctctcgaggaatattacctcgttgtctgcatgtcatctaaatagttatcaaatttttttaaaaaaaatagtaaatatattaatacgaaatatatcactccacaaacatataaaatcaaatttaacctatacatgttgcaacaaaaataacaagttagactaaaaatagttattgcacattcgcaactatattttttttatctttgttacaacttataacagttgaatttaaacttgcatgtttgtgaagtgatatattttatattaatctatgctgctatttttttatattttttatgaccatttaggtgacatgcactaaatgaggggttatcccttcaagggatgaaatcactttttcttattattttacacacatgtgtaatatcattgttacagaggacgtgaaccggcacgacgaagcataggtcaagttaaagaattaattcaagtgatttgttttggcaagtgtatggctaaaacatgccgcctaagtttttgtctagactttgaattatttgatcgaggagtacgtgtgtatgtacgtgtatgacgattgacgacgaaggttaaggttgaccatgttgacggcaaagtcaagtcactggactggacattgatatgctgcatgcatggatgcatttctgtaatattgaacttccagaaagcatgttctgatctgatgctagctatcaactgactcagtctgtagtccaatggactaaaacagctaggttaattactctgaaattgacttggacattgtgtgtgttgcagtgtatattggttaatgcttaccaaatctggaggttgacataacagttcttggtagtactttaggaatcatgtggtttaagttgtggttagttaaaattggtaaagtaccatgcatattctagcgaaacaagtagaaagtagaaactacactctacccaccttagataattgctgtcctgaatgttcttttgcccgtattttctccactggtagccatccttgtacggggaaggtgtaataatctccgtcctcgtaaccacctcttctctgccatttctgacaagaacctcttcactcctacagtagtattccatatatatcaatttgtcatcaacaaaagcaattatcgattcagaacatattgtaaacatcgataagaactcttctgtttacctaacgcgtttaaccctcgccggagtgtgcaagcaaatgctatcgtcagtcctcgtctccggcgccgtcctggtcactccttccggtcgtctgctgctgttgctgcaaggcttcagcatgtagagagacaccatgaacactcgcccgagctctctgctaacatcgacggcctccttctggccgcggctatcgagggggccttcgagcagcgcctggagcttggcgctgaggcggcggccgccggcgagctcccggtacagctgctctatggtatcttgaccaaatgccatcttaatttgagctgaaacttgaggcaccctagctagagcttttgacaaagtgagaaactgagaatcctttcaatttgcaacgcagaggagttgagcttgagtagctgcagtaggcagctttgaagctagctgctactccagtatttatagacaggccgacagtctgcatgcagtggtcatcagccttgcaattgtcagttttcttcagggatgctccaccagtttcagcatatataatttgggtctgactagctcaaaccctgttcattaattaatgttgatcattgatgtcaacggctgggcgattgatttattctggtcttctgaccgatggatcaatcgatagattatcttagatgggttgactggttaggctaagcttgtgctctctctcacggtacatacatattgaactggaaatttcggtctcttcatctggacgtcagttaagtatagttgacatatgaaatggtagtagtaatataaactacaatcctgtttattttattagtctactttgagcttgcaataaagtatgtggcgagcgatgcaatttttttcaaacgctcgtgtcagttgattttccaacttcactcccagaagagacgtcggacagtgactcccctgtgccataaaaactggacagcaacattgcgatgtcgaatgcatagtagaattcatagaaaaacaaggagtaggtccaaaggagaccggccttaattatgtgcctcaaaatctacagaaacatggtacatgtcaagtgatgtccatgtgcctatgaggatgtgtttagttcacgtcaaaattgaaagtttgattgaaattggaacgatgtgatggaaaagttaaaagtttgtatatgtagaaaagttttgatgtgatgtaaaagttgaaagttcaaagaaaaagttggacactaaaccatacctgaattctgaacatacagaaggtcaagtgatgctcagaaggagttaatttttcaccaacttgccgatcgatcgtctgatggtcaaggagagtgatctgtgcccttgaattgtagacctggagtcaactacagtgcctcaatttagaaatagtagagataatttaattcaatctccactcgcaattagaaacttctaacgactcgatctcaactgatctaagctcaaaggttaaatctgactgatctagcttctaaagttatatatgtgagatgctcctaatcgtacctaccagagtcaatgtccagttattttctttagcacaagtcaatgccccaatcataagacagaactgtgtcctagtttgctactatgattacgattccttgttttaagtatgtacgatccgtgtacatactccctccgtcctaaaaaaaaaagataaaccctgattttcatgtccaacatttgactgtcagtcttatttaaaaaaattatgaaaaaaattaaaaagacaagtcacgcataaaatatttatcatgttttatcatctaacaacaataaaaatacgaattataaaaaaaatttatataagacgaacagtcaaaattggacacggaaacccagggtttgccttttttttttggacggagggagtacaatacattattgattttggctgcagtagctcaagattcaagagtcaagatcatatggtgtagtgacctctaataagatagcctttttttttctttacgagacccacaccaatcaaaggactggtcctaccctaacatatttgggtgtattccggagagaacgttaagaacttctcccctcacacataaaactaggtgacttacatgattaactaagtattagcttaaatacttgaaaatggaatgatatgaatttttaaagcaacttttcaatagtttttatttttgcaaaaccatatcgtttagcactccggaaagcgtgagaacatgtagtataacacacccttaaaatatcaaatttgttcatccgctttcggagtgacttgctaagggcatgtacaaggtgagagagcatagcactagtttctttttaactcgtcgccgcataagggggtgctaagtgtctacagtggtggggaccgactgaaagtgaagtgtggcctgtaataagtgccaagtaaatatacaatgataagaaatcagaaaacaattttctctgaatgccaaatatatatttttaaacgaactataccaaacaatgagagttttatattaatataataggaaaaaagaatacaacactactatagcactagaataatcaggaaaacaaaaacaaaaaccaccactatactatacgctga

SEQ ID NO: 15027 - DNA, 2988 bp, Oryza sativa
ggatcgagcaccggggaaccaaaacaaggaaccaccacttaactaccgaccaacacacctccaaccagttaaaacaactagaccatctggacaaagcgataaggactacagaaggaaagcgcaatagagaagaaagactcactcgtccctcgtacacacccgtcgccgtccaaaatgttggtagggtcctgccatcgtcaacctccacaagccacggtccctcgtaagggccttcatccctccaccaaacagctgaactcctcctgggggagcgagcaataaccacaaaagctgccacacttggtgactgatgtagccatattccttcatgtccctatagcactagtagaaccctaagatgcgccaccaccctccagccagtgatctccttctaccacgcacacgtcgtggtcatcgctgcattgcactggtatattgcacgatgtgctccccggtcttgtgcacgttgtcttgtgctgctaatgtgcacaagacatttaaatgggtgttgttgctttccaacttcagcagcaacccctgagatgggaccccaagtgcacatcagcggcataagaggggaaacaattttggagcttaggaaatgggcatagccccatttagcttccggtcttaaaatggggactatttattgaagatgctataaaggagacaaaaaaaataaatcatgagcacttcatttcctttttcagcacggggagcgtaagcaccttttgtcattttggatctaaacactagggtggaaaaatggcaactttgtatttggcatttggcagtctggactagcaaatttcgccaaaaagtgcatagggacacggaccacccctcacggacgcgcaatacccccactcgctctctctctcttccgtcgcaccctctctctctctcgcccccaaaaaaatccccatccgcttgctccgcctcctccgccgatctcccccgcggctccgcctctttctcccttgctccgcctcctccttcgccgatctcccccgccgcaggcgctcacgcccgctccgcctcagccgtcgctcacgctcgcttccgactcccttgctccgccgttgatttcgcccgccgcaccaggtcacggcagcctcgacctctgccgatctcccccgccgcaccagtccggggtggagatggacggcgacggatacggcgatggctccggcacaagggacttcatgtcgcagtccgattcacacgccgaccacgacgagctcgacccctacaccgactccctgtactacactggatcccgcagcggcagtgcctccaggataggcatggccgccctcgacctcaactccggcggggatgggtggccggatttggggagctacgagggtcttctttgatccggctcgcaaggaggcgtcatcagcggaggagggggccacctttggggcggcgcacatggacgcggcgtcggcggatctgggagccaccatcgctccgcctcgcaaggaggcggctctgctgatctccctcccgtgcgtgctgtgagtcggacactgggcttacgctcggcccgccctgctccatgtggccgaggcgccacggcagctcgcgccaattcctcaccgtatggaggtggccgttcggcgcccgcggccggagccaggggccgtggtggtggtcgaggcacgcaggcgaccggagccaggggccgtggtggtcgtcgatccacatccacggctgccaccgtctctgaagtcaacttggacgtcgactccgacaacgtcgaagatgccgccgagctccaagaaattttccaaaatcatgggaaggtatgccgaccaaccatttcatcttcgtggctgtgctgctgtgatgtcctgtgattccctttgcttcaattttaccatttccatttcataaacctgtgctgtgctgtggtgtagtacgatgtagttgtgtgctgttgtgtggtgccctttgcttcatctgtgaccatatcataaagatgtgctgtggtgtgattaggtgtgattagtttggagattttaggagttatgttgccttgtgatttatataaccgagcaaaaaatttgtgattcaaaagtttatataggtgtgatatgtttatgtcttgcactctgattcctgtgatccagaagctatgttgcattgtggtttatgtctcctggactgtgatatgtttaggtttaatatacttgtgctttgtgatttgctctattaagttgtcataactgaagatgtatttgtttcccttaaatcgtgttaaatattttttgcttaccgttatgggtgggtttaggttaaacctgacagggccaattggacagaggacaataccagcttgctgtgtgaaatttgggttgaccagatcaataagggaaactgcgtgaatggactcatgcagaagactgggatgagggagattatcgctgcttatcatgcagcaaccaacctgcggcatggtagatcccaaattactaataggattaggcaactgaagggattgtggcaattcattcaaaccctacgcacaaacactggattcaatagaatatgactactgtagtgttgtaatatttgtgttgtatggacttttaaaattgtgcactgggacttttaatatgtatgtggacattttaatgtttctatgctatggacttttaataattatttggacatttttttgttgatatgctacgtacaattttgcgagctattgatacatttgaactatctggaaatggtcatttgggaactgttgatacatctgtgcactgtcaaattgtggcttgtaccagtaagagatgaatctcttgttttcaacttagcagcagcagcatcatcatttgcactaccctcacggccgcagcgcgcatcagcaatagcggcagcaacgacaagcagcagcagcggcaagcaacaagcagtacaagcatgagagagagagagagctacatgttttgtggggggggggggggggggaag

SEQ ID NO: 15028 - DNA, 6948 bp, Oryza sativa
  unsure (1)..(6948): unsure at all n locations
tccaaaccatacctgagcgcgtcccacgtcgagaacaggtcgcctccgtcgttcatcgtcgtcgtgagcggcggcgccgtcaacgcctcggctgccgtgaacgacgacggcgacgcggccgcggccgtggccggcagctggccgtcgggagggaacgcgtgcggctgctcgtgcagctgatggctgctactagaatcgaagctcagcatcatgaatggccttcttctcgctgtattttgctgctgtcgttctcgctcggtctgctgctgatgagcgccgccgccgccgncgncagcggaggagccgaacctgaggaggtacgcgtcgccggcggcgcccggcggcggctgctggccacgacgtcgggggtcgggacgggcgtggtgttgcaggtgtgctcgtacgtgtaggtgaccctgtacagtggcgggtcgtcgtcgttctcctgctgcaccagcttggaggcaaggcactgtctgtcctcacggtaagagcatctgtaatataacctgcgattccatttacagtacagatgcataagatttaaatgcatcttaagattaggatctcgccgcgcggttttaccacaaattaggttgattttgaactctgaacttttttaagtactagtacagttactattgttaatagtttgttgtagccaagtagcctactgctgaccatgcataatatttcaatggaaatcccaatatgcaagaaataaattgactaaaagctacttttagatgggattgctacattcacaacacacatatttttttcccaaaaacttttgtatgagaacttttagaaaaacgtctaccaggaaaacattcatccagaaagcttttattttgaaactttcatcaagaaaactttcatatgaaaactatcatctgaaaatgtgtgtgctaaattaaccataactttgctagatagtaatttcgagtttttgttgtttgactcctggtagcttaatattcccatctgtcaattttactcttcacttttttatagtaattcacagcaaatgaaacattctaaaatattataacaatttatttctataatatattctcatagtaaacaataaaagaacaacctagatgattgaaaccaacaagagcacatattatatcatttcttaatatgtcatttctcaatatgaacagaatgcatgacttaaaactttttacagctgatagtcaacagataaataatttaggttctatttagataatgactaatttaattacctagggaaagcagagtccttgatgttcttctggccatacttcctccacaaatgaccatcaaaatgaggtgtgaacgtatgtttcaccaatgatggtctatccttcctgcagcaatactccgtgtatacagttcaaatagaaaaagttagcaagtaattttacaatgttatgaaaataataaaacctgctatattaattaggatacatcaaaagtgacaatatatacttcctcggatcataaatatttatttcatgcaattgatttgcccataaaatttaaccattcatcttattcagaattttagtacaaatatataaaaatatatgttacgtttaaagtaactttaataataaaacaagtcacaagaaaataaaatataatatatattttttaaataagacaaatgattaatgtcaaatgtgtcaaatatttatgatcggaggaggtaatatagaaaaaaatgttccaatatacatgaataatatgcaaagaatcgcacatgactgataatatacaagaaaaagatacctcgagtacagaaatagttctacaggactaaattaataatgaacgatcgatgtttacatgaagttaaaaacaagcaccattacatatataattgctggcctaattaattatgtggccagatattgcaacatgcacgcttatatatatttgaaaaacataaccttgtcagttagttgttgtacaacactaatgactacttgcaaacaaagtcgcattataagtacaacatataacaaattaattatgtgtactatatatgtatatatatgtatgtagtatccagggtgtatttaccacgtactatatctgaacttagcgagattgaagtactgtgttagttgtttcgtgttagcatggcctctatatcaaaatcgactcagtgcaatcttatgacgcaacggtagtactaccaccgtttcacaatgtaagtcattctagcatttcccgcattcatattgatgttaatgaatttagatagatatatatgtctagattcattaacattaatatgaatgcatttcccgtattcatattgatgttaatgaatctagatagatatatatgtctagattcattaacattaatatgaatgttggaaatgctaaaatgacttacgttgtgaaacgaatggagtaagttcgaagcttagtcttttagtttttttttctcttgtttcttagttatgagatttaaaatttaagtattctttatcctttaagtactgtgtatatccccgattttttatccattgttaaaaagaagcatgcatatgggtgagttggatggcctccatcagagtaggacatgtacacgagacatgcatgttgaagggggcctagctagtagtagttgcttgatctccgttatttgcatgcatgcttatgtcaatgtctgggtcattagcttatttaaagggaaatggatctgaatctgttgataagttggtaaattaaatacgtaccccttctaaatgggttaccacctcccccgaacgcatgccatatgagacatgaagaatctagaataattaaagattcttttttcatcagacagattcagaaatgcttctctagcttttcatgtgatccatagtactgtggatctatggaaactagctggaatgtgagtatatatattagtggtgcccactttttattgacatgttgagaatagtggatgagccaggaccacaaaaataatctaataagaaggggcgcaaagcagtgctaattaacactgttcttaacattcctaacagtacacaaatttatatgattttaagatagaataatttcagccaaattcatgacttgtataataatggagcctagacacgaccgaggaacaatgaaatacatgctctcccaacctttttatcaacagttaagttgatattcgaacttgaatttgtttggacaataggttaattagctagatcagctgaaaatacacttatatatgcatggtagttttactgacgctctcgattcttttataaggatgaaaggcaacggtttcaagtgtactgtcaaaacgttcaaataatggggtataacttgtgaaaaatagcgactaatcttttgatgttgtcctttagaaatttttggtcggttttactatgcaatggcatggctatatatatcaccctttctttctttattttaatctcaacaaattcatcacattgatcttgatattgcatgttgcaagcatcattttttttgtgggagttgctacaataagctgggcggtttgttgtttgaatagaaattttgtgatccttaatatggaagcaaattaattaattcattatttcttacttacatatgattttcaaggcaacatatatatactaggcaaaatataggttgcaactgcttagaaattaaaagagaggggccgagagctgaggaactgcttagaaggtaatcatgcttttcccctacatattcatgtgttggcgaaaggtggtcatggtgtagccatgtagtgatcttggaattgcagctatggagttgtttgcaggttcgtcggatggaattttagaaaaaagaattgtagcttggtgttaagtttggtgtttgagaatctgaacttttgttaattatgtttaatgcttcctcgtgtgagggctagagtctagaactcgtttttattttgttgccgatgtacatccttctttgaaggatgtagagaccgggttgatatattcattaattatctgaaaatataagagtatggttcctgtgtgtgtgtgtgtgtatgctctgatcttctgacaaatgtcactgatatcttgctgtactaatatctagatttcaatctatatatcaagatcaaaatttaattgttggtgtgaatatatagtggctaaacactattcatgaatctttgtgaaataatgtgtgtgcaacgtacgcacttcagattgtcacatgcaaaaatattatgatcaatgaagcaatgccgtcagaaatgcccttttctcattcttaaaatgaaaaatggccagaattgaataagctctagtgttcacttacaaataggtgtagttcgagacaggattaatctgagtggatagagaaagagttaaacgtctcccgtaaataataaatggcttagtgttccacataactgatcaatatgtccttatctaatactatgagttaatttgatcaagtctacgcactagttcatacgtatgcgcttggtctctgaccgtgtacactcccccctggaagacttgtagtcaactcacactatgaagggtcctaattcccgattaataatgttcatgtccaaaaaagaaagaagtttaccagcataggaatatatatataaatgaaggatcaaaacattttgtttagaactaaggagtttcaatttgccattgcattaattgaggttgaggcttgaggacaacagaagaaaaactgtatcaaggatacataggtcaatagtaagaataagtcaaaacactaacacacaatactacacaagttgatcaggataacactgtatagttagggggatgggagtgtatgagaatgagaatcacaagtatgaataagttcatggatatatcttaaacttaactaggaaggagaaatggttagtggaactttatggatgctgcatgcatgaagtgatgaagatggactgccgacatgcatgtgcttgttactttcttgtttcctttaatttttacctcttttagaagaaaagtatatgcttgtgagtcataaaatactactaattgtggactattactgctaaggaaagaaacaaaggttggttcgatcagttggtaattcgatatatatatataacaaagaagattcgagacttctctatgtgcattctttgttttcttgttataagctagcatgcttaaaatgtgcaggaagagctccaatctagaactagtagtaaggtagggttctcaagcaattaatggagccctccactatggcaaagatgcatggacatatgttaagaaaatggaacaacatatgatcacttcgggttcctaagtgtcaaaaagaaatggtcttcattcaaaggaggagaatatgcatcttcttggtgaattatgaagaatgctgaaaatggctattagcatatatgtgatgtttgatgattttaatttattaatggcatgtccttttactgtagtgcagaatctcaatccaaacttgagcaaaacattatgccccccccccaaaaaaaaaaagcgtattaattttccgctttcacctcagctcatgaaatatagctagctcactcaaaagtaggacaactcaaaggaagaaattaagatcgatggaggaaagaaaaaccttgatagttggggtagtatgcatccatttaattggtttaatttttcaatctgtttgtttaatagtgcagacgagctagcgttatcaccctcaatcgtacaaggtttcgtcattctttttagtagtaattaaaccattaaattcaagttgcaatatagtacatactatctaccaaccccacatatagatcctaacattgcctgtttatgaccatgttaatgtttcttcctcctccttaatttccccaaaaatttccccatattggcataccacacagaagccagaaactataattcccattctccttaattttggcagactcaagaaacgaagaaaaagaaagggcaaacaggtacacacaactcaaatcagcaaagcgcagttaggatcagcggctccagaaattaatccattcaagacagcaagagaggtaaacaagaagtggttggagagaggcaaaatatatgaacgaatcgacgaaattaaacacgaagcaatcaaggagatacaggtactaattaccaaattaacatctgtgtgtgctagcttagctagctcgtgtagtatagtaccttctcttccggccgtcgcgcggcgaggactcccgcggcgagatgccaaagacgccgccgcccccgggagggctgtacgacgccgacgcggatcccacggcttcctgcgcgctcgcctcctcgaagtcgaacgactgctccctcttcagccgcggcgacgccattgattcttcaggccagctctctctctctctctctctctctctctctctctcgtcagctagaacaagagctaatgccttgcaagctagctagaagctgcaggcaaggggagtgggaaatggaggaggcagctgcgtcgctttcgagctgctcgccggagactttaactttgggaggggagcagggctatgcctacgcttaattagccacggcgtgcggtacaagcacggtcaatagtttatggtttggttttgttgtcaagtcaagaggcgttgctgggtcttttgatatgtttaatgtttacagatatacattagattcgagaggatgaatctgctgccccctcaaacaattaatcatgtgccctattatatgggcctcaagcattggccccctcttgatgacttctttttccccttaaattaacttaatttcttggtcagtatgcaattaggttgtgtgtatgtatgtatacatatatgtacatatatatgtatatgtatatgtatatgtatatatatgtatatatacatatatatatgtatgtatatgtatgtacatatatgtatatgtgtatatatatgtatatg

SEQ ID NO: 15029 - DNA, 18890 bp, Oryza sativa
  unsure (1)..(18890): unsure at all n locations
tagatgtatttgcaagttgggattacaatactggggaacgccatcgttagccaggatggtggaggctaccaatcccgagccactctcacgtttcggtgcagcctgcatgcagctaagcattttgctgcaaggtgctgaaagaaggctattttatcaggagaatttgtgaggaagacgattgtatatgatacatttatatcttgagggtttgctgatcttgtttaacacggtttagttgcattgccagcggaagtcactaccacagaacacctaataggtgccggttgggaatcccacaaaggtgccggatttcccaaccggcaccacgaaggcggcactgatgtgaagagaaacaggtgccggttcctaaaccggcacctttgtggttccacgagtaaaaaaaagccggctcgatgcatcgagcatgcaccttctccatccatagcaagaaaaaatcatcatccatccattccatatccatccacagcaagaacaaatcgttattcaattcaatccacaacacaaattacacgaactatttgcatgcatcagaggtaaagcaaaagaaaaaaaaaaacaaatcaagcacagcgcctcgcctgatccgaccacccccgagcaccggtgggagtggcggcgccggatccagccaccctcgagcgccggtggccggtgggaagcaccgaatctggaggagggcggcctgccccacgtcgtcatcgccccccagcttggatgtttcggtgaccgccgccgctaggtagcacgcgtcggcctccccttccctcggatctgatggaggggagggtgctgccgccgtgaggaggtgctcccgaggggaggtgagggcgtgcccacaggagaagactccgccgccgccgccaactcaggaaaggaggaggaggaggaggaagggaggagaggaggatgccggagaggggaggaggagggggacgatggaaagtggaggagagggagtcgacggagagggtgcgagagagagagagagaggtatgggagagaagagagacgagtggaggagaggataagggtcacgcactcgcgcacaatcttatccgagaggtcggcttgccagctcggctccgtttgatataggtgttaatttttaaataaaccgacacctataatattttatagtcggtttttaattaaccgatacctatagtgtattaaaggttcttatttttttgaaaaaccgacacctatagtatatataggtggcggttttattgtagaaccaacacatatattttggtaaaggtgttggtttttttattttcagtctatgggtggtggaaaaaacactataggtgccggttttagctgttccggcacctatagtgccgacttgtatgtgactttttgtattagtgatagtcttttccaacgaaatacaagtgtgagatctcatattgatataccaggaaaaaaacaagaccatagtattagctagaaggctatgatcgggaaaggaaacaaaaataacagtcacaccacacacctgcgacaaaattaattctttgagaaacaaacgtgagcacaacgccccaactacaccagactgtctccgtccatgcctttgggtttgagagggagagaacgagagacaagatggatccattctcccccacgcagacccgccaacataggcatcttgtggcagtcagaagcaccactgcaagataaacaaaagtctgaagaagagattggcttgggaatggtccttcgaaaacgagcctctaggaaggtcgcgacatcaaaaacgttcccgtcgcccactccggtaaaccaggatgtggttttcacctgaaggaaaacaccatgcgagagcaaggagccacaacaatgcccccaagaggtttacggtgcccaaaagcgtcgccgctgtcgacctcgatttaggccagtatttcgcctataaacatcctttccttgcatgtcgttttatccttgatgattctgtcaactgccaccaaatgaacaccttcagcgcatggttatcgtattggcgccccaccgcgagccaacccttgggaggatctatgacccacccgttgtctaactctggcgagtctttgacaagtcgggcaccaggacctcacccgcacatgatcggagcaaaagacccatgagctctactgctgccaacccacaccactgcccgtgccatcccaccgtcttcacgtcaccaccatcttacgccagtcgtcgttgtgaggctggatccaccgggtacagtctcctggtcaaccttcatcgcacgcgcctcgctccaactgtcttcgtcgcctccactgttgccttccctcttccctattgtcaggccgccaccctcccttgctggcatgtgcccgccgtcgtcgcctcgccggatccgagcagtggcggtctggatctaggtggcacagagccaccaccacttgagacgccctggtgtcccactcacgccagccagcgtcttcgggtttctgatcgacggccgctggaggctggacgctagaggccgccggaccgagcgggcgcaccacggtagatctgatcgacggctagttaattactggtgtggcgtgcgtgcacgctccattcggtagtgatcagcggagaaaccgagtgagagagttgcgcgcgcgcggtggaaatcaatcaacgtcgtacgccaccggtgcgccgtgcagatgtagtagtagctagcccagcgtacgtactatataccagccacatacgtcgcacgacacggcaggaagcgcgcccgtgggccaggtgcggtgcctggggaatttagggggttaattggaggagcctacgcgtcgggcgcccgattggagaggggaaaaatcgggcgctaacatcagcatgacatatgcgtgcaaaaccactttaaactattttttctcttaaattatttatccaaatcatgatccgattgcatcattaaattcattgcaattaatctttaaaacaagaccacacatggatatattccgatgaattttttttagcttattcttgaattatttttaaatgttgcacaatgttttaacaagtataccggaattgtttcactaagtagatcgaaaatgtttcaatcgtttaaatcgggtgttatttcgccttatatcaaaacaatgtttcagcaaatagcgaaatgatatttcggttcactgcaacatttgatccatacatagtgaaacattataagtacactaggtgaaacatttttggtggaacaaaaaataaaacgaattcccttaatagagggtttccaaaatatgtggatgatttgttgcaaaaaaatgtttcaattcattgcaacattagatctatacatagtgaaacattgtgagtacactaggtaaaatatttttgatggaacaaataatgaaacggattttctttatagagggtttctaaaatatgtggatgatttgttgcataagaatgtttcaattcactgcaacattagatctatacatagtgaaacattatgagtacactagatgaaacattttttgtagaacaaggggagggatatgtgggtgggcccgggggtgcacgcgtggaaggtagggaaagcgaccgattttctccctccccccagttgaccgattctaagcattatcggggttaattagttagggatgatcgatgcgggcatggcgcagccggggttggccgngtacatattattgccgatgcatcacaggcgtacggacttttttgaggatttaattggtctctctggcagagttgcatggtggtgcgcggctatggtatncgatcgatcaatgatcaatctatatccccgattgacaggacacgatcacacgattggtcggaacgtacgtggctagctgttttagtttagtgtcctaccaaattaccaataatatactacctttgtattttaatatataacgttgtcgacgttcgatgtcgcgattccggtatttgcatagtatggggatcgttggtactagaatatacgcgagactgaggtaaaagagatgagacagtgatttttatacaggttcggacccctgaattgtcaggtaataaccctacattctgttggctgaagccggtattgctcttattcaccataatcacaccagtacaatatttggggtagcctatctaactgttgtcgatatggcggtctgaagttctgactcgtagtcgacaacagggtagtcttcctcctcgagttcgtgcccggcgagatcaaagataacgctttcgtctctcctgacagtatccggagacaccgtaggggactagccgtgcttatccctaaagtcgatatccagcgtcttgtcttggcgtatgttggcttgtattggcttgtggcgtctatgttgtctgtgtcccctctcctcctagggggccttatatttatacccataggtgtccccttatctaagtagaactaggaaaaccaatatggatacaatccgagtagtacttgtcgtttctatgtagaactctggttgtctttccttatccggaactcctcctatatccgcaggttgttttcgtataggacatggtatgtggtgggtcctgccgagatttagtcaactactattaggtatgtggtatccataaccctgacaaacgtcgttgaatttttaataaatgtgtttgaccattcgtcttatttaattttattttgtaaatgtaaaaaaaattaagtcatgcttaaggaatatttgataataaatcaaatcacactaaaataaatggtaattacatttttttaataagatgaatggtcaaacgtattttaaaaaattaaccgcgtcatatattaaacaacggcgagaatacgtctttgataaattttaacactaccaatactcttaatcgtgtacgagcaaatgttttggttttggtaaatactattgtcaatccaaacatctagggtatatggtattttttaagttgttaaatatttatttagtaggtttattaggacatgttttgacataaaaaacagattaagacttaagttgattttttttaaggaatcgtctcctaagtagtacgagtatcttcctataaccaagcgaggaccgaacgacccggccatatatacattgatcagtttgtaataataaaagtgtatagtcatcgattgatgcacttgacccttatataaaacataggcaaaacgtatctgcagttctgtatacaagcgtacaattatatattcaaggaaattaatccaacttattgtcaaaggtgtgcgcatgcccgcgaaaggacccaggcgtttagttcacaccaaacttcccctaaactcttaactttccatcgtatcacatcacatctaaaatttttctactcacataaactcttaacttttttttcaaactaccaactttccccaaacttcttcccaatttcaaaaactaaacacagccctaattaattaagattaaatctgaagagtggacctagattaaaatagtacggctgctgcagattttaatatattggcacgcggttgcacgatcgatgtacttacttatgtacgttggctgttagccagctgcttagctgtcctgctagaaaatcattttccgaagataattttgcttatacggaacacatcctaggtgagaggcaagaaatactaacataacatgtggattcattgaatatagagtactcttgaatatataatgaatgctcatttttcagttgacaaatgcaaacctgcgacctgccgtattaggagagttgggttaacataagcaccttgtcagggcaatcactcgtcttatgctcacgtcatgctgatgtgtaagacccagctcgcgatcacctggccacttgattaacacactgcctgatggaatcaatcaggtggccataacccatgagctagcagagtatcatttggagaacatgtacagttcctaaggaatgtcaaatctattgcagaccatcgatagttcaataggtgtaccgcatatatttcagaatataaacaaactttcgaacgtgaatctaaactgcagtacatgtctaaatttatgtgaacgaatctatgaatatacacaagttgagataaagcgaatacttagaccacatcgaatatgctttggattaagattaactacgagtatacaaaatgagaaacctattagtttatgattaattgaactttaattattttaaacttaaaaaaggttttatatgatattttagagcaacttctatataaaaagttttcgcacaaaatatatatatttagaaatttaaaaaatgtgctaacgaaaaccgaggtgaaatatgtatctcagcgaagaaagaacgggaccttatttatttaccattcgcttttgattgtttttttattttattttctaaccgatggccggataggagctccaaaactaattataagtcggcataccggatttacataactcatctgcttacataccggatcatactccaacctctcagccataaaaaatttagaacttttttagataatgaacttaaataaaaccccggcatctacattccaagagattcagaactaataagacatactgttgttaggccctcgcgtcaccctccccctcgggcgacacgggaggtgactaggccgccgtcgccggcctctccctccctcctccgcctcgctgccgcccgagcggccgcaaggacggcggtagcggggcttcgctctcaccacgcaagggcaggggggctactcggcgtttgggacggcggaaccgtccagatccgtgccgtccggccggatctagcggggaggatgtcggcggcatcggcgtggtagtgcggtgtggcggcgacgtttggcaaaggtggcaccggcgcttggaagtgatgacagtggtagaagtgaccaccagatccgcgcctggatctggcaggtaagtggccggtggcggggtcttctgctggcgacggacggtggcgcccggtggcgcggtggcgggtgaggtccgactctgcgacggctggatctggccggacgacgagcatccagccgtcgctattggcgaccgaggcagtggctggcggcgacggtgcgacggcgcggaggctggtgaaggcacgtgcgatggtgcggaggccccggaaaccgtgacggtggcggaggggcaagaggccgcgctcgcagaggaggtggcaacatgcgcgggcgacggcgtgcggaggcgcaacaactggtggttgcggttggccggtgaggtcggctcggccggcagcccgcgacggcgaaggtggtgtcggctcgctgaaggagttgcggccggcaactgtccaacgcgtgtaggcttggccggcgacgtcgaggacggccggtgcgtgatggctgcgcagcgagaggtgatgtcggtgaagccagagcccggtgaggtggctgcatgcggagactggccgcggggggcgccggtgcagtgtacccacacaccggcagaggttttgatgccggtggagcaatggagctgtggtagattggtaggtggtggacggtgggtgaaaacccaacccgaccccggccggaccgacaaccgatgaccgatgatgctcaagtgtcattcccctcctgagggtgttgtcgtgccgtcttaccccttaagggtggttgctgggcgaaagcttagtctcggctctcttgagaccttggcggacggcgacggtggtgtttccgtcgttctctccttggagacgttgtctagacatccccttatcaaaaccacctgaacttttggcgcaaacgtgctctagatttcttcctcttgtggcggcatcctagtttctacaagttggccatggcagatggcctaggggggagaggtgttccatcttctctctcaccctctctctctctctctaaatcctgaagacgtggatagagttgagctttgtgttgtttgtaagggtaaggttttgagcgatctcggttgtttccgttgttggcttagcggcagtcggtctcacttagcggcggccggtctggtgctagtcttctccaatacttgtggttgaacgctatcgatatgtgagtggtggtatatttatttttcctggtgtgtaatcttgttttttttcctgttctattaatagaatttcgcaccgagtcgttcaaaaaataagacagactggcaacacttgccggggagcaatgctgagagcttggctgctgggatggggccaagaggttggagacacatctagtgacgactgacgagtacaagcatctactagtactttatttgatccaagttgctaagctaatctgattgctaacttagcttatcgactgggggctgcagaaaaagagcaaatatgattaaagctcaagtggcaaggtgtcgatgccgacgaggattagttaatggtcagtgtgacagcgcattggcaggtgctactttaaatctaattaagggaaaaccgcacgtgattttgggagcagggacaggttcccctggagaaaacgccagtggcaagtggcagcacgcataaacaaaatttgttgccctttctccaaatcctgccaaggatagttcaggcgcggatctagcggccattgcatcactggcctttgtgaccaggacaaagtcatggcggctcaaaaaccaagacagctaacaaaaaagaaatatagtaatgctcacttcttccctttaaaaaaatattatacaaaatatataatctaatatgaaatgtgatacattctaacattataaatctgaacagattctaggactatgaatctaggtagacctcttatcaaattcgtaataataggatgtcacatcccgtattatatttattttttatgagacgaagggagttcttgatattcctttgtcttcaaatataacattgttactccctctgttttacggatgaaaatggagcggatacggacggataatgctcgtatcatattcgttttcatattttttgtcggatacggaaaagaatacggatagctcgaatacggaaacaaatatggactatctcgaatacgaataagaatcgaatatgatcggacacgaatacggaaacaaatttttctcggaacacgaaaaccagttcaacttctaatagaaacaaatatcaacatatataattagctcattttatataaaatatagtataatttataaatatttttaaaattttaaataatattaataatgtggactagtgttaagagatgaactactattaaaatctaaaaaggtacattgaaggtcatagagttataaagaaatagggtatgtcttgtggcttctgtgcatatccgaatagcactgttcaccggatatctgaattattatccgtatccgacggaaaccctgataccatattcgtattcatatccgagagaaaatatccgtattcgtatccatactatccgagaattatccgatccgaaaggtatccgtatttgtttttatccgaagcggacggaaactatccgctccgttttcatccctactctatttcaatataaacaaatccatacaagatttgtttattttaaatcggagtgagtagatattatgtttaattatttattttattttaaaacttaatataaatatatgtaaaaatacaagtcaggtttaaaataccttaagtaataaaataacaagaaatgatacttagtttgtttagtaagacgaatactcgaatgccatacatacgatacttagtttgtttagtattcactccatttatatccattttatattataagtcgttttgatttttttttaatcaaactttttttaagtttgatcaagctcatagaaatatttgccaacatttataactctattagttttattaaaactaatagttaatatattttaataatatatatttctatttttttctataaacttagtaaaactaaaaaaaaagttgactagaaaaaatcaaaatcaaggtgatttatagtatgatgaaacggagggagtaagacgaatgctcaaatttcatatctagaagttaaccgcatcatatattactttacaatactgctcataataaatgctgattgtggcaccataattttttttactgaagattaacaagtatggtaatcaggaatcttaaatcaaagagcgattttaggagtataagagaaaactaaatcaaaacgttgctgcatatatgcagctatgcttaaagcttactgcacataccctcctttatcattcatatggtatatatagtatattaaatttagctaaaaaaagagctgtgcatatatacactagatcgacatgtatattttctgcaaaagtggatataatatactttcttttatgaaaagctagaccaaaagcaaagaccctttttagtatgccaatgaattaattccactcaaccagtgtgcgtggattctttgagccaagccaaatccagaggctcgacccagtggggatccagtactgaatccagcatgaagtccagtgtcaggtcgtcggacgccggcaacaattcaggcgaaatcgcatagctgcagctgtaatggtcgcttctggccaccgccggcggcggcctgtttaccggcaaagcagcggcgctattattaccagctgattctgcaatgtgacagcctctgatgacggtgagcagcgaggagacgatcacatccttctcttctttcatcgccatgttgtagccgccgctgcagcgaggaggaggagaatgcatcaggcgaggtgtttccacctctgcctttctcagtctttccgccgcctgtgcctttctcaaggaggcgtcggcaatctgctggatttgcatggaggaagccatgtaatcggaggcagaattgctggtgccgcatgtgtgctcgttggtgtagatcacccggaacaaaggcgggtcctccgagttgtgctgctccacgtgcttgctcgctggacagccatggtcctgatggtacgtgcacctgtagtagcacctgcatttgcaagcaataatatatgatgcttaattagtattacagttgtttagtgctcacttttgcattccttgaaggaagaatgctaagaaaagagggccgtcgacatgcatgtggtagccagaaactttgacacatgacaatatttggcattgtacaacacttatctcgtaattgtttaaccatgccgacatgcattattagccccaaaggagtattcccatgcaagcatgctttgggatagcacaatgtgggggatggtatccccaggtatgggatcgatacatacaccacatgcccccaacaccaaggggtctagtatatatcctcatcaaattgtatatatagtagttccagttaattaatgatggactatttacgtcttagtacatcatattatgaatcaaaacgtttagcctcaattagtgtatacaatataccgtggtctacattacataatcggcagggagcctgagacatgcaaatctagtttagttatcttgtcagacgggaaactgttttaacagttcgagtggacgtccacccgtttactgtatgtcatctaaatggctatgaaaaattgaaaaaatatgaataagatagatcaatatgtaatatatcaattcacaaacatgcaagttaaaattcaacttctacaaattgtaacaaaaatacaaacaaaactcaaattactatatgtatattaacaattaaatttgttatttttgttacaacttgtagaagttaaatttgactttgcatgtttgtggagtgatatattacatattgatctatcttgtcgatttgtttgaaaatttttcgaaacccatctattttgacatgcaataagacgggatagatggtccacttcgacctaactaagaatcccatcttcccaaaaccggtgcagttatgccctttcatgtgcacgccngtgtagagcatacaatgctctagaaataaaaaaaactaaaaaagaatgagatttggaaggagagatgtccctccaaatattttttttaagaataaattgtgagcatgttagagattgaacacgaggctttagagttgaatcaacacaccccttgccactacactatcaagtgtatctctaaaataaaaaaaaactaataaaggaacaattattgtctgatggtaagtgcatagcgcgcctgtgaattgatatttgcgttgggagcattccttcatttctctcagttcaagaggtttcagttaaaattatattgaataatatccccaaatcaaaatgtgatttgaaatatcatgcaaaaagctgaattaatcccatgataaaacccaagtcttccccaaaaaaagatgaattaatcccatgcaaaaagtgacccctatcagaaattgcggcagggtgtaaacaaattaagctgcttcccataaatgagtaataggcatctattataaaggaaaagaaatttaaactaatattcagacaacatggtctacggggtaggcaccgttatccagtaacaacttgaggattattcggagcaagaaattatatataaatttgattgtgtcgggtttaaattaaaatcataatatgattttcgccaagattgaattacttaggttctgatcgtttgtgctaactacggaagcacagccgtagttcatttttttttagtgtggatatatactgttgctgcagctgtaacgcagccacaagtagaacaaacatgttccttatacaacattgcaggtacaatgaaaccttcaactatccctgaaaattcccatggcatatattgctagtacatggatgttgcaccaattccttgttcgattcataagtatggtacgttagaaaatctatcatagcaaacaaaacaaatcaaaagcttggtgtaatcaaaggcaagttgagttggatcatttaaatatctaatcctcagttcgtgcatgttaattattaggaaactaataggcatcttttggactactaaacaacccccagtggagcacaggagagcatgtaccatgacaattctgtcgacgtattatagttcttggttctatttttccctatttggattattgtgcttcttagaagttgctcccattcaagcatgtgatttttggatacacgacagcctaaaggcaaacaatacaatgtgatgcgagggtagctactgggaagatggacggcacaatttaataaactgcacatgaacaagatatctttttgcttgaaacacacttcccattaaactatatatatgaatgcaaccagaaagccagctttccggatagacacaattattaagttccttaagccttcaaacgggattaatcacatgcacttaactaatatggaaaccttgcaatgagatcaatccaatgaacttaactgataagggaagcaccctatttacatacagtgtgtgtttcaatattattttgtattggtatacatgtgggtatgagttcgatcagttaagagttaaacaacaacctttataataattaaacaccctcatcatgcttataattaaggagcttatattatgtgaaatcctgaaccagagtgtaaattaaggagcttatatattatgtgaaatcctgaaccagagtgtagcccagctgggtcatctacatggattagttctactgagcctacaaatatctttttactacatttcacctttcattcttgcaatatagagagttcagtacaagctggttttccaacccatttgaattccttgcaagtgcataagcttacaattcgtctttgccatcaagtctgacactgtataaattacactagtggcatctactaccccattatccaacattttgattgttcaaaatttggccaattattccccataacagacaaatgttgattaaagaactacaggtaattgagtagtgcatgtaccttgggaaggagttgccccggatcatcttttgcccgtattttctccactggtacccatcatgatatggtgcatatgtgtactcagttcttgttccgatgcaaacctttctatttgaggaaattaacgctaattacttaaacatttaaataaatgcaccaaaagatcgaagaggaatattacatgcaataggaactaactacaaacatcgtttgcagcaagcaccaacgaccagacgaattcattagctccatcaatcgcaactcaattacaatttcatcgaaatacgcaacaattaagaattaactcagtttaagcgcgtgcaaaaccagtgaaatgaatggctagctattgttatacatatatatatgcatggattaacttacttcatagcgttctcctggtcatagctcctactgtcctgcagaagccttttatgggctcctctagaacattcactggagctgtccatgttgtcgctcctcttaaccatggtggtctcttgcaaccttctgaaacaggtcgacgtgatatgcaagttggtgcttgcaagataccttgaagttgctgaacgtcgatcagtcggattcccacagtaagtgctgaactcctcgccggcctgaaattaatggggatgatgagtttattctccttgtctagtgctgcggagaagtgtgcgactgtgcgctcatataaatcctctgcacaacctggagtaggtgcgtgctttgcttccagaattttaaattttaactcacacaacgcggtatctgcacttgcaaacttcactgacctatgcaacgtgatacgcatggacaatgttcaagtctcctgaggtgacaaatccagtcaaagaaacgatagccctacctgtcagtgataccagtatcaaggtttagccatgttccggagattctgatatatatcggtttatatgtgcacacatatagggggaaagaacactatatgtgtttatatattggattgatggatttgatatccaaacagtaacctgtcagtctgctgcaaacttatatatgaaaatgcctccagattggtttgattcaaaatttcaatttcaggtttgagaacaaacaggacctgaaaggttgagatgcaattagattagagacatgaacaggatctaattctaactttatatccaaaatttatatgtaggagtactacaaaatctaagtttaaccttctcggtttcttggttctcatcattgtttcgggaatatggttctcatcattgtggggacaacttattcttcctttttgcttttgaatagttaggtgtttgtttgtctaaaaaaaatagttaggtgtttgctttccttgtaggtacacaaataattaacacctatgtatatgtgtgcatatgaccacgtgaacacagggccccaaatactgggaatgtttagttacaaaagtagttcattaatacggagggagcaaagcttcaggcttaaggaaaacaattggtgatctacacaacttcagtggactagtagtattatgtctcctacaaatcaaggccgaatggttattattataagttaatagtccaatttattctaaaatataacaacttcaccaccaacattctcttcccaactaatcataatcctctaccattcaatttccccgcacacctccatttctcatcggatcataactctccctcatttaattctacctactttcttaataattgtgtacacccctaaaaatccttatattgggacagaggtagtatatatatattatctaggcaaaagtaatttactaatgcaaatggagctagcttcaggtgaaaaagaatggtactgtgtacatacaactacgatgaagtagtagtcctgtcctgtctcctaccaataaatcaaggctgaatggctattattatcagttatcagtttattgcataaaaacccgttttagctagcatgattcaatctaaataagtagaaggataatacaatattgttgtcgatagcattgatcatatagttaatactccaataaataaaacgaatcatattttagacacgacagctatcacaatactagatttcaattttataatggaactacactgtctgaactcttagatcttccttctcatacgttaggtttcatcacccaaaatgacattacaatatttagtattaacggtagtaagtacttcctccgtttcatattataagactttctagcattgttcacattcatatagatgctaatgaatctagacatatatgtgtatagattcattaacatctatatgaatgtgggcaatgctagaaagtcttataatatgaaatcgagggagtatttaacatcacatgggaaaaatgttaccaacacccaaaggtgaaatttgcaacagtgaaaagtaaagtggcaaattatttattttgatatttatctacataagtgcactgatgagcatgagctgattatcaattaaaaacagtgagcccacccatattgttcgttaactaaaaatgtatatattaagtgaaatgtgattcatattgtatggctggtgtgtggaaatttcttgatgtgggatctatgaccttttgaaaacagtatgcaaaggtaccactaatgaaacatatcctgggtagctgtcttcttcaatgtaccagtcatagtcaactatactctatttgaccatcttttgatcaatcaacagttagtgtgaagctcaagtaaaggattactcatttgtattgtcagcctttcgcttaaatcaatcataataacacggttcacactatttcaattatgtttgaatcccgagtcaaaaatgcaaagtagttaaaaattgtcctttcagggatcaggtgttcattgtatacaataaataggtccattcggatctcaattgatattacaatcagaatttttaatttttaaaaatgcaaaagcagaacagagggtgacagcatccttacatgtttcaggtgatgtgagcacggtgatgaagctaatacgagagtccatttcgaataagtcaaaagttgtacatcctgatcatgctttcagatagcttttctgaaaagagagccccaggaagtgggattgctgaattttgccgtacaactttcattgatgaccaacacggtatctccaaagtccagattgctactccacaatcaaaatacgagaaacttcccagcaagcagtacggagtaatcctctagcacaagtgacaaaccgacagttagaaactttcatggcacagggcaatcacacgatttgaaatacagtcaagtgacacatcattccacgagctcattggtaaatcgtcattgtttataccatgacagtatttgagatgatagcgattccatatatgattttcttaatttgagaagaaagtgattctatgattttctaaagaaaagaggtacagaagacgcaccattcctaaaataagctccacagtgcaacgcagaccatgactaactagatcagctccagggtgcagcatcttgcgggctaatctacatctgtttggacattgaaggcatacttcatcaagaagtttttgacaaagcgacaatattctgagttctgagcatcgtaaagtagtacaactgtaaactgtttgcagtacaactgtttggacatcatgaatttgtatgactagtaaagatttccattaaaaatgcagaaatttcacaagaaatttcagagaaacagttgaattcccacggagagatgaacattttcgcacctccaaaaacccctcaccacggacgaagcagtaataaaacacatagttcgttatcctcgatctcctgtttcctggtggcataagcatgacatggaaattccatctaggttttcagcatcaaccatcgatgctggctaacaacaatctctgggctaaaattttgggaatcgaagttgctaaagcggggcaagctttgggccagaaccggcaaggtcagtgctgggctaggctaaacagaactggaaccgagacggaggagtaagaacctgcaacaaggaaccccccccccccctcctgcggcggctgcattggccggtgcgccgcgcctgaacgatccccctcgtcgccggcgccgcatggattcccctcctccagccgcgtcctcgccatcgccttcctcccgacgaccccgtcggcgccccgccgcctcgccgtcttgcccgcgtagcgtatgtgggaaggattcgatggttggagatctcgtgggctctccttgcgctttattttggcccaccccgacgtgtgccacgccacgtcgcttatgatccagatgggctgaatctacttaaccggttggaccgtgagcccatatttagttggcatgggctatatgtttcttcttggtcatcgggcagtaacgtgtgccacgtcataaaaacgccatgtttttttttaaaaaaaaggagtagatttgtaaaggacgtaactatacagctagtgttagctaaaccagctaccactccatctaagaggcaccatccacctatacttcaaatacaattttctcttaaactactcatccgatctacgatcgattacaccgttgtgttcgtaacaattaaatctttacaacaagatctcacatgattatattttgatgaaaaatcacaaattacttttatgatatgtctaaattacttttagatttcactaagttactttttagatatataaaagtaaattcagtaaaacctaaaagtaatttacatatattatagaagtaacttagaacaaaacgaaggtaactttaacatgtcatttgaagtaaatccgttgtagagataaaaacatgactctatctataaattaaaataatcaacacaaattatggaattaactaaaataataataaaagtaatcacctcagagcattatgaatgtataggaagtatttgaaaaagtaactcatatatatatatgataatttgttcaatgaaaaaagaca

SEQ ID NO: 15030 - DNA, 803 bp, Oryza sativa
aattattacgaacacaacggtgtaatcggattgtaaatcggatgagtaatttaagagaaaactttatttgaagcatagatgataggaatatttcccctacttgctcaatcgattaatagcaaccaaaactcctaaagtactagcacgtgggtgtctctggttaagactaattggagaggcctctccaattagatttaccgatttggaaaactttgaaaccatatttttttaaaaaaaatattctaataaataaaattaaaaaaaatcccataatctgccgaatcgcaggcgaccttcgctacggaaaaaaattatgtgcagaccggctgcaaaacccgcaccgtgtatacccgacttagatgggcgacgcgtggacgggcgagcaatcccacggcgcccttgcgcggctccatccgctctaggagaaggctcaactcggctcgctcgtgtcgactcccacaaccaaaagcgcatcgagccgagcatgaggaatggacgggctcatcagcgcctcactcctgtccttttcttccacttttctttcccccgccgccgccgccgctgcgatttccttccctatctcgcctccatctatcgggatcgcctcttctcggtgccgtcagctagccgataatcccctccgttcaacaaccgatgacctctctgttaggttctctcgaattcactcaaaatagcacaggattatggcaattatattggttgtattgctccatttcaacaaaattgagcatccaccgccttagcctcctaattgccaaagccgttgttgttcgtattcgttt

SEQ ID NO: 15031 - DNA, 607 bp, Oryza sativa
tcagtacatgcaccaaacatgtccaaaagagagttgtaatagttctatatctatatataaaggtgcgggactgtgattaagagaccataccaacatggggctattagaggcttcgttgttagcatcaaattcagaaagaacatcaaaagcatgaagcttccaatctagagtttgagtaacaactactctcgtcacgcatacattcccgtgaacctgaaattgatgatgacaatttcaaattttatgaccaaagaacttccaacatacattgttttcgtgtgtcattacatgactttgcacaaataagaacatgcatttatattgactattgttcattatccgccattaacaaaataagagtaaaacatcatatcaacaaagttatacaagtacaaattctgaaatcaaatggtcaagaagaaatgacacagtataagctggctgattgtgatacttttctcatctggataaaaaagaatttggcatgtaaacaagaagatcctgacgataatttggttgtgcaatctaattccaagggtaacttatactaaatataaattgatatttttaaaattttaaaaatgagcaaattatgcccaccagaaat

SEQ ID NO: 15032 - DNA, 2205 bp, Oryza sativa
ctgtgcgtcatcttccttagtatgagtatcctcttagtgtgactgcagctcgccctcttcagttatatgctcttcttctccatcatgttcagtaagcttatcctactcttcttcagccagcttctcttcttcttcttcaagcgacatcatcgtcaggtggcacaggtggacgcctgacaatcccctctcctttgaaatggcttgtccacgagccattgctttaggaaactttgccttcagctcctccagatcttcccaggtggcttgttcagatgcagtacctgatcattgaattagcacttgcataatggttgaattattcttcctggtcaacctgtgatccagcacatgtaaaggatattgaggagtagaggagacataagataagtgagtttgcactggcttgtcaaatcccttggctggctttagcaatgagacatgaaaaagctgggtgaactctgcttccaacagggagaagaagcttgtaagcaactgtgccaatttttgagatgatctgatatggtccatagtacttgaaagctagtttgtgattagaacgaggggctactgagctttgcacataaggctgtagcttgaggtaaacccagtcacccactgcaaactccctgaaacttctctttttgtcagcaaagtatttcatttgttgttgtgctctattgagatgttgctgggccagttgttgtattgtggctctgtctttgagccaaacaaccaaatcaggaatggcacaatctctgaacccaatgttaaaatggcttggggggtagccatagaggatctcaaaaggtgtcttgttcagagaagaatgataagagcaattataccagaattcagtcaaatgtagccatgtggaccatttagtgggggcagaatgagtgaaacatctgagataaatttccaaatattgattgactctctcaatttgcccatctgactgaggatgatatgcagaagtaaagtgtagttttgtatcagacctgagaaaaagttgttcccacagaagactggtgaaaattttgtctttgtcagagacaatagtagtaggaagaccatgcaacttgaagatattagtcatgaatgctttagctaccataatagcagtaaaaggatggtggagtggaatgaaatgggcatatttggaatatctatccactaccaccagaatgctggtgtaagaatatgatcttggtagaccttcaataaagtccatggaaataacttaccaggcgcctgagggtacaggaagtggttgcaacaagccaggatacttggccctgtccggtttttcttgcaagcagatttgacacttctgcaattcttttaatcattttcttcatgccttggcaagcaaacagctgcttaatcctcctgtaagtaactgggaaaccagagtggcctcccactgggctggagtgcaattcagatataattttaagctgcaagggatagttagaaccaatccaaattctgttcttgtatttcaggagtccattctgcagagaatagtgttgtttggctgcagggttaagagttagagcagcaatcaactgagaagtaaaactgtcttgagtatacccttgttctacctcttgctgccaactgggtacacaagttgatacagcattaatttcttcttcagtgtcctgaaacttcctggacagggcattagctgcattgttggaactaccctttctgtagcaaatcttgtaactgaggccaagcaatttggtcaatgccctgtgttgccatggggtgtgcagtctttgatctgataaatgcatcaggctatgatgatcaatgagaatgacaaactccccatgctgcaaataggatctccagtgatctactgctaagagtatagccatgcactccttctcataagtcgatagccctctagttcttggacctaatgccttgcttagataagctatgggatgcccattttgagtcagcactgcaccaataccagaatcactggcgtcagtctccacagtgaagggtaattgaaaatttggtagggctaaaacaggtgcagaggagagtgccttcttgaggtcttgaaaagcttgttctgtctcagatgtccacttaaaagaaacatgcttcctgagtagctgagtaaggggtttagaaattaaaccaaaattcttcacaaatttgcggtaatatccagtgagtccaaga

SEQ ID NO: 15033 - DNA, 4681 bp, Oryza sativa
cagtcttgatttgccgctgaagagtgctctcgatcagatccactttggtattcatcgcctggaaagcttctccgatatcctcgacctttctctccacggctggaattctagattccaccatcttcttgagctccagatactccgccctagtgcgctcatccgccaccacgcgcttgttctcgttctcctccaccattttcagcagcagatccagcttgctgctatcctgcgccatctccgagtctcggtgttagggctagaccaaattccgctaacctaggggaggcaagttgccttttcgcgggattaatccgaagaaaaatcccaatcctccctcaggattttgcagcagaattcggtagaactagcacaacggggatgaggctctgataccagattgttaggttctctcgaattcactcaaatagcacaggattatggcaattatattggttgtattgctccaattcaacagaattgagcctccgccgccttcgcctccaaattgccaaagccgttgttcttcatgttcgtttcagtatttaacgatacaagccaactcccacacgcaactctctctcacgggtacaactcacgcacgccagttgtcacgccacccactttgcgccatggtactttgggttgggcttcttgggccttgctggacgtgtcttctgtgtgtcatcttccttagtctgagtatcctcctcgcgtgccaccagctcgccctcttcagttatctgctcttcttctccatcatcttcagtaagcttttcctcctcttcttcagccagcttctcttcttcttcttcagcgacatcatcgtcaggtggaacaggtggacacctgacactctctcgcctgctaccgtcgtcgccgcctcccctgtgttcccctccgcacgcctccctcctgactacgggcactgttggtgacggcggtggcggctgggtcaggtaaggtgagcacgaggcgtgtgccctctgcctccctcctggccacgggcaccgggcgtcttcggtgaaggccacagcggctgggttggcgaggacgagcagaaggctctggaagaaccggcatctggactgcaatgcaccgcgtcgccggaaatcgggtcaatgcaagtggagcaccattcaagcaactaagaaaagtagtagttgctatgtctgatcatttgcccgtgtctttctgtctttcatcaaaatgttggggtgttggtttctgcaattctgctattgtttaaccaaattagttcctcggacctcagtcttgctaaaagtgatggggtgtatgatgtatcgctcacacagtcacactgggtagactgtttgcagcaatgacaaaggcttatgaattagtatacggcatctttggtgttctgaaatctagaatgtgatgaattgatgtgtaaaaaagattgtgattgtttgtctgaggttcatttctgcaagatatattgggtacaggggtagcagcaatcctgaaagaacacagcattaccacaagcgcagttgtgagcagcgatcatagcagaccatctcttttatttggctttgttcaatatcatcgtttctggacgttcacatttatcatatttccatgttctagagaaaaagacaagcgtgcatggagtttctatgaaaaaaaaggtaaaaagaccgaatgaacgtacagatcttcagaaatgttcagaaacgtgcagtgcaaatgttcagaaatcaacacattgtttgcaggtcttgttgaatttgcacgcccaggctttgaattatgtatgcgctagtgcgatccatggccaaaaagaaagtctagcggaatgtgtttttcgccggcaacaggctgtgaattgcaatcagccaatcacttctatctctagataaccaagctcctctggtcgccggcgtctccggcagagatcttcccagccttgatcgacgccgacgagggggcagctacaaggggaacgatgtggatgaggacgagagagcttaattagaaaggcggcgccgcggcggcgacggcaaatgcggaaggaccgctgctctgcggagccgatagaggcgtgcgagccgaaccgagttagccgacgtctgtgtccaagtcacgccgcctggagccccgcggggagcgccgtccgatccaaatgtaatccacgtggcattcatccgggccagggctccacagccaccggtttgcatccggtctccaccaaaatttttttcctgctacccgctgtgtcccggtttcacggcagcatatcaaacttatccaggccactggttttcggatccaacggtgggtgtatctctagtacacgttaccgtgcatcgcagttgcaggcttgaagtgcaagcagacaggcagagcaattcccacatggagcaaaggaacaggaaaaatcatggtgtaccggccggcgcgggcggctctactccctacgtataaaaaactacggacctatttagattgtagccaaaataaatcctatcaaaatttagcaatttaataatattgttaagttttgacaaaatttcttatgtatttttcaaagtttgataaaaaaactaaatggatatatatatttgacaactttatcaaaatttggtaaggttcagtggtggatctagaacttttttttttagccgaggcaaacctaacaatagaaaacaaattaacacgtaaacacaaatacatgtagcattttatcatggatagaagtaaaattgagcgattagttaatgactgagtatgataattagtgctaatctaatggtgcaagtacagctaggctaatggctaagcaccatagttagttctaatgcttgaatgcatgcggcggagcccgggcgtctgcctgtgctggccggaccttggctccgccgctggtaaggtttatttcgtatacaatctaaaccggccctacatcaacctgatcgatgcatgccgtgtgcccatgtgcatcagcgagtttgcgcgagaaacctctaaaatgattttttagggataggtagggagctcctgcaatttcagtatagaagaagagagttgatccagtttataaggaaaatcgaaaaaaaaaacttaaactccataatgttttcgtttgcgtaacccaatcgtacgtctcacgtccgtcaaggtcaggaggaaaccggcacgatcttacgtgaaacagccaaacaggcggctgtacgtgctcggcttgttcgttcggttcgatgcagccagcagccagacctgtgcgcgcaaggttctcacgaaatcctttcgcgatgctgcaggaagacaagcagtgcactagtgaccgtacgtgtggctgtttcgcgtcgccacttgcttgctttcctagctacaacgtgaagttttgtacgctacctatctcctgttgggagacatacttgcatacatgagttacacgctcatactaacgacactattgatatttataaacgaaaaataatttataaataaaatttttatatttgtgttcttagcggtataaaagtaaatgctgaaaaataaactttgataaaaaaacccccaaaatcagctccaaatttaaggttgaaaattcaagaattggctgataaccataagcataaatgaaaagatgacacgcttgctcttccacttgccatcaaaattgttcgacatatccccaacgagcgatcgagaagacaaactccaccaaatactttctttgttttatattataagtcatttgactattttttaagtcaaacttagcaaagtttgactaaggcccagttctttttctcaactcctcgttttccgttaacatgctttttaaattattaaatggtgctttttgacaaaatgtttctacgtagaagttgtctaaggaattcaaataaacccatttttcaattttataataattaatacttaattaatcatatgctaatgagctttctcgttttgcgtgcgctgaaaatctgtctctcaactcagagatcgaaggggcttaagtttatagaaaagtttagcaacatctaaaatatcgatttagtttcactaaatctaacattaaatatgtgggactagctattcagctgtcgacagtttttaatagtgaaaactttcgaattttttgcacctcacaatctgcaatcaatgggccacacgaaacgggtctgaaccaactgaaagcacgaaaccaatccgtttagagcgtgcagacctgttaagaaaccctgaactaacttgtcagggttatgaataccacatacctaatagtagttgactaaatctcggcaggacccaccacataccatgtcctatacagaaacaacttgcggatataggaggagctccggataagaaaagacaaccagagttctacgtggaaacgacaaggactacttggattgtatccatattggtttccctagttctacttggacaaggggacacctatgggtatacatacaagaccccgtaggaggagaggaacacggacaacatacacgccacaaagcctcaagccaacatactgccaagacaacccgtcgtatatcgacatcagatatatgcctggatcgaccctatctggtacctacagaggccggccagtagggatctagcgttgtctatgatctcgctgggcacaaactcgagcaggaaggctaccctgttgtcgactacgagtcagaccttc

SEQ ID NO: 15034 - DNA, 2404 bp, Oryza sativa
gatctagcgttgtctatgatctcgctgggcacaaactcgagaagaaagattatcctgtagtggactactagtcagacattcaggccgctcatatcgacaacagttagatagggttcttcaaatattgacctggtgtgattatggtgaataagagcaatattgtctcgggccaacatgatatagggttatgacctgacaatttaagggaccgaccctgtataagaaccctcgtccccatctcttttacagcagtcttgcatataccttaatatcacagatgtacatactatgcaaataccagattcgcgacatcaactgtcgacataacccattttaaattagcacactgtaactagtctataagttctatgtaactgtaatataattaaacttattttgcatagcgcaataaaaaattaatgctctatgtgtagatgataattgacggtgactgtgcaaccaaacaaatatatcacatataagcaacagtgcaaccaaacaaatctctcacgaatcatggcgccagatcgaacggccagaaaatcgaatgtttccggcattcaaaactgttaacagctagctagcaaaaccatgaatatattttgataatatatttgttttgttgaaaatattactatatttttctataaactttgttaaactctaaaaagcttaactaaaatgttaaacaatttataatataaaacggaaaaattactatcttggtcataaaatggtactgatcgatagaatattttttagcataacaaattcggacagtgagtaatattttaggacgaagaaaatactgacacaagtcaaaatccaactcccatcccacctacccagccaccaacaaaccctttttttgcttttttaccatggtagtatcacctaagagcaggtacaatagtaggctataagccagctataaacatattttaaaaagataaaaaaagagagagaaaagcagcgggctacagatctgcagctggctgcagtacggactccaagacataatgtgtgtatgacagatgggaccaggtactaatagtatagtaagcaattattgtataaattagctattacattgactatagatattttggagctcatagtgagctatacgagctcactatgagctctaaggcttcgttcgttcttgggcgatctgggggattgagagagaaaagcatctcgttttccgcgcgcacgcttcccaaactactaaacagtgtgtttttttttaaaaaaaattatataggaaaattgctttaaaaaatcatattaatccatttttgaagtttaaaatagttaatactcaattaatcatatgctaatggctcacctcgtttcgcgtatcttcccaatctccccaatccctttctcctcaaacacaccctaagagcacccacgatggttatctataggctctctacaagatatctatatcagcatattttcctacttgaaagagattaaatgaagaaagagagcaaagctatctactaacttagagatagtctatagagaaaaacgaggcaatgcattagagagctatagatacccatatagacatactattgaggtggtttactattaatctaatctattgctgagatgtacatgttttataaaaagcacattcctttaccattgcgagtgctctagaggaccaacaactctagccagaaatatgaagaggactggacaatgaagccttgcaggccacaggatttccacgcactcgcacaccgtccaccgtgcgtgtactgccgcgcgcttgcacgctgcagcaccaccaccatggctcactcacctaacgccgtcacagttcacgtcgtttctcaagatcaccaaatgttattagatcattcataatgcgcggacgtgtcgttgagcgctaggaacggaatatccgacgtcacgtcctctgtcagcgttgccccgtaaagaacacggagccaaaactgatcacccattcttcggcctgaccgaggggaaaggggcacagctccacgttgtggaggtcggagcctcgccactcgtggctttgcgtaggcgtccacgcaccttttcccctcccgtgctttcctttctctcgtgcaagagcggtggaaaggagaacgagaacggcaggctggcaacacaagatggcagtggaagcgagaacaagcatcgggagagaagaggagcctactagggtctgtctgccgtcgcccacccgcccgccgctgaggccactcaaccacgttgccggcaagccgccaaagcggtgtcgatttgtccgccaaatccgccgccaaggccactcaacacgaaagtggccaggagaggagggcccgccgttggggagatgatgaggagcgctggccgtgggaggagacggggtttccgggtgcac

SEQ ID NO: 15035 - DNA, 6393 bp, Oryza sativa
caacaaaacggtgttgttgaaaggaaaaatcgtgttttggttgagatggctagaacgatgttggatgaatataaaactcctagaaaattttgggctgaggctattaacactgcttgttatatttcaaatcgggttttcttgagatctaaacttggaaaaacttcttatgaacttcgatttggtcatcaacccaaagtttcacatttgcgtgtttttggttgcaagtgctttgtcttgaaatctagaaatttggataagtttgaggcacgttctaccgatggattgtttcttggttaccccgcacatactcgtgactatcgtgtacttattttggggactaacaaaatcgtggagacttgtgaagtttcttttgatgaggctagtcccggtactagacatgaaatcgcaggtacactgtcacaggttcaggaggaggatggtcgtatttttgaagacgagagcgactacgacgacgacaacgaggtcggctcggccggtcagaccgggcgccaggccggtcagaccgccggcacaccttcggtcaaaccggcgcatgacgtgcggtcagaccggccagggtcgtcggctgagggatctgttgatgctgatcgagatggtcctccggagattacaacttcgaccagtacggatacagaacgtggatcaacttcagaagttgctgctcctttgcacattcaacgacgacatccaccggaacaaattattggtaatataggtgagcggactacaaggtctaaggtaaggactcatgatgtttgtgcaaattctgcatgtgttgcttcttttgaacccaaagatgtgtcacatgcattaactgatgaatcgtggattaacgccatgcatgaagaacttgaaaattttgagagaaataaagtttggactttagttgaaccaccttctggacataacattattggaaccaagtgggttttcaaaaataaacaaaatgaggatggtttgattgtgagaaataaagctagacttgttgctcaaggttttactcaagttgagggtttggattttgatgaaacttttgctcctgttactagaattgaggcaattagacttttgttggctttgctgcttcaaaaggttttaatttgtatcaaatggatgtgaaaagtgcttttctaaatggttttatacaggagaaagtttatgtcaaacaaccaccaggttttgaaaatcctgatttttccaaccatgtttttaaattgtctaaagctttgtatggtttgaaacaagctcctagggcatgatatgataggcttaagaactttttgcttgcgaaaggttttataatgggaaaggttgacaaaacgctttttgttcttaagcatggtgataatcaactgttcgttcagatttatgtggatgatatcatctttggttgtttgactcacgctttggttgtagattttgctgagactatgcgcagggaatttgagatgagcatgatggatgagttatcgtactttttgggattgcaaattaagcaaacacctcaaggtacttttgtgcatcaaacgaagtatacgaatgatcttttgagacggttcaagatggagaattgcaagcaaatttctacacctattggttctacagctgtgttggatcctgatgaagatgaagctgttgatcaaaaggagtatagaagtatgattggatctttgttgtatctaactgcttctaggccagacatagaatttgctgtgtgtttgtgtgcgtgctttcaagcttctcctcgtgcttcacatagtcaagcggtcaaccgaataatgaggtatttgaatcatacacttgagtttggaatttggtattctacttcatcttctatatgcttaagtggatattcagatgctgattttggaggttgttgaattgataggaaaagtactagtggaacatgtcattttcttggtacatcattgattgcatggtcttctaggaaacaatttagtgttgctcaatcaattgctgaatctgaatatgttgctgctgctagttgttgttcacagattctttggcttttatctactttgaaagattatggttttaattttgagaaagtacctctcttttgtgataatactagtgctatcaatattgctaagaatcttgttcaacactcacgcacaaagcacattgatattcgctttcactttttgagggatgatgttgagaaaggagatgttgtattgcagtttttggacaccaagttgcaaattgctgatattttcactaaacctttggattctaatctctttgcttttctttgtggtgaattgggcgtaattcatccttttggcatggtttgagggggagtttgtacctcatggttttatcaagcaataatatgacaatgagaaaaaaatgagaaaagagagctttgttagcagtatgttgaaggtttatttgtctctagcatagtgtcacgcccagaaattcacaagtaatttctgaactaatttgtgcattaaaaccctcgtccaggaatcagccgaggaacacaaactgacaatttaatatacagattcatcaaaataactaaaatgatttatggcttgagtcttgtaattagtgtggaggtcatcaatagcatccaaccttgtagtcatctgcaccatagtttgattctctcctccccgactatgtgcacaaatcatccaaaaatcatcaccatgttttagatggtagtgatatataggattctcgagacgatccttgagatgatgccggagacgacacaaagcttcgtaaacaactccttcacaagcatagaagaaacaattggcctcactagtaaatgatagttggagaagatcttccttgtcaaaaacgagagtaccggttgtcttgcaatgcaattggtctccaacttgaatagatactttagtcctttagaaaaatgccttgctttcttgtgttgctcctctcactaatctgaccaatcttcttgggcacatcaccccagatttcatcaaagcgtgccatcatattttccaacctctccttgtagggattcatctaaagcaagttgaaagacggggaagggaggatgggaaaagcttttgcaaggagcaatgggataaggaggaaaacaaacttttgcaaatagatttttgtttttgcaaagactcgtccttatgggtttaaccgtttggcttgacctacagtcgagatggctctgataccaacttgtcacgcccagaaattcacaagtaattcctgaactaatttgtgcattaaaatcctcgtccaggaatcaaccgaggaacacaaactgacaatttaatatacagattcatcaaaataactaaaatgataaatacttacataagaggcacttagtcctcaccatgaagaaaactgcagcggaaaataaaatctagcgaagcttcagctccactcccacagacagcgcaactgggatctaagccaaaggtctgctccttctggatcctttttcttcaactgaggtttgataattattgcaagaatgagcatatgacatactcaacaagccacacagcaaatatgcaagtgcacaaggataccaaaggatggcataatataggctcatttgcgaaagcagcatttagcaaagatttaagagaagtaaaacagtagagtaattaatcatcaattttaatcaacactgaacagcaccccaatgctgcacaggcccaaccaaacctgaacaaccaaccccgatcgtacagatcaaacctccaaaccaggaattatccattccaaactaggagtcaagttaattatcacattattaccattaatgagtagtgtgggactaatcacgaaaaacattgttagacccgcccataaccgcgggcacggctattcgaatagttttactctggccagagatgtaccactgtacccacaagacacgattccacacttgttgccatgccctaaagtaccaccacagcactgcaaaggaggaaattagtgacaatacccttcgcacaacacaactcaccataatgcaccattcctggatcataatcaccccctcaaaaaccagaggcatggactccccagcgacccccacggacttctcgctgcttctcagtctggcaccccgtaatgaactatgctatacaaaaggtaaagccgttgcccacgctagcttgtggttggcacggttaatgtctcacaatagtagctcgcgaaccggtccttaattgtcatgagcacgaccttcaaaaccatgtgctcacaatccaccattaatcatattttaattatcaattaattatcataacacgattgaccatcgtgagctaccattcaatataaccataagtaataatgtagtatatatgattcatcccattaatgagctaatgtttctaagcatggctaagcaattatatatatatatatagcatttagctgaaccaatccaatctataaggtccaaactaatcaaattataacccataggaaaataaagtcatcttcggccataatcaaatcggaaggctcaccacccgatgacattcgaaaataatgcatacgttgaaataaaacaatagctttaaatgggttcaacatgctcaaagggttgtttgggatctgtgtgacttgccttgcaaacaagcatcttcaattcatcttcaagaacttctccaacgatcgaacgatcctccgaaacaacggaaaactaaacctagaacgcaaaacgagaaaaaacactaataaaaaccaaataaacagtacaattaaagttcataaataggtagatcttgaatttagatgaattatgagacttgaacgacctcattccgagttcgtatgaattagatatgaattttagaagatttaattccaattaaacctattaaagaaaagactattccaaattgattaaacaatttacaaatgacttatagctgagtcaaaagattaaaaccggaaatagattagatcatatttggtagatgacatatattaaaaaggaataatatgccattgaaaagaaagaacggatttatatcgattttggacggctgagattaatctcgaccgagtcgaccaagatcggatggcttggattgacacacagcagcggcacaacagcggttgcggtggcacacctacagcagcagcgcgacggcgacgtacaacgactaaacaacgacgtggcggcaacaaggcagctagcgcagcggtgacgctagggcaacagctagcgacacagcaacggctgcgctagggttagagcaacagcggcggtgacacgaccgagggattgaaacctaacccgaggggacacggatagaagtctcaccgaaccaaagcgaccggagagggagggtcgacgatgacgatccggcgacacacatggaaacgatgacgacgctagggccaaacaacagattagattagattagattaaatccctagggataaattacaccggtaaacgacatgggagagaggagagctcaccggagaagacgacggcgacgaccaagatgacgacggcgaggggtgacggctagcggcagcggcgactagggcagcggcggctaaacaggaggaggaggctaggggcggctgaaaaaaaacaggaaaaagatggggaggggtcggcttaaataggggaagattgaataggattaggtgggccaagggaagcacgagaaagggggagagggagggactcggaggggagagggcagggtaggcgtgcacggctgggagaggccgagagggggaggggaaaagatatgggaggaggggttgcctagaaaggaaaggtgggggaaacagatgcggtgccgttttgggaaaggaaaaggaaacgataccggaaagagaataagactcggctcttcatacaaaacgaaatcgtggcggcaaagaggtcagcggatacaacgaacctcagacagggagagtgaaccgggaatgattcacaaccaaaggaggaaaaagaaagaattattaattacttttccaattaaattaatcactgaatgatctttcatttattaaaaatacttccaatgctcaaataattctgggaaaaatccagaaaatacttggacattaaaaatatttaatacaattttatctatatcaacttaatgttcaaaattttcatagattttattcacacacttgctttaatcattaaataatttctaaaaattcctttttcacaacgttttataatttagcgatttcagggtgtgacacatagcttgtatgtattctagtcttttcatgagatttagattttgcttttaagggagatgatgcatgacatctaaattctacttgaattaagaaaatatgcaatgttgatgctagcatatggtttgatctataaatgctatatat

SEQ ID NO: 15036 - DNA, 59965 bp, Oryza sativa
  unsure (1)..(59965): unsure at all n locations
nnnnnnnnnnnnnnnnnnnnnnnnnnnnnnnnnnnnnnnnnnnnnnnnnnnnnnnnnnnnnnnnnnnntttattactttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggatatgaaaaagaaacacgctatgtctttgcctccaattactaactatttgcaggaagtgcgtaatcacgaaaaggaggagagagatatgaaagagccaccaattccactgttcacactcaagttcgagacacctccatcatctaaagaggacatccaaggtaaagtaaatggtactgaaattaatcaaggtgagtgcattgttaacgaagtaaatttgtccacttttcatgcaaaagtagagcaaccgttagtggaaccaaatgctggaattcttttgtcacaagttgatttactcgctgttcctggtgataaagaaaagttgtgtgataatgcttcacttatatccatgccacaactagtgaatgaacatgctattcctagtgtttccttgtgtgctaattttaagcatgctgttcatattgttaatgaagttgaggaacgtaaattgctatcttctttaaatactttgggctatgttcagtttgatgattttggtgagctcgataatttgaaggagaaattatttgctaagtatgatttgccatgtctaactaatgctatttttcatatctttggcaaatataatgatagaggaatatatttggtgcatagagttttcatttgtttggatttagagaaacatgttattgctaatcacactatttcgagtttctctagttttgattggatgaaacaggttattttgaatggactatatgaagaacaccatatggaaaaaccgaggacggttttccgtgaagaaggggaggatgatgtgaccatggctactacggatacatccgttgctcacatcatagatgaacaacaagatatcaagttcgagtcctccaagtgccaaaatccaattcggccacctgctacactgcagacttcaaacggccgccgaagctccatacgacctccgttttcaggccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagttaccccttcagggtttcttgggttttgtttagatgaaagtttagccattgctacttcgcttgcagcgcgcgtgtcggctagaccgtccgtctgcttgtattcgaaaccccaacttatcatttgtattaaattcctatttgcagtatcagattgcttttatcttgttcttgcttgtttcttcgatttgcttgcaggaatagggttgatctgcactggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgagaggaactcaaggttcatcaatctccctctctctccccctcggcccaagctgagccgcccactcgcgcgtgcgcgtgttcgcccgctgacaggtggggcccgcttgtcggggtcgtcgtcttcctcgcgccgaaaccctagccgcgccgcaccgccgccgcctttccaattcggccgcacctttcccgatccggtgaaatcgattgaggggaaatgcttcccgagatctcctctacctttttccttttggaatctatcgctatttcgctttggaaatcgccggattcgagctcgaatcggattcgtttctttccctttaaccctaacctttccatcgcatcgccgaccgccgtgggccttcgccgtcgcttcctagcctctataaaagggatccctaggcccttcgctacccgtcgccaccctcgctttcgcctctcgtcgctggtagagccctagcgccgtgccgcttagcgccgccgttcgtccagccgtgcgccgccgtcgctctggtcgtcgctcggggaagccatcgccgggttcgccaagtcgtcaccgtcccagtcccgccctccgttttcaccgaggatcgtcggagcaccgccgtcgtcgtcgacccgatcgtcgccgccgcttctaccttgacgccgatgccgtccgttgatcttccgccgttgatttggtcaccggtgagttcgccgcgtcgcccgcatcgttttggtgcccttcgttagcgctgtcgtgccgtagttcaccggcgagcttgcgccgtccggtcatcgccggtgatgacgtcatcgccgacgtcatcgtcgccgtgtctcgtgcaccggtcgtgggccgatggatcctggccgtccgttgtggataggatagatctcggccgttcgttccgtgagccgcagccgtgcgcccggtccaccgtgcacccgaacccgctgacgcaataatcctcttttccttttcaaaaataattctttattgcgtcataattcaattaaaatccatataaatgctttaatccggtttaatatttaaaaattcataactaattcattgtaactcggtttaatgtggttccagttgcaaaagttgaataaaataaagatctacatattaaaattatccataaattgaattaaatttatttaatcctttttaaataggctgtaattagatttaatcttgtaaaattcgtaataaattcatatgaagtcagaatgaggctgttcaagtctcatgtttgtttactttatatgtattgtttatttagtttttattagtctttttcctcgttttgcgtgttagcttgtcgtttccgtcgtttcgaaggttcgcgagtgcgccggaagtgttcaagaagattaattgaagacccgttattacaaggcaagtcacacagatcctaaacacaattcctttgagcatgttgatcctatatttaaattctctatttgtttcaactgtgcatttattttttaatgtcaccgggtggtgtgaacttattcctttgttatggcctgtttgcattgattactctattccttgataccttgtgttattataatttgactagttgagctttatatattggttcagctagatgttagacataattgcttagccatgcttagaaacattagcacacaattgggataactaatgcttcactattatttaatgatggcttaatgatagctcacaatggtcaatcgtgattggttgattaattaatgtgccaactaaaacttgataatggtgggttgtgagcacatggttttgatgatagtgctcatgacaattaaggaccggttcatgattttcggttgtgaatcatttaccgtgccaaccacaagccagaatgggcaacggctggacactttgtataacaaggctcactgcggagcaccagactgagaagtggcggagataagcccacgggggtcgctggggagtccatgccttgtttaagagggtgattatgatccaggaacggtgcactgctttgggttgtgttatgcgaggggtcttgtcacaatcactcaacatggtgacgtgtctggccgggcacggtaacatgctggtgggttgtgtcttgtgggtacaatggtacacctctggccagagtaaaacaattcgaatagccgtgcccgcggttatgggcgggtcgaacaatgtctttcgtgattagtcccacactactcattaataataatgtggtaattgatggtaattaatttagctcctggtttggaatggtacattcctggtttggagataaatctgtgcagccgggtatggttgttcaggatggttgggcctgtgcagcatgggtgtgctgttcagagttgattaatattgatgattaattactctactgttttacaatttttactatttgctaaatgcttcttttgcaaatgaaccctatattatgccattctttggtatccttgtgcacttgcatatttgctgtgtggcttgctgagtatgtcatatgctcaccttgctataatcaatcaaacctcagttgaaaacaagttgcgaaggagaagacgtttggcttataccccagttgagctgcctgtgggagtggagccggagcttcgctagaccgtaattccactgcagttttcttttcttttgtaagtatgtaacgttattatattgatgaatctttatattaaattgtcagtttgtgtacctcggcttattcctggacgaggatttaatgcaaaaattagttcggaaattactagtgaatttttgggcgtgacatagctaccggaaagtccaggccacccgcccgaagtgtctgacccaccgattggatcgccaatcgctttcgccgccatcaacccgagcaccacgtctggtcgtctccctgttgattgcagccatcgaacggtttagaccgccgcctgaagtgtccgattccaccgatcaaaattccgttgatcgccgccatgctccaccttgcgtccatgtctgtccctggacaccccgtgtagtcgtcgcggcgtggagcacctccctcgcacctctaccatggatctcccgtaggctctgataccacttgttataaaactggccttgaaatcacatcggaaaccaaacgcggaagaaacgctataggagatccaaacatgatgacgacaccgaggcacgatatttgataacggacttcagccgaggcctacatctccggggcactgattacgggcgctcctgtaacgccccgattttcgttcgggattaaaaatcatttaataatccatttcctagaaattaaataaaagttaaatcaattcaatcaagtgaaattattgggagagttaaaattttcctttaaaaatcattggtcgggaatattttgtaatattccttctgccctaaaatactcggagctcaagaagtaattataataatacaaagttcatttaatcaactgaattaaaaagaaaacaagttaaaatctccctttctttgtctttgggccgccccggcccaattccccttttccctcccatggcccgcgccctctctctctctcggttagcctcccactcctctcttgggccgtcggcccgtttccccactccctcacgaagtctgctttgcctccaccttccaactatccctccctctgtccccgacaggtgggacccgtggaccctacctgtcatctcctacctccggctcccctctcccaacggccatggccgccccgtgctccccacatcgccgccaatcccgcacgccccgcgttcaaatccgtgcggacgtggttaccgcccactcctccaccccttccccctcttctcccctccaaaaccgccgctgaactgccccacttcaccacgtcgccggagcccaccccatcgtcggttgccgcctctcccgggatcgatcccgccttcccgagcctataaaagggatccccgggctctcctcttccgtttcctcctcctccccgagctccccgcgctctctcccactttccccacgcgagcccaagcgccgccgctcgccggcgaccctccaaccggccgccaccgctgctcctgccgccgccgctccgcacgaccgccaccaacgtcttcgccacgtcgtgccgtaacccagcatcccctccacttccccattttgtcgccggaaccacctccccacggtgctcccactccccaccactcaccggcgtgctccagccgccgcctcccgccgcactagccaccaccgagccgcgatgacaccaccatcggcatcgccgtgccgatctccaccccggcccctactacattttcccattccgtctccggaacgccgccgccacgcgcaccacctctcttcgtcgccattgccacctccagccgcgtcacaatgccgctttggtccacgccgacccacgccgtcgcctcccttggcttcgcaaggacggggagatcctcggccactggccctcttcgccggaaatccgctcgagctccacccccctcggtcaccggtgagatcctcctaaaattgtcgtggtcggtagtcgtttccggttacctcgcaccagtcctcacctccctaacccctcaatgatcttccttagatcaaggctgagctcgtccgccccttcccgagcgacgcccgtcaccggagctccgtcgcgccgtcttcccgaggagccccgccgccgccgttccttgccgtcggccgctcgtttgccgtcgtgccgctcggtgagcactcccttccctctcccccttcctccccttcgtcggccacctcctgtgcctgctcgtgacgcgccgccaccacttgtggtcgtccgaccgggtcgccgtcgccgcgctccgcgctccacgccgctaccggttgtgtcgggcagccggatgccgcctccccttgtcgcgccgcaccaccactccctagcgtgcgtcgccgctccccgcaccatcgccggtggccgcgctgccgcgtgctgtcgctcggtcaggccggcctgagccgtgcctgtgtcccggctgcgccgccccatggccgcccgatcggctagggccgatccgggccgtcagttcccgtggaccggcggtggaccgcctcgatggtcccggtccacgatggaccggtgcccttgtgttgccgatcggtggggccagcttgccggcgccgcccctcccccttatgacgtcagcaacccccttttcctttggaaaaataattaataattgcgtcataaatcatatttaattctagaaattcatttaaatggctcaaaacttctaaaattcatatctaattcatttgaactccaaattgggccattgaacttgcaaaattcatctaaaattgagatcaacatgtttgtttactttttatgtactgtttcctaggtttttattagagtttttccttgttttgcgtgccggcatgtagaatccgtcatttcagaagtccgcggtcgcgaggatcagagttcggaagatcgtttgaagaagcaaggcaagtcacacattcgccttgagtattttgaccctactttacaaattttttccgtctgcaaataaatatgcatcgttttgctaattacatgggaataggtttcacctatctgcttgcttgtgccatattatttgatatctgtcctttgtcaactttggatgatagatcgactagcttgggttactatgatgacctagctagaactttatacttagccatgcttaattaccactagctcagttgatgggataattgcagaattagacatgttagtatcatgacgagttgcgtgctcgagacatccggccatgtttcatgctcataattatccaactaaaacatgactgaatggtgggctgtgggtgcatggttttgctggtcgcacccatggcaactaaggaccggtttgcgggaaaccctagaagacatacagcacttgccacaagcgggaataggtaactacctaatttgaagtatagctttccgctggctgacgcatccaggcaagggtgagcgtgatggagttcggatgggccctgcgacggcctatgcggctttctgattcgcctaggcacgagaggggactgcccaccgcctgttgggggcgggggtgaaacctgaggtgtggtgtgcttggtcagagggggttatatggagggtcttgtcacaatcactcgacatggtgacgtgtccggccgggcacggtgacatgccggtggattatgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggtgtagcgttgatcagtggagatctaatttactttaattaatcaactgttttactgttttgctcaataaaatgttttacaaccgcctttatgcaaatagccacaaaccacccttgtatccccttgcacgtctacatcattggtgtgacttgctgagtacggtggttgtactcagccttgctattattccccttttttagaagtgtagtgcttctgagctgaggatgaagttagaggaccaaggctcagaccccagttgagttttgcctgtggagtggagctgaagccccgctaggatcgcctttttctgctgctgtcgtttcttttcggtgcgaggactaagagcctcttctgtaagtattttacgctttatttacgtttggaactgtatattacttgtcgttttgtgtaccctggctggtcctggacagggatttaatacacaaaatagtctagaaatttggtctaaatttctgccacaccctaaaaatcccaaatataaaaattgttgcttaattggaattattagaaataattttaaaagcctagaagagaagatctaatttttaattaataaattccaatataaaatttggctagataaaattttattaaatactttgcttaattctatagttcatagatttttctgggatttatttgagctaaggaagtatttttaataaatggaattgcttttcatgaataatttaaaatgaaaaaggtttaaaaatctctcttttggctttgggccgaaagtcggcccaaacttctctctctctctcccttggcccaatccggcccgcagccgagccgccgctcgcgcgcgcgcgctcgcccgctgacaggtggggcccgcttgtcggggtcttcgtcttcctcgcgccgaaaccctagccgcgccgcgtcgccgccgcctttccaattcggccgcatctttcccgattcggtgaaatcgtttgaggggaaatgctccccgggatctcctctacctttttacttttggaatcgatcgctaaatcggtttggaaaccgtcggattcgagctcgaatcggattcgtttctttccctctaaccctaatctttccatcacgtcgctggccgccgtgggccttcgccgccgctccctagcccctataaaaggttccccaggccctccgctacccgtcgccaccctcgctctcgtctctcgtcgccggtagagctctagcaccgtgccgcttagcgccgccgtcgccgttgttcgttcagccctgcgtcgccgtcgctccagtcgtcgtcgtcgctcggggaggtcaccgtcgtggtcgccaagccgtcgccgatctcgtccgcccctccgttttcgctgaggaccgccggagcaccgccgccgtcgtcgacccgatcatctccgccgcttcgacctcgtcaccggtgagttcgccgcgtcgcccgcatcattttggtgcccttcgttagcgccgtcgtgtcgtcgttcgccggcgagcttgcgccatccggtcgccgccggtggtgacgtcatcaccgacgtcatcgtcgccgtgtcccgtggactggtcgtgcgccgatagatcccggccgttcgttttggatggatcgatctcgatcgttcgttttcgtgagccgccgtcgtgcacccggtccaccgtgaaccctagccgatgacgcaataattccctttcccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgagctgttttggtgattttgttcttttctctttagattccgacgttccgggagagtccgattttgtaggagaagattttgaggaattccaaggctagcaaggcaagtcacaaaaatcccaaacaaccctttgagtatgttgatcccgtttaaagctattgtttctattcaactattgcacttattttcgaatgtcattgggtggaattaagctattgcttgttatggccctttttgttcttgattactttattctttgataccttgggttattataacttgactagttgagctttatatattggttcagctagatattagatatgattgcttagccatgcttagaaacattagcacactattgggataactaatgcttcactattatttaatgatggcttaatgatagctcacggtggttaatcgtgattgattaattaattaatttgccaactaaaacctgataatggtgggttgtgagcatatggttttgatggttgtgctcatgacaattaagaaccggttcacgattttcggttgtgaaacgtttaccgtgccaaccacaagccagcatgggcaacggctttactttctgtatagtatggttcatagtagagcaccagactgtgaagtgtcggagataagcccacgggggtcgctggggagtccataccttttttataagggggtgattatgatccgggaacggtgcactgctttgaattgtattatatagagggtattgtcacaatctctattcgggtacttgtcaagtatcgcgacgcatggttgacatgatgttgaggttgtgtcttgtgggtacagtggtacacctctggccagagtttaaactattcgaatagccgtgcccgcggttatgggcgggtctaacaatgtctttcgtgattagtctcacccctctcactatattaaatgatgatgttaataatttgattaactcctggtttggaatggttaattcctggtttggagattgaactgtacagccggggttggttgttcagaatggttgggcctatgcaacagggtatgttgtatagcgttggattaatattgtttaattattatttaactgttttattaaattctgaagtatttattaaatgttgtttatgcaaatgagactatactatgccatcctttgttatcctgtgcacttgcatatttgctgcgtggcttgctgagtatgtcatatactcaccttgcaatcattcatcagaggaggagttctacagcgatgccgatggagtggatgattaggcgtagccctggtcaagctgcctgtggaggggagtcgcctgcgctatttatttatttttccactgcttagaactttattgattgagaggaactatctacctctgtaatgacattttattcgcttattaattagagtaataattgtactctattatcaatttgttattgtgtacctcagctgattcctggacgagggtttctacacatgtaagcgtttggaattttggatagaaattccgggcgtgacatttctgggcgtgacagctcctcccggatccagcatattacagcgtatcagagttacaatgactcacggcaggtcgccgccggcagccgcttcctctcgctatgctatgttgccatgcggttacaacaggcatgcccctctatttatgagagagcctaggatagagtccgactcttactctagtcctaatacctagtacaactccaagtcctaaactgtaaccgactacgtacatatatttgacacaaactctaacagtatggtccctgctctggccctgcaagatctgattttgttacctggatgaagaatgtgcatattggtcagaaccaaaatttctctttttctaggggactttaatttttacatgtcggtggaggatagaaataagtctagggcaaatataaatgatattttcatctttaatgatattatcagctttttgggattattagagatccctttgaaaggtagaaggttcacatggagcaacatgcaacagagcccactcctagagagacttgattgggttttttgttctgcctcttggactctgtcttttcctaatacaactgtagttcctctcacttgaaacatttctgatcatgtgccttgcgttgtcaaaatcgacaccaagatccccatgtctccaatttttagatttgaaagtttttgggtgcaagttgaggggttttttgacattgtggctcagatttgggctttagatcctgggtttgatgatactgccaaatgtatatcttataagctcaagttgcttaggaaaagacttattcattggagcaaaggtctctccaaattagcttccctcctcacaaattctaacagagttattgattttttttgatctaatagaggaaaccgggcagctcactgttcaggagtggaatttcagagaaattgtcaaagttcagattctcaagctcttagagtttagaaatcaatattggaaaaaaaggtgcacacgtagatagatgctattaggggaggaaaatacaaagttctttcaatccattgccactgagagatttagagcaaactcaatttctcatgtttatgatttcagtggtgttggcggttgttaaatgccgattctataccgccaatatctgcataaaatccagataataaagcatccaacatagtaataggtgttaaatctcacattttccacaagtgttgttgtatatttgtatgcagatgataaacctagaaggtaggaggaaaatcaaactaaagtggagaaggaaacatatccatacaaggatggactttgaactttatcaaaacactagagaatcagcccaaaaactccgagaattggatagagcaggatcagaggaggagatgggccaaaggccatgctaggaggggccagccatgcaaagaggccgaaccaacatctcagccatttaggctggggtttggcatggacgctcctcatcactccctgatggcagttgcagggaatttccgacaattcgtatagtgattaccgtcgtaaatgtccaatttaaggagcttcactccttcacttctccacacacttccaagcttgagctaaactataagagactattgtactatttgtatactataattaggaagagagtagagtagaagaagtcggaagaattctggagctatcagtaatcttctcctatttcttttattctgtttattacactaatattaatagaattatcttcctgaataatttaaatttatcctgtgagaattatttcttggttagttcctaaatagcatataggattattgttcactgtaatcaactaaaatatactgattgctttggtgagttataaatactaaagtagatattaattgcttagacgtggtgtttatgtaattattatccagtaattgctgcgtatcccacagtacgtttgaggtgggtgtagaggtggtgacagccctcaggagcacttaagtcctccctgtctgtgtacggagtagagcgacatctgggaacagcgggttgccagcgcctgaagtattgtgttatgattaaaattaagctttccctagacactgtttcccaccagtgaatcctcactatcctagcctacctttgcttggtttccttggatgaaccggaggaagaattaatcacacacattcccttggatttgatacccttggaacactccgtaggggaagtgctacatcggtatatccgtgcgattgcggattttatctgtgatcgtatgaaataccaacaagcatttatggcaccgttgccgaggaacggttgctgattatttccgaacccagttcatcctcgtatctctttattttcatttttattctaccttcacccctgctacctagagaagtattcatgttcaattattctcaaccatggagcaacctctctttgagctgtctgctcctagggatgaattctatgagccacctccttcatcgtagccaatttatacaattggctatgaaattcgccccgaactaatctgcatggttagggagaatccttttttctagtcttgatctagaaaatccctaccatcatctgtgggactttgagcaagtttgctcatgccttaagattcgtggcatgaagcaagaaactgtacggtggaagttgtttccgttctcccttcaagagagagcgaagcaatggtacacatctaccgtaggatgtgtagacggtagttgggaaaagttgcgagacaggttctgtcttgccttcttcccagttacccgtattaccgcccatcgagtagaaatcctcagtttccggcagatcaataacgaatcaatcggtgcagcctagtccagattcactaatctagtgcagtccagaccaaccttgtctttacccaagtatgtgcttttacaacattttcatacgggtctagaaacagagtctgcattctatctggacataacccccggatgatcattcatgcataaaatgtcgtcagaaggaaaagtaattttagatcgcattctagaaaatacttccttcatgacgcaatgcgatgaacctctgctggaggcattcgtgtccaagatagagaagccttcgacagtcgaatcacaacctgaactttccacttcgaccgactcgactgatgaagtagttcccgagccgccatccattcagaatgaagaaattcagacttcggattgtgctccaattttattcagggatggccttgatgaagactacggcaacaccctgaattatttcagtaaaaagatgctgattgttcctttgccacctcccgatcctatggaacttgcattcctaagacaaactgtctgggacgttacatccataatgagtgacgaacggctaagggaggcagagctttcatccgaagtaatttggataaataccgctccctgagttattccttatcgtctagaagggaacggcattggcattctttacagtcaaactatcggggttaatctcatttctgagtcatttgcatttgtttacctaagcgataaagcaataaccccgacatacaaattcttcaagcactcaaatggaaaaatcattgaaggatttggaattgtgcaagatgtacatgtccgctttcaagatagggaggcagtcttggattttcatgtctttaaaatccaagactttgacattttggtcgggtgccaattgagcaactcctcataaacacgctcgattaaacagcctcaagataactttgggagggaacgaattttcagttccattctcgcaggcaaggtttgcctcgaccgactctctcccagaagatgagtatgtggtggaagtaacggaagttctctctcacgagtctcctgagacccttctggaaaatgaagtccctaacttcataaaagaggaagcggaacccagtgagactctcgagcttccaatcatagaaccgccgcctcgacctccgattgcgctgaaacctctgcctcaaggcctacgctatgctttcctgcacggcaataaggaagctcatgtcatcataagtaacaagctttctgaagatgagactcaacgtcttctagctgtgttagaaaagcatcgctctgttcttggctactctctctaggatctcaaaggaaataatcttgcgctttgcactcatcgtatccctattgagcccgagagtactccctccagggaaccacaatgacggctcaataatacgatgcgagaagttgtaaagaaagaggttctaaaactcctgcacaccgagattattatctcgtcccatacattgagtgagttagcacagtccaggttgtgccgaagaaaggacgaatgacggtcgttgcaaatgctcaaaataaacttattccgcaacgaaccataactggatggaggatgtgcatagattataggaagcttaacaaggctaagcaacggatcatttcctgctatgtttcattaacaaaatgttagaacggctggcaaatcattcctttttctgtttccttgatgggtgttccgggtatcatcaaattcccatccatccagaggaccagagtaagaccacgttcacatgtccatacctatgcttatcgtaggatgtccttcggactgtgcaacactcctaaatcttttcaaaggtgtatgatgtccattttcttggatatgatcgaggacattacggaagtcttcatggacgacttctcggtctatggaaaaaccttcggtcattgtctacagaatttggataaggtcttacaacaatgccaagaaaaggacctggtactcaattgggaaaagtgtcattttatggtccttaaagggattgtacttggtcatagggtgtccgaacatggaattaaagttgatcgtgctaagatcgatgtgattgatcaacttcctcctcctgtgaatatcaaggggatccgttgtttcttgggtcacgccggcttttatagaagattcatcaaggacttctctacaattgcctgactactgacaaacctgctagctaaagaagctccctttgagttcgatgacgcgtgtctaaaattctttgaaattctcaaaaaggcactcatctctactccaatcatccaaccccctgattggacactaccctttgaaattatgtgtgatgcaagcgatttcgctgttggtgtggtcttgggccaaaccaaggataaaaagcatcatgcaatctgctatcctagcaaaactctaaccggagctcagtttaattatgcaactactaaaaaagagctgctcgcggttgtttttgctatcgataagtttacactgatcatgctgctctaaaatacctgctcactaagaaagatcctaaaccacgtctcttgtgatggattttgctactccaagaatttgacttagaacttaaggataaaaagggagtagaaaattccatagcagatcatttgtctaggctgcaaatcactaacacgctcgcaggaacagtcgataaatggttttctaagagatgacatgctgatgatggtgcacgactccaactcatggtatgccaacatagtgaactacatggtgttaaagtacataccacccggagaaaatcaaaggaagctgaaatacgagagtcaccgtcatatatgggatgagccatacctgtatagggtttgctctgatggtctattgagaagatgcgtgccaactgaagagggacttaagatcatagaacgatgccacgcctcgccttatggtggacattacagtgcattccgcacccaggcaaagatttggcaatgtggtttcttctggccgacaatgtacgaagactcaaaggaatttgtcagaagatgcccaagctgctgtaggatcgagatgtcgactagaggggggtgaataggcgatttaaaactaagtggcacgtaatcaaaactaacctatgttgctagggtcggtgagagacaagtctaactaagcaactaagttatgttttgcaatcctagggtgaaagtggttcaagtgtatcactaggaaagtaaatcacacaactaaattaagttttgcaatcctagggtgatatggccacaaataagtttttatgaaatataaattgcacaaatgtaaatgcaacaaataaatgagacaagagacaaggaatttttcactgaggttcggaaactcgccgatttcctaatccccgttgaggtgagcccaactccaccactcaaccacgaagccgccgcacgcccccttcgtcaaggggtgggcagggcaggagttggcccaaggagaggactacccaagcctcgatcactaggggtagttctttcttcactccgaaggtggtgaactccaaaccactcacaaaccagcgccgggcctcctccacgatctcctcggagaggtcaccggcaacacctccacaagccgtctaggaggcggcaacctcccagagtaaaaagcgatgacccggctcggagatgatcaagtgccacactagctctacaatggaagcaaatgcacttgactcttggctaatcaaccctctaacacactaagtggatgaatacaaagctcaagtgagtgtgggagaggtgcaaggggtgtatgcaattgaagtgggtgccaagagagtccccttgctgctggtgggggaggtaagtccactcgtgatccgccatttcctaaccctgcaggaactaatgggatgtcaaaagaaacgccatctactgactcggctgacaaggagatttagccagagaaaatcgtgccgcaggactactgcgacacacggttgctgccattccctcagcggagtaggaaaccgtcagtggacgagcagttcactcgttttgttgaagtaatccagaagatccacatcaacatgccgttgttcgacactatgcaagtaccaacatacgcctgttatctcaaggacatactcaacaacaagagaccgctcccaacaatggaggtggtcaagctgacggaacactgcagcaacgtcatactccacaagctcccagagaagaagaaagatccggggtgtcccacgatcacctgctcgatcggggcacaacaattcgaccaggccttgtgcgaccttggagccagcgtcagcgtcatgccaaaagacgtctttgacaagctcaacttcacggtgttggcaccaacaccgatgcgcctccaactggctgactcgttagtccgttacccggcggggatagtgaaggatgtgctagtcaagatacgggatttcttcatcccggttgattttgtggtgctagacatggacacagggaaggagaccattcctggggcatccatcctggggcatccattccttagcaccgcaagagccaacattgacgtgggaacggggagtatctgtttccatatcaatgggaaggaggaaaagtttgagtttcaaccgaggatggaacaatgctccatggtcagaatcaagtacgggccaaacccacagaatattcaagtggtcgaagtggagccacccaagacggatagcctgataaagttcatgcagaacttcctggaaaaggaaacaacaatacccaggaaccgttattggaggacgccggtaaaatcacctgtaccggccaagaagttagagcagccggctcagaagaagccgtcttccgaaccgaaatcaaagaaggtgtggaaggaaaagccaaagacgcccgctccatcacctctggagacgggtggaaaatccgtgcactgaatcgaaaggaggtacggtcttgcacgtcggactttaaatgacgcgaccttccccaacaggtaaattggaatgtatccgcacatttgctttcaacaatttgaatttttgcatcaccacatgtttgaatttcaaaattgcatttagggtttttgaaatttaaggaaatccttcaaatgaatttttcagagcaaaccaaaataaaattttcaacgaaaattcactgtgccacgaccgcactgaccgttggattccaacggccgaaagtggggccgattgggcccacaaggggttcggccgaacaccctggttcggccgaaccggccaggccaacggtcggctccttcctcttttgaggcaacggctagtgggtcccacaggtcagttttgaccgttatgggtgcactacttaagccacccggccgagagagggaattccaccctatttcaatacattttcatgacgagtctagtactcgctcatcagccgatgtcttgacggaagacgccgacgctctgcgacaactcctgagcgacgttgacctttaccttatcagtaatcgggagagacaagccaactacatgctgagcgaccgggagtatgctcacacacgagaatactcaccggagttgctgaaaaagataggtatggatgttgaatttcgttctatttggaaatctgttggttggcagaaatttgttgtggtagatgagcctggttctcgtttgcttactttgaaagaaatataagatggtatttcttttcgcattttccgtaaggagttcacgctcacatggaaaggcttgagtatacttcttggtttcacgattcctgtaaaatcgatctctagaaaggaatttctgggttcgagaaaaataggttttgggaagatatttctattgctccaatttgcaagaaacctagaacgaatgatatccataattctacacttaggctcatgcacaaatggattgctatgactttgtttcctagaggtgatttaagacccattaggggagatgaattaattatcatgtttgccatggttagaaagtataaagttctctgctcctgttgaatgcacttctctgattactcagaaagaaaaaggcctaggggtcgttagcgaccagattgcttttatctcagccgctcgtccgtgtattgatgaggcctatctagtgcaagggcatattttgaaacatggagcagatggatatttgaaatactttttccccgattgtacaaatgaaatcatgttgctaaatgcgaggtatcatttgtacaactgtcatgaactaaccattcccctgcagaccatagaagaatctcgtgcaggtggaacatacacggagacgcgcaacatgacaaggaacgaacaaggaagttcatcatcctcgacactcgtgcagatgtatgaggcaggttgggcaccaactggggatgcaaccggatggacccaagctccacgccatagcatcgtagtctcaacctgggcaagcgccagtgaggaccggtggcatacgcctcgtgacatccactgggggaacaaccaaccctccagatcaagtggtgtgcctcaatctccaaatgaatggcgctcaagttcttctcgttgggacttgggtgaaatcactaggagaatggacacccttgatgtgcagacgggggagatccagtatgacctcgcggaacacatagctcaaacgcaagaatggcaacaatctgctgatgctcagttcgccaacatcaacaacaagatgcaacaacagcatgctgacctttaggcgtactttcgctttcaggggttcaatccttatcaaggaccctaagcgaaagccaagcttggggggagacctcgctccccccactaaggtaacttgtatcacattgcatattttcgtttccaattgcatcctataaaacttgaaaacaacataaaaatttgcaaaatagaaaataccaaaaagataggataggtttgagtcatgctaggtaagacaagctagttcactttgttgaaatgatgaatagttgctctattttatatctctgatatatgggttcttggtaagtgctctctcaaagattgaataaaagtagccaacaattatccgggaacctgaggtaaatgtgctacacttactgatctaagtctaagctgttgcaagatatgagatagtaaatatgagtagctacgatcctgatactagtttgacttgaattccggatgttttgtttttcaaaatgataaaattgaaagttccttatttgatataaattcctaccagagccaaaaatgtgctatcatgattaaacaatatacattttggttactttccattccattgaactttgtcaaactcttgtgacttgtgtagatacttctcatgctctatgatcaagatcgtatacccacatatatgcacatgctatactcctacactgggagctaagcaatattccattccatttccatattaccaccaaaataaattctccatgttttcatatgctttcttctcctaaaagaaaagaaaaatcctttttaaaaaaagaaagaagagaaaggagggaaaggcatggttatgaaaaaaaaataaagttatgctccatcaagcatgagcatgattgaaaaaaaaatgtaatcatgccctcccctaatcaataaaagaaggatttttgggagaagaaagtaagcacaaaggagaagcatttttcttttatttttcctcatataccatttccatcatataccacacacacattatgcacgatcttgatcttgagtatgtttagttatctgctctagtctaagtttttgacttagtaataaatgtgaatgcgagtatgccatgtttgatccttaccaagctccacatatcaaaaaccttagagtaggaatcaataaggcaacatttggtgaggaattcattttgatacacttagagagactgagtgaatcacttgaggaacttggttttcttttccaaaatcatttgaaaacttccggaacaagagttgaataaagatcgggtgattggtgctctaattgctgttctgtctttcaaccgcccaaggcaaggagaagcagtgtctcgtgggaatcaggggtaagggtaagccaccatgccaaacattatttaacctaagagagagtacatatatcttgcacctgtatctttgagatatgtagcatagtagcaactcctgatcaacaaccaagtctatgtttcctttcgtccttcactcgggacgagcaaaggttcaagcttggggggttttgttgacggtcgttatcgatcagtttcgaccgtcaatattactaaaataggagagaactagtgatgcttgcaatgcataaatatgttataataataatattccactagtattaggtctactagtaaagaatgatcgtaaagtggaggagaatcgacatcaacaccaatgataaatcaatcagacgatgtcgaggaccagacttatgtatgaatgggccaagaactcagaattgacaagatgaattgggccaaaattcacaagtctgcggagtggagcaatagaggaggccaccagccgaaattgggctggattgggccagccccaggttcggccgaaccaatcctagcgccgttggatcctggttttggcgtggacgtccaggactgcatcccaatgacggttagagggcacttcggacaattccccttccacaaccgtcatacctacctctatataaggagctcactctcttcacttcaacacacacctcaagcaagagctctctcattcctctcaagtttagtttagtagtatctagctcgtggaatagaattagaataggaatcaggagtccggaagtcttcggaagagttcaggtatggctctagtagctttcctttcctcttttgtaagctttgtacttttattagaatactcttctaaatacatttctggtattgaaatactttccgagtatatgagtaccaactttacattatgttcttgttataatgaatgtacggctagcttatttgggagatgctttggtgcgggtataatgtttgtttatgcaattactctatgtcatgacgatgatattagagtagtatctggtagtttaggcgtggtgtctagattacgggatatcattatttggggttatatattgcggatgagaggtgggccgatgatggtgatagctcagtatgggtattcctccgtgcctatatataatcctaagttaatttccgagggagagtattcctccgtatttagccccggttggatggtcatgacgggctgtcgtaacgaactcggcagtcagggtggcttctcgaagtaccaggagggcatcggatagagggtattagctagtatatcagttaactagaatgtatgtatactatgtatattagaagtataggaatagattatccttctcttttctttccacctagcttatattatttattatgaggatgagtagtaatggttgtgtgtcactctacccttggattatcataacccctgcttagaatataattatcacaagtaatatataaattattagttgagttctctctacatgatcttcccacgggataaaataaatacgatacccttggaatactcttgggtgaaatgctacaatggtatatccgtgcgcttgcggatgaactttgtaaccataatataccagaagtatttctgcgccattgctgggaattatatttctagtaatgtcgttaagaaataccaacaattggcctcccatagcgccaccgctggtcaccaagggggccggttagaccggcatagtgcttgtggtcagaccggccactacctgccagtcagaccggtatacaagccgcgatcagaccggatctggtcagtcatcccagtgacagcaagaaatgagaaaattaactcaagtcaacatgcgcgtgacctaatgtggcaatatgaatcatctctttgtctagatcattacccttcttaatagtacggcaaagctaaaattaaactagcaaattttgatcgctcaactcctcgatcaatttaacattaaaacactagttttaccgtcttcctttccttttgctttgcgccatcaattttagtccacaataatcatctatgcgcacacataatgtgaacctaacttaaaatatatagctcaatagaacggttagtccacaaaaacaacaggggcctagatgcttcagctgccagaggcaaggaagaatagctgctcgcgacgcaatgcccctcacatacaacctacaagtcgagatattcgatgtgtggggtattgactttatgggaccatttcccaagtcccgtaattgcgagtatattctggtggcagtcaactatgtctccaagtgggttgaggctatgccgtgcagcgccgcggatgcgaagcatgccaagaagatgttcacagaaatcatcttcccgaggtttggtaccccaaggatggtcataagtgatggaggctcgctcttcgtcgacaaaactttccgagacctcctgtgagacatgggagccaaacacaacgttgctacaccttaccatccatataccagcggtcaagcaaaacgtcaaacaaacaaattaagaacattctgcaaaatacggtcaacaaaatgggcataggatggaaggataagctaccagatgcactgtgggcatacccgacagcttacaagacacccattggaatgtccccctatcagattgtctacggaagtcatgccgactccctgtagaacttgggcacagagcatacaaggccatcagaaactagaatatggattttgagggagtaggagattggaggaaaatgcagttggctgagctagaagaatggagagaaaaagcatatcacaactctaggatatacaaagaaaggatgaagcgctggcctgataaaagaataaagatcaagaaattcaagccaggagacaaggtcctaatgttcaactccagagttaagcttttcggccatggaaaagtacgaagcaattgggaaggaccgtttgacatcatcgacacctcttcgcacggagcgataacactctgcgacgactcaggtaacatatttaaggtaaacggtcaacgtttaaaaattttccttgagccgaataaaacttcagatgaagaagtggatattattgaattaattgattatgaaccatgatgatctcatctaaagcatgcttagttgtcatttttgtgcctagaataagattgtgtgggcctaggaagaaaattggcagccagccggacccaccagggttcggccaaaccccgaaccagggtgacgcccaactggacccgttttcgaatgacagcccccccccccaactcgtttgtagtctgttgtgatgtgcattcggaggtagatcaatcggatcaagcaccagagctctagttctttctcctcctccacctttgcaaaccctcctcttcacctcactcaattccttgctccctctgctcaaaccaccaatggctggcaaatccttaatgccatacattggctcttcctcaaactccacatataaccttgaaggagagccaacaccggccaatcaattgatcccggtggagaattatacaatggaaggggtgaacgcactctgggctcaaccccttgcgacggtgctgggctcccctgcgaatctagagcccatcggcgagctccctagttcttctgaaccaggggttcggccgaacccatctcggccccattcagcagcacgctccctctccccgatgcacgtcacatagacaaaagtacagggtgattcgcctgcgcgacggccgacaatgggcgagctcagccttttgaaggcgaggcgtctattccaagatgacgagaaggccgctccgcttcccgttgagtaatatgtggtcactctctacaccaaggcaggggatgaggtgctccacaagtataccacaaccactgctgctccgtccacccctaagagggatcgcttttgcattcagggagtgcgaactcccggcggtggatatggtaaaggcttgctccgtccattgacggcatcggagaagaagggggtagcggaatcctgcatccctccacctatgaaggtgaagcgtcatttgacgcatcctcctatcattagggcgcccaggcaattccaagaagatgaagtaaaatcgtcggagccctcggtccacaagctcgccgttcaagtgaagaaattccgtaaggagaacatagagcttagggatcgcaatgcgaagctaggggtagaactcgctgaacttaggaacaatatagacacccttagttgcggtttgtgcgctaagatcaatcgcgcattcctagaaatgggaaaggagaataaatactatgctaactacatgtctccttttccattaataatgtagttagtaggtgcttagtttctttattacttcttgatcgttgtaagcatctgttgtcaataatgtggctcattggccttaaccccaatgattgccgattttattttatgatgattaataaagtttaggtttcaaataagtgtgggggagataccttggctttctgatgtgcaaactctgaaaatgtgactaaatatctgaactcctgtgaggcactgaactctgtagaaaattgcagggtgattgggcaccagggtggttcggccaaacccaaaccagtgctggccacaatcaccctcagttttcactagtaagcaggtcagcacgtccactgcctctatatctccaccattgtatagtacaagagctaggaattcagagaataattggttcaagcataattgaaaagataaaacttccaactaatggaatttccgatgattaatcttgtatatattttattctcagctgaacttgttgcttgtgcacaaccatccatgtttagagaaccttattcatctaagtatttgttacatgagagatggttaaagatcaaagaaattcttgcaacatttgtcatgactcttgggaatttgtttttcgaaataaaaattctttcaaacctcacttctctaaatgatttcataattatacctaccaaggccatatgcaagtatatcaatgatgaaccatattgcgcatatgactgtttgacattatattgagctttgccaaatttatgtgactcgtgctagatatctttcatactctcatgatcaaggggtcatatccactttcatttccatataaccacataagctaagcttctacattggaagttggctttccacaaaaagttttattcaaataaactcctactttagaccatgctttcttctcctggaaaatcattggcaacaagaaaaggtggaaaaggcatgactatgaaaaaaaaagagaaaataaaaatgcttgccttcaaagtgcggagcatgatgaaaaaggtagccatgccccttccttatgtatgcaaggaaaattgaagaagaaagtataggaaaaaagagaaacattttatttcatcattccacgaaaatattttacactttccaccataaataaagacccttgatctaggagtatgattgatgatcttcttgagtccatgtatttggctttgcaatatatatgatgcaggtatgtcacaatttatccctaccgagccccacataacagcctgtagaatagggtgaattttggcacaatccgccttggagaggatccacaaagtcagaaacacttgagtgacagagagaaagtcagtaagaggaaaagagctattttgtgaaaaattcataaaaccccatgagtctgacagaggaagtaggaaggactggaatcatgaccgttccatttatcaattacccaagatgataagataaccactgataaagttcacaggtacaggtatggttttgaataatctatatgcttgagttatatcttggaaaatttcattctacactgacctttactcagggacgactaaagagctaagtgtgggtggttttgttggcagctgttaaatatcgattctataccgccaacatctgcttaaagtacagataataaaacatccaacatagtaataggtgttaaatctcacattttctacaagtgttggtgtatatttgtatgcagatgataaaccccgaagttgggaggaaaatcacactaaagtggagaaggaaccatatccatataaggatgggctttcaactttattaaaacatttgagaatcagcccaaaactctgaaaattagatagagtaggatcagaggaggagatgggccaaaggccaggccaggagggcccagccatggtttggccgaaccaacatctcagtcgttcaggctggggtttggcattgatgctcctgatcactccctgatggcggttgcggagtatttccgacaattcgcatagtgataaccgtcataactgtcctatttaaggagtttcactcattcacttctccacacacttccaatcttgagctgaattataagagactctattgtactatttgtatactataattaggaagagagtagagcagaagaagtcggaagaattccggagctgtcggtaatcttctcctacttcttttattctgtttattactctgatattaatagaattatcttcctgagtaatttagatttatcttgtgagaattatttttgggttagttcctaaatagcatatgggattattgttcactataatcaactaaaatatagtgattgctttggtgagttatatacactaaagtagatattaattgcttagacgtggtgtttaggtaattattatccagtaattgttgtgtatcccacagtacgtttgaggtgggtgtagaggtggtgacagccctcaagagcacttaagacctccctgtccgggtacgtagtagagcgacatctgggaacagcgggttgccagtgcctgaagtattacattaggattaaacttaagctttccctagacattgtttcttactagtgaatcctctctatcctggcctaccactgcttgctgtcctttgatgaacaggaggaagaattaatcacactcgttccctttgatccgatacccttggaatactccgtagaggaagtgttacattggtatatccgtgcgcttgcggattttatctgttatcgtaagaaataccaacaagtggccaagtggtttctttgtatgaacagaaggctgctttgttcttatcaaagttttaaaaatagaatgggagtttctacattccccacaatgatctttgatctgcaaaaatttcttctttgctaatcataacttggacagtcttgtagatcctttctctacacatgaaattgacaaccttatcaagataattgctgtagacaaggcccctagtcctgatggtttcaatgggctctttttgaaaagctactgtcctattattgcacaggattattacagactagctgctcattttcatgctgaatgcactgatctacagggtttgaataattccttcataactctggtgctaaagaagacttcccctaaaactgtgaatgacttcaggcctatttcactcatggggatcagtttaaagttcataacaaagttgatagctagtttaaagttcataacaaagttgatagctgatagattgcacggggtgatcttaaagttaatcagtgaaaatcagtatggttttatcaatgtcagtaatccaaaagagagaaaaatatactaaaactggactttgagaaagcttttgacataatagagcattctgtcataatctcagttatgcaacatatggattttctagaaaaatggcttcactaggttcaaatggtgttctcaacagctaactctgcaatgctcctcaatggtgtcctaaggaaatcattcagctgtaaaagaggggtcaggcaaggtgaccctctttctcccttgctatttgtgctgggagctgggctgcttcaaagagtagtgaataaagcttttcagatggatctgttatccaagcctatcaatgaaaatggtggcactagtttcccaattatccaatatgctgatgatactctggttttgttgatggcatcccttttaggttttttgtttcaaagccatccttaattcttttgctcaatccactggttttaaagttaatttcaacaagtctagcatgtaccctctcaatctcactgctgagaaatctgacttgatggctggtttgctgggttgttctattggaactctccttttcacctacctggggctgcccatggggaaagaaggctcacagcaagttcaatgttcctcccctaaggtggtaggctgaccttaatcaattcagttctttcagcaatccctacctactatatgtgttccctacagtttcctattacagttgtcaatgccattgatacagcaaggaaaaattgtctttggagaggaaacaacccaatttctacaaggaaatctttggcatcctgggatctggtctgtaggccaaaggataagggaggtttcggtatagtgaatctcaaagtgcagaacatagcattgttgctaaaacacctggtgaaactttacaaaggtgtaaatctgccatgggtcaatttggtatggaattattacttctctgtaaaggtacctcatttggtttttaataagggttccttttggttaagagacatctaggccctctcagccttgttcagaggtattgcaaaatgttccatccagtctgagaaatcttatcttttttgggatgacttgtggaataaggaactgcatagctccaaatttcctgctctgcatgctctagctttatataaggaggaatcaattagctgaatgtgatctaggactttggaggattgtttcatgatgcctctttctacccaggtttatggggattttttgcaactttaggacttcttgaatcctctgaatttgaatgatgcacagggtgacaattggtgttttatttggaattcagagatatatacctccaagcggttctataagcttaacttcatgtctttgagcccttctaggccttttgtttggttatggaagaccaagtgtgttatgaaagtcaatgattttgcatggcttttattttgtgacaggctgaacatacgagatatgcttgatagaaggcattctgcaaaggaggatgatgatctcacctgccccttatgtcctgaaggacggagggaaactcggctacatctcatttttacattccctttcagtatgtgatgttggcaatctttgggaattgtttggaatcataatttggagttctttcacctcgtaattcttgcaaaatggaggttcagtagaaatgacagaaagagcttcttggaaattttctttttagcatcatggcacatatggaagcagaaaaatgggctcattttttataatattattccatcatttcaatcttggaaggccttgttcgccaaagaaattcttctacatctatgtagaatgaaggatcctttaaagcaattaatctgttttttattggttacaaactttgtagcttggcaaaatttgctgcagcacacgcaaaaatcatgtaattggctaagagacaccgtaaaaacatgacactgccaatgaacactacaaaagttatgtagttagctataggacaccggaggcattattttataatttccgggctaaaaaaagggagagaaatttcgaaatgacgggaatgcccccctctactccttcttcctttcttctcactgcagccaacatgtgggcttgcagagagtgttgtcgtcctcctgtcgccaacgctcaacgccagctgccgtccccgacctcgacgccaccgttgcctccacttgctgccacacccacgctcagaccacctccctccacctcatctcctccctcctcgccccgcccacagctcccctcctccgcgagctgccatcgcctccacttgctgccgcgcccacgcccagaccacctccctccacctcatctcctccctcctcgccccgcccacatctcccctcctccgtgacgccctcgctcgcgcccgcacttaccccgccgaattccgcaacggggacatcaatctcaccatcctccgcccatgccgctcctcggccgcctccccacgcgcacccgcccaccgcctctcttcctctggtgcttgctcgtcatccagaacatgagccgctacatgcgcggtgtgtccaccacgtcgatgtagttgacgacggttaggcaaacctgcaagatggggaggctgcgtctagcgacgagcaggaaggcgaggtccctgttctccatgacgacgcagccgaggcgggggaagacggcgtagtggaaggggcccgggtgcacggcgaagacgcgggacacggcgccattgacgtcgccaccaccgcgtccctccggtgcgaggtgcacgttgacgagcgctaggggaagcggtgagcacgtagaacaggaagatggataggcagatcgacaacggcaaagccatcgacactcggggggcaatccgggcgtttcaaaaaaaatctcaccgctttcatcccgaaaatgataaaataatgagttcggtgtcctacggccaattacataacttttgtagcgtccataggtagtgtcacgtttttacggtatccctcagctaattacactttttacgtgtcctgtagcaaattttgccatagctttaagatcttgctatatgtaaatctctctttaatgaaaatacactgttagacaaagccggttttttcaggtcaacaagatagagccgatgtacacaaatgaaaaagccattaacatacaattaatcaattttaacgggaaatgagataaaatttacaacttgatttaccaaatcaagcgctcaagtgtgagatgcgtgaacaagcgctcaagtgtgtacgcctcgtgtttgtgtcaagtggcctcaattggaagggaagtaaatatgtgcatttctgtgaaagttattactagtactgagcatgctaaagcttttacatgcgccgaaccatatggttcatggagaaaacgtacaaccaaacaatcgcaaattttcttcgccgtgtgggccaagctccgtgcgaacaaccaaagatgctctttttgaatcttgattagttagttggttgtttgtacagtacaacccaggatagatttagctgtgttcgaaccccttctcccggcacgcaaaacaaaactcgtattgttgcatgattaattaagtattatttttaaaaaaaaaatgaatcaatatgattttttaagataactttcatatagaaagtttttcataaagcacaccatttagcaatgtgaaaagtggatgcgcgaaaaacgaaagaggtgggttgggaaaatgggaggaagaacacagcctatagttgaaggcagtaaagttcttttctgctttaaggcccgttgatttatacaaaatatataaaatttggaggatttttagtcttgtagaaatattccgtacgaaggcatttgagacaagagattaaatcccatcttatcctttgaaattccataagtaaggaatggacaacctataaaaattgtgaagaaaatttagtaatagatgtaacctcatcaaaattttattttgagtttatctctcttatcgaatttatgtgtttttctgcgttgaatcaaatggttatttaagcgtttttaatgtgttttacattctttattagaatactacgttgtttctatcaaagagggcctaatagagacgctaacaaagcatattttgaatttgtcgttgtttgtaactccggaatgtgtgtgtcaacataaatataccagagtacgatgaagcacaaaacgtttctgtttacacctaaaattggcatgaatgttcaaattaaggaaaattgctaagatttgggaaaaatcgctggtttcctccatagggccagtctgaccggcgtgtattggccagtcagaccgttgattgagggtcggtctgaccggtggcatgtggtcgatcagaccggtagagtccgagaccgagtctgtttttgtcaggtctcggaattccttgctcgagagactatgcttttggtttcctttggtttctataccgagttgaacgtggaggagaatctgtaggagacaagaccaacccctatataagggacaaagccggttcaattggaggagaatccacatacaacccaatttagccaattgaatcgctttttgaatatttcaaatctagttttagtctagttcgtccatctttatcgatctgcgtcataaatcgtccaccttagctgcaagagggcgaaatccttttgtaggtttgtctcgtaaaccttccgcttatccacgaaacgggtagttatctattgttttaactaaattggctctgctagccggtttaatctattaaaacccatcttaatcaccataaaatgtttaggtgtttcaaccgtgattgtcttcatgtaaaaaaaaaagttgccaacaacttcttgttcaatcgacttgtttattactgattttaaggggtcctaatagtagagaatgacgaagcaaattttgcatttgccgttgtttctaactccggaacgtatgcgtgatgaagcgcaacgcgtttcttgtctaatcgactagtttatttctactacacagccgtagccctagaaacaacgggacgtaccatacatatgcttccttagcgaacccgcaaatcggccataaacacggtgtgccgtagctctgttgccactaccgctcgcccacacattgtcattatgtcaacccatcattacgaagcgcagaggtacactgatccacccagagacatactcatatccctacgtacatcggtacaggtatacgcgaccggccgcggcagggccacaccgacgccctttccggctttcatcccgacccgacctagctaatctatcagccgcccacgcccaggcttttatcaaaacagtccatggtgcacctaccgaccgacgttgtaaagaaacagcagagatccacagtgctgtcaaaaaacccaaccccacgttcccaccatctattcattcttaaatctcgaactctctgctgctgccgccaggcgccccagatccactcgctcgtctcgtctctccgctctcttccggacttccactagtcgcacactagcactcgccactcgccagtcgctacgactagtagctccacctctgtagcctaaagcccaccccccaacaccaccctctgtgaagtagcttgtcctcttcgccgaggccgaggtgacgcacatggcgctgcctcctcctctgctccgcttcttcatcgtcgccgtgctgctcagctcggtcgccgcatgggtggcggcggcgacgacgctgcacgagcgcgacgcggcggcgctcagggacgtccgggcggggctgcgggacctgccggggtcccggttcttcgaatcctgggatgacgccaccgacccgtgcgactatgccggcgtcgtgtgcgagcccgacgaggacgacccggccgcgctccgcgtgtccgtgctgacgctcggcaccggcctcaccgactctcccggcctggctggcacgctcccggcctcgcttgccagcctcactgcgctcacggacttcgtcctttatccaggacgcgtcgcgggagctattccgacggacattgggtcgggtctccggcgcctcaggctgctgtccatgtccggcaaccagctgaccgggcagatacccgagtccctcgccgggctgccagatctgcacacgctcgacctcggcaataaccacctcgacggctccattcccagcggcttgctgctgccgtcttcgcagagcctcaaggtgctcatcctagcgaacaatggcggcctctccgggcagattccagaccaattttccagctcacagcttttccatgtcgacctaagccggaattccatcactggctcgctcccaccgctggcgcagacagtccgctacttctccgtcgcggcgaactcaatgcaggggagcctcgacggcgcgttcggcaacggttcggctccgaccgacttggccttcctcgacctctcgatgaacaacttctcgggttcaatcccgcgggagttgttcgcgctcccgagcgcgtcgtcccttcttctgtcccgcaataacttcaccgggtccctcgccgtgccagcgttcgcatcggagcgtgccgcaacgccgccgtggtcggttgtggacgtcagccacaatggcatcacgggggaggtcccggaggagctagcggccgtggagagcctgtacgtgaacaacaaccggatgtacggcgaggtgccggaggcggtggcccgtagcgtgttcgccggccgcatgacgaccttctacgcgcagcacaacttcctgacgggcttcccggtgccgccgctgccgctgccggactccgcagcgctgtgcctctcttacaattgcatggagctaccgtccgcttctgccgccaacgggtgccccaccatcggcggcccaatggagtccaggcccgccgaccagtgccggagcagcaccgcagccaacgccggcagcagcggaggggacggctgagccgccaacattcctcaaggctgacaggtggggcccacctggttcagctcatcagctgggcacgggtgggggcgtgaggaagggacggccaggatagctaagcctggctcacacattttcgttttgtccgtttgtttcgggtgtggttttcatgtgattgggtttgaattcatcggcatccgggcttgtcgtcgggcgcgcaacggttacacggctacaaggttagcgcgttcttgtgcgtgtgtgcaattactcgctctggtagtttgtacgctgcgtctgtgttactctgttcattgtgagtagctggcagtgtccatttaaacaactctgttcatactctactaagtcagctaatgtaaagggaggcactattttagggggtgtttattttttaaagtacatgtcacattggatgtttggacgctaatttgaagtattaaatatagactaataaaaaaactaatttcataaatgcgagctaatctgcgagacgaattttttaagcctaattaatctataattatgaaaagtttactgtagcatcacattgtcaaatcatggcgtaattagactcaaaagattcgtctcgcgaattagtccaaggttatggaatgggttttgtaattagtgtatgtttaatactctaaattagtgtccaaacatccgatgtgatagggacttggggaataaatccatgtttcccaaacaggcccttagaaaaaaatatcaaatcatctcacttgttgatccatgtttggagtctcgacagagttcgcggtatcggcggttaagagttcacggtatcgacggttaccgtactctagtaactaggtggtaatgttggtatttcttacgataacacataaatatgcaagtgcacggataccgttgtaccatttcagttatgcgtattttcaagggcatcgtatttatattttttaggaagacggtgctacgaagacatacttatatcttttcaatccatttataactaattcaccatagtctagacatgagttataataagaggcaattacgtttttggccctgctttttcgagttgctcatttgaccttctttttttacaaacgaggatgagacttggccctattccgtgaaggcaacatgacggtgttaactcacgacaaaagttccatttatacccttgtgaatttaacgcggtttctcaaagttttttattcaatacagttttgtgcacttattagtatatatcaaattgcgtcaaacacaaatacatggtacaaatttatgtctaccaaaaacaaacaaaaataccatgtcaagcaacaggacaccgcgccacagacggctaactcctgagcccatccatgcggagcagccgccggcactactcctccctccgcccaccggctccgctgctccgacccggccaccgactgtgcagctccgaccctctgcgagccaccatcgcctcaccgtcagtgctccctccctccttgcagaaccgtcgtctccccactaaagtccgccaccgccgacctgccagagccagatgcaccacatgcgcatctcgacgccgccgaatgcgccatgcgcgtgcctcggcgccaccgaattcgtcgcctcgttgccgagcctccgccagatccacctagtcgcccgttgagccgccgctgccacttctccgcctcgtcgagccgccgctcctcctcttcgtcaagccaccgccatccctcccatgccgctgctgccgccgctcctccgccttgtcgagccgccacccaccctactcctcgtcgagctgccgccactcctcctcttaatctagccacccccatccctcccatgacacggctgcgcggttgctgttgcacgaggagggtggcgggaggaagttcctcttagggtctggtgagaaagaggaaagggagaggataaggatttcaagcttcggtgagagagagagaggagaggaagaggataaggaaccaatgttgatgtgtacaagggtattttggtcaattgtggctcataaaaacatttttttctaaaccctaatggtgtgatgaaaccagggttagacgacaactccaattttttaaaaatagggccaaatgagcaaactttaaaaagtagggtgaaattagtggttatgcttcagaacatggtcaaagaagcaattgttccttataataaagtttgatgaggtagcgaacacacatagaagattcacatataatagaatgtctagttggaaatagcctaaggcgaggttgggaatgaagttgcatttatccccttagtgggttttggtgatcaataacaatagggttaagggactaatgagttttattgagcaatacttaggtgttttagtcccaagatgacattgtgtgatcaagagatgcttggagaccccccacaacatagattcgagcggaatcggaactcgaagtgtgcataggctagtttatttcttgtaattgggttttaggaaaaactgtactattaagaggggttctagatgtggttctgggatacaacaagtgctcttagtgagatccaagtgtcaaaatatttttaagagctatttttgagaatagccctacctaggacatatcaggttggctggaagttccggaccgttgaagggtgaaaatttcctaaatgttgtctggaacttcctggaaattccagacctgttttctagttcaaaaatgtgagtaacggctagataacgtcacctagccattatatatatccaaatcatccacaactcactctttggccatttcacttttgcttttccactccatagctgttgctagcctctcccaagagtttctttgcttcctccacccaatcttgagccattcttgagagagagtgagattttgagggtgaaggagaagatttggagaagatttgaaggctaggattggtgtgagcacttggggtatcttgtgggctgacatctcggtgcttactgctcttggagatcatctcttagacggttaggtgccgcccgcgagcttcctttgcaattgtggatgtcccgggaaagtttgtgaaggtattcctcactttcgcaaggaaatgaagtaagtgagtaaagaagcttgtgctgaagtcctagaggttttcctagtagagcaactcacacttgtgatgttttctagaaggatgttgagttggatcttggtggtcactcaaattatagaaaatgacctagaggtgttggggttgaaggctgtggatttcgttcaagatttttgtacaagtgaggcaaggggttaatcgagacccggctctttggagcacctcaacggagagtaggatcgcgagatccgaacttcgggaaaaaaatccaccttgtcccttcagtgatgtttctgtgcatgtgtctatgatattgctacctctctgtttgcctatgattcaactcgtgaaatttggctgagttcctgttagtgttatctgaatttctctgttgcccggaagttctagtccaagaacactagaacttccggtgttctaactaggaggttccgggcctgttaaattttaccgcagcgatttgtttttgagatttcaggcaagcctattcacccccttcccgccccccttctaggctacatctgtgcgcattcaattggtatcagagcttcatgctcctgattcaagcttcaccgcttggagtgatccaagatgtcgcacttagagggagataaagagttggatgaaaatggtgatggatcaactagcaagggaacgtctacacctaagggagcctctatttcttttgattacaacaaacttaccattccctctcataactttgtctccgtgccttccctgcgttctcctcaatttgatgggacatattacgccgcttggaagcacaagatgaagttgcgtacatctaatctctttgcaccctagcatttggaaagttgtgtgcacatgtgttgatgttccaaatgaagacatggagtttaccacggagcaagagaaagcaatacacctcaatgcacaagccgccaatgccattctctctgccttgnnnnnnnnnnnnnnnnnnnnnnnngatggacttgaggaagccatggaaatttgggatactttgcaattggctcatgagggttcacccgccgtgcgtgagtccaagattgagttgttggagggaagagttggacggttcgtcatggatgacaaggagacccctcaagaaatgtatgataggatgatgctccttgtcaacaagattagaggacttgggagtgaagatatgacaaatcattttgttaagagactccttcgtgtctttgttccaagaaatcccatacttgtgtcaatgatccgtgagagaaaggactacaagaggctttctccaagtgatatacttggacggatcgtgtcaaatgagatgcttgaagaagaagctcgtgaattgaagcaaatggtcaagaatgccgccatgatcaagaaccaagagataggtttgaaggccaatcaagaagaagattcaagtggtggtgaagaaagtgaagatgaggagatggccctaatcgtcaatagattcaagcacttccttcgcaagagtggatatgggaaaggaagaaaggaagatgacaagggcaagaggcaatccaagcgagcatgcttcaaatgtggcgagtatggccattttatcgcggattgccccaagaccaatgaagcaaagcacaaggtggtcaagaagaagcctgatcgtgctcatgttgcggaggcacacatggcggaagtgtggtactccggagatgaaggctctcccaaggctatggagaagggagatggagatggtggcgtggctactgtcgccatcaagtcctcatcaacaaaggagcgcctcttcaacatcttgagtgacgacgacaacgactcctaccaccactcgtgcttcatggaccatgggcgcaaggtaatgcctatccaaaagccctctcttgatgatgataacactagtgatgaggatagtgacaatgaacttgattagatgtttaagaattttagcaaaccggccatgaaacaattgtcaaaattaatgaaagctttggatagtaaagagagatttcttgagaggcaagaagacttgcttattctagaaaagaaaaaaaaaccttgccttagaagaagatctagctaaggagggtgagaggattgaattactacaatatgagatttctttgcttaatgattccatggctagtttgacgagtgtgaacgaaactcttcaagaggaacttgtggttttggataaaaaaccatataaatcttgaagtggaaattgacactcttcggaatagcgcatcctctctaaatgaaactcctatgacacctatgccttctattagtgttggttgtgctagatgctataattatgatttgagttcatatgctactaaccttgaagctatggaggcccttgaaaagaaaaatgagaggttaggtactttggtaaagtatggatgcatgaagacataccactccaaagacgctctctacaagaccattgctacaaatccaaacaaagatggacatgagcttggtttttctgatgaaagtcctgtgtccaaacgtgttgtggtgaatgggaagattttcttgatgtttgtaagagaaggaaaggctccacaagaaagtgaggtgactctaccctttgttggtcagagacccggagcttccggacaaaatgtccagaacttcctggcacctgtcaggatcatcgtcctcctcgcgccgtcgccgcagccaaaccctagccgagccgcgccgccgtctccttccaaattcggctgccactttcccgatccggccaaattaatagaggggaaatgatccccgagatctcctctaccttttcccttttggaatcatcagctaaaatcgcttggaaagtgtcggatttgagctcgattcggattcctctttccttccgaaccctaaaactttccttctcgttgccggccgccgtgggccttcgtcgccgccccctacccgctataaaaggatccccggtaccccctctactcgccgccacccttgctttagttcgccgccgcccgtagcgctctagccgcgtcaagccgtgcgccgccgtcgccgccgcgagttcagccgagcaccgccgccgctccggtcgtcgtttttgctcgggaaggccgccatcgtgatcgccaagctgttgccgacctcgtccacccctccgtcgtcgccgaggaacgccggaagaccgccgtcgtcgtctacccgatcgtctccgccgcttcgacctcatcaccgtcgtcgtccggtcgccgtccgccgccgttcgtgcctcggtaaggatcgccgcgtcgcccactacgcgtagatgccctccgtttgcgccgccgcgccgtcgttcgccggcaagcatgcgcgcccgagccgccgctggtggtgacgtcatcaccgacatcatcgacgccgtccgccgtagaccgcgatgaaccgatttgatctcggccgttcgttttggatagggtagatcccgaccgttcatttccgtagaccgccgcggtgcacctggtccaccgtgaacccgagccgttgacgcaataatccctttttccttttcaaaaataattcattattgcgtcataattcaattaaaatctatataaatgatttaatccgatttaatctttgaaaattcataactaattcatcttagctcggatttagttggttcaagtctctagatttttctaaaattgagatctacatgttaaaaatatccacatgtactgttcatgcttgttaatgtgctgttttggtgattttgctcttttctccttagattccgacgttcccagagagtccgatttcgcaggagaagactttgaagagttccaaggccagcaaggcaagccacacagatcccaaacaaccctttgagcatgttgatcccgtttaaagctattgtttctattcaactattgcattttatttttgaatgtcattgggtggaaataacctattgccttgttatagcccttttgttcttgattacctattctttgtcacttgggtaataatttgattagctagaacattatatagttttagctaaagtgaataggatgcttagccatgcttagagacactagctcatataaatgggatacttatgactcacttttatttcatgatgacttaatgatagctcacgatggttaatcgtgattggttaattaattaatttgccaattaaaacctgataatggtgggttgtgagcacatggttttgatggtctcgtgctcatgacaattaaggaccggttcacgattttcggttgtgaaacatttaccgtgccaaccacaagccagcgtgagcaacggctttactttctgtatagtatggttcattgtagagcaccagactgtgaagtggcggagataagcccacgggagtcactggggagtccatgccttgtttacaagggggtgactatgatccgggaacggtgcactgctttgaattgtgttatgcagagggtattgtcacaatctctattcgggtacttgttaagtatcgcgacgcatggttgacatgatgttgaggttgtgtcttgtgggtacagtgatacatctctggccagagtttaaactattcgaatagccgtgcccgcggttatgggcgggtctaacaatgtctttcgtgattagtttcacacttctcaccatattaaatgatgcggttaataacctgttagctcctggtttggaatggtatattcctgttatggagatagaactgtgcagccgggattggttgtttagaatggttgggcctatgcaatagggtatgttgtatagcgttggattaatactatttaattaaatactctactgttttattaaattctaaaatatttattaaatgctgtttatgcaaatgagactatactatgccatcctttgttatcccgtgcacttgcatatttgctgcgtggcttgctgagtatgtcatatactcaccttgcaatcattcatcagaggaggagttctacagtgatgttgatggtgtggaggattagacgtagcccttggtcaagctgcctatggagtggagtcgtctgcgccgtttatcttatttttccgctgtttagaactttattgtttgagaggaactatctacctctgtaatgacattttattcgcttattaattagagtaataattgtactctattatcaatttgttattgtgtgcctcggctgattcctggacgagggtttacacacatgtaagcgtttggaattttggatagaaattccgggcgtgacattgggggaggacccgacaggtgggccccacctgtcggcgaccccgggagagagaggagggggcgcgggcttagctgggccatggccttcggccggcccagcaagggcacgggagggagaaggaaatgggccggcggcccattagggaaaaaaggaggaaaaaggaaaattaaaaagggaaaagaatttccagggatttaaatattgcttgtgctcatttttaattggttaaaattatttctagagctctgaaaattccactaaaaatcttgttagcatatttcgacatgtagaactcaagaaaaattccacatgccaattccgattattatttgcattaatttaattagggtttcactcttgcttttacactggtattttctcgagactatttataaattcaatttaggcttgggagaagaaattcagggtgtgacatcttggttgttttcctttattgtgaattttctcaccaccttgcttttcatacttattcaaaagcatatcgaaagtcacctcagtcttcttaggagctttggaacttgaagcttcactcctattctccttccaaacatcaacctccggattctttggcaccatcatctttggcctaggctctccaatgaacacttttttccccttagtggattcggcttgctctggccgaatcaataccttcttatcattgaaatcaattgtgttcaccgggaaaggatcatgatcaagcttcatcttggaaccatcagtgaatttcaatcgtccttcatctatggccgattgaatctgtcgtcgaaatacattgcaatcattagtagaatgagaatgagaatcatgctatttacaataagctcgacgtttcaattcctcttgagatggtatgacatggcctttaggcaatctaattatcttttcttgcaaaagataataaaaaaatcttatcacatttggccacgtcaaaactatacttaatctcactttgtcgatctttacgaggagtcggcattaaattagaacaaacaaaaggattatttttgttagtccatgaccactcaacaacatatatatcatgatcaccatcatcatcataatcactagcctcagggtaatcaatcaaattaacattaggcttcttaccatagggtctaacaaatttcttactatttttaacccgactttcttgagccagagccttttgcatgagttgactaacatcaagaaattgttggccttctaatctttctttaataggagcaattaaaccattaaaagcaagatcagccaagtctctatcagttatattcaagctataacatcggtttctaacatccctaaatctcttgatataatcaatgacatattcactgtatttttgcctaatcgatgttaaatcacttaggctaagtttagtttaaccagtatagaaataatcatgaaatatttgctctaattgaggccaagtatggatagaatttgccggtaaaaaagtaaaccatgtaaaagcagtaccggacaaagataaagaaaacaagcgcaatttataagtatcagaactactagcctcaccacattgcgctaagaattgacctacatgctcccatgtggtcctactatcctcaccactaaatttggtaaattcggaaactctataaccacgaggatatgggatgttgtcataataatcaggatacgacttttggtaaaccttagcatgattcctagcttcaatcctgaatttatccctaataataccactaatcaattcctccatattctcaggcctatgctgatttggtggtgggtttggtggcctaagaggttgcggttgcggcgcaatataattatattggccatacctagtattgggaggatatcccctagtaggattattgtaaacatttgggatatgtgggggaacttgggtattaacagtagatacaggggaatcatgtactggaatatggtataaaaacccattatttgtcattggatcaatcccctgtattgggatgattgcgccggtctgactggtccagggcctggtttgaccgatctggggtccaatctgaccgtagggaggaaacccggtctgaccggccatctgtcctgtatgaccagcggcgaacgtgcggtctgaccgcccatctggcctgtctgaccggcggcgaacgcgcagtctgactggccgtctggcccggtcagaccggctgaatgcacagcttctccctcaccggttgtttgcatatttgccccatcggttttgctataaatttgatctacaggggctttactagtactggtagaggctttatctttaggttggaaatcggctataaaagaactgaatctattccttataaaatcatcaatacgctcattaaaacgagattcaaacgatgcatctaatttattatttaaagcagcaatggatgaatctattgtatttgctatgagttgttggataggagttgttacctcttcagtacttaccacatcaaaattaggtttaggcaacaatccatgcttgagaaccacaccttgacgagtcctggtgcacgatctcatcaacaccttgaggtgttcctccatgatcttgcgtgcttccccatcaagatcctccaacgagattggaataatattggatggttcaacctccggtttggttgttggcggcttcgtcatggtggcgtcgaagttgagatgacgttgagcagatttccccagcggagtcgccaaaattcgtgctggcaaccttttgtaacaagttgacaagcacgatcgcaacacctaaatgacttacggtgatcctagagtcgctaaccacctcaatctagccaaagctaaatcaagatgggttttgataaactaaatcggctagcggagccgatctagatagaactatggataactactcgtttcgtgggcaaaacggaaggttttcaggataaacctacaaagagctgtcgcactctcgcagtggcggtggacgatttacgacgcaaattgataaagatggacaaactaaactagtactagaaacaaaagtaaaagaacgatttgattaattgatagttgattgcttgtttacaattgaaccggccttgtcccttatataggggttggtcttgccctctacaggccctcctccacgtccaactcaggctaaaaatagatggaaacacgaaacatgcaaggaaacccgagattcgatgaaaacggagtctgactcggactctgccgatcagaccggccacatgccggcggtctgaccggcccactagcggtggtctgaccggccaacacacggtggtcagaccggccctttcagaggaaaaccggtagatcgttcaaattttggcaatttctctattttaatcctaggtgccaaatttgggtgtaaacacaaccattgcatatctgaaaatttgtgagcaatataaaaccttttcatttctagatctaaggtaagaatgaaaacatggtgtgtgcttgcatgtgcataatgagcatgatatgacttgagctctttcatgtaccccaaataaatcacttaaaacagcaaaaacctggaaattacagatttcacttaaccctctttgctaatccaccataaattaatcataatccatttaggggtgaaacctggtcgaggctgtagaccaaaactccctctaccaccatcttttaaaccacagcaaggcaccgacaagtagagtcaaaggctcaatagtgctgcagttaaggagtagggcaaaattctttgttttccccatctctctcaacctctcactgccagtgggccacagggcgatgtgggacccactggaaagcctcacaagcccttcacccggccccaccatctacgacgcgtgcgccatgcctcccacacgtcgcacacgccggccgagttctctccacgtcaaccaccttgacgatctccaccattcaacccgccactccaccgaaagtctcctcctctcaccccgagtctgttacgtggaagagccaaggaaatccatccttcgctcgccgggaacggaagcatcttcatcagtgccggtaagatctttgccgtcgccatttccgcattggtgagcttcgccgcaaaccgagcacgggaacgtgatccacttaccacacttaatccatccgtgcattttggatccagttgcgaaggtccaaatcgtcgcttaatcgcaattcacactctcgccgccgacgagccctagctgctgcacggccacgttctggcgctccggtggactccaagacgagccactacaccatcatcttcgatatctcaaaagagcccaagagcccaagcactcgaagctaggtagccggccggagcgagtagaacaagcattcttccccaattccggccgctggcgtcaaccttcgattctagccgtcccggcgagcctcacatcgtttcctggcacacgcaccagtgcaccacccttgggacctcactaacatcatgcgtaccatgttgcaagctagatcgagccgtcactgccatcccggagtggagcgtcgccaccgaggagttccgcgagccgcgcgccgtcgccaatgaggcttcaccaacccctcacagccactcggcgagtcccctaagtgcccaagacaacgcatgcaagcatcaacacccctagatccagcctctagagtgacatgcaacacaaaccgagagccatcaccgtggccattgagtccgatcaccattatttgcaacaagaccaccgatggcttcgccatgaacccctctacgttttggcctttggtcgctcaccgagatcagcctccgtccgccgccagcgatggtgagaacttcgccgccgcgccgtgccctgcttcctagcccccatcacgctgacatgtcggacccacataattaggcgctgaggattacacttagcaaaagtttaaaacttgcaaggttctaaatgtgaaatatgttaagacttacatgtgggatcttgacctgaaagtaattacctaaatcttgggtattcttaatgaatctcccttttaccacgtgttttgatcacgggttgaatcctggaaacctcaggggcctttttgcatattagccattccctgaccataggaccccatctatttaaaacccgaaaatatgaaagaaaataactaaaacattatcctttcaacagaaaaacattcaaacttgaaattcatataaaatcgaataaaactcattttgacataaaaccaacttctttagaatcgtaagattatgaaatttaatgtggtaaactaaaagatacacttactgtataagaaatacccctaaaatttttataaagaataattaccataaaacgtacttcaacttgtaaaattggaaggaaattcatttttactcaaatggagtgaaccaaatttctgtagaatcagtaacatgtgaacttcaatttagtaaaataaaatttggaccttccgtggcaagatcagtacaaaaaagattgtatagcaaaataatcaccaaacatatagcccaatttctaaaattcataagaaattcctcctaactcaaaatacagtgaaccaagccccgctaagtccacagccatgtactcttaaacactgtaaaaaaaagtacctttagtataatgatcatctctaaacttttacgtacgtagtaaaacaagcactaaactacaaggtataacttgtgaacatcatttaaaatgcacttggtaagaccagtaaagatatacttttcattcttgataaccaaaacctggaacaccctaggacatacaatgtctcccaagttaatataacaaattatcaacatagaccatattactagttgtaaaatacataagaaaatcatacaaactcaaaaaattatgaaaccaattgggttaatcttgtaaaacaatcctctttcacctctgtaaattcaaatttaacaaaatcacctatcaaaagtatttcacaacactacctaggtaaataataccctatgtcagcacaaatttggaaattcataactgataaataaaaagagataaaatagaaattcattcacctaaattcacccactatggaaaaattatgtattttagagtattttgtatttttcacatattttggtatttaattgcataccatgtattatatagatatttgtgttaacggtgaaagtctgacttaggtgctgaccatattgctcaagatcaaggcagtttctccccacctcgtttgatcaccttgaaccctatgatttggggaatgaaattgttattttcaaaatagcacatgtattttgttaatacatgtgcccaacttagtaaatagtagatatgcccaacttgctcaacttggtaaatattagatatgctcaacttgttgcattaaccaccttgaatatttgtgcgctcctctgtttgtacccctacgaatggttagagcacactacctatgctcgattgggtctatacatgctttatatgctactacttgcttaggcaagcctataactatacaaatattcatttttagcactttataaatgcaattttgggcatttatttatttcttgacagaagcgaaaatgtttagtatttgtgaactaaaatgagaataaaatggttttagacttgggcgacaactgttgtacgtatggtggtagttgtacaccgatagggggagtgtttgcccacatccacatgtgctattcatggggaggccttagctaattaagttatttaatgactaactttgcattttggtaggccgagaaagaacgggcagtgcctattgacccgtaatggtagtagggctatctagaggagctatccatgtgtgtgtgtttcatgtgaggatgattcattccctcgtgtgtgtgtgtgtgtgtgtgcgtgtgtgtgtgtgtgatccgtggggggacaactaactattccacctcacagaatgggtgtctaagtttgttcaatacaacagtattgtgccttgtggggaaccgggttggttgcgcctatggcgttaggtttaagccatgggccagccacctagcgatgttacagtctagatgtagcatggagtaatacacatcatgctggtgcaaggctaggcattagataatgtaaaggcttcgttgtatcctctagaccacattcaacatgtagaatgtggtagtgcttcgcgagcacgagacaaactagattgttcataacatatgggtaaaactgtacaaactctacagagtctaaaactaatcgattaaccgtgctcacggtcaagagcgacttggtgaggtgtcatgagtatagttttatacttttaaattgtgtttgtgaaattgtgacttggaaatggtgattcgaatttgtttagatgattttggatgatgagattatgccttgttgccgaggcaacaagggtaataatgtgaatttgctatgatctgtattatggaacaattatactctactttaaaaatgatttacaaattccttttgcaaatggttgtgaaacaaaacttgctccaaaaacaaaactacaaatagccatccttaaattataagccttgcatgtagaatgttatgaatgtactgactcttgccatacatatttaactttgttttgcaggtgtcagacctagtttattttgagtgatcgggtaccgttgtttctttaggacttgattctattagtggtctacccctagtcgactgcttgtggtttgggtagccaagcttccgtgaatctaattatatttgaccggtcaacctatgtatattccataatagtgttataaactgaattttattaaagttacaccctattttatatgtgtaacattgctttagatgaaactgtgggactagtgcttatcttgtgaactagtcctacatgagtatgagtttagagcatttgagatgttattgagctctagcgattttgtcaagtctcctttgtgtggtttgacagacatgtctcaggctaaagttgactagcacgcttagtcctagctagcaatatgtcacaccctgaagttcttctcccaagcctaaattcatttaataaattatcgcaagaaagctaattgtttaaggcaagagagaaaccctaaattaataaatgcaaataataatcagaattggcatgtggaatttctcttgggttctacatgtcaaaataagctaacaggatttttagtggaattttcagagccctagaaataattttaactaattaaaatttagcacaagcattaaaaatccctagaaaaatccttttcctttttcttttcttttccctccctttttcttccttcttgggccgccgcccgttccctcccctcccctgtgcaccctcagctggccggcccgaggccgaggcccagctagccaccccgcgcccccctcctccctccgggtcgccggcaggtggggcccacctgtcgggcctctcccctacctccggccggcgctgtccgcgctcgcgaccgccacctcccgcctctcctgcgtctcccgcgcacatcgcccgcctcccgtgcgcggcccgcactcccccgtaaccgccgccacactcccccgcttgcgcccacacttgagatggctgggatttgaatttcgaatcccgccggcctctccctctctccacctcccccacttcgccggccgttttgcgcccctaccggccacgtctcgtcgccccgcgcctatataagggaccacctcaccctcctccacctttttccactttttgccgaccgctcccgagctctccaccgttcccacatcgtcacacccatcgccgccgcctcttccaccactccggccgctgctagccgtcgctagccgccacgttcgccatcccgcgagccgccgcgtccgccattcacctagccgattctgccgccagagcccgcctttgtcctcatgccggtgagcacctccatggccgccgccttcggccggcgtccccgtcctctgtgatctctctctccctctctaatttctcccgttgtgtcccttaggcaacccaggagctcgtccgcccgtcgccgtcgccgtctcgccgctcgctgtcgtcgatcgtcgtcggtgaggccctcctctccttctctctctctcggtgccgcttagcccgccgcttagcgccgctccgtgccgccgtgttgccgccgcttgagccgagcccgtgcgcacccgtccgcttgtcgccgccgccatccgctcgatccaccgcccgcgtggcagcccgtgtgggccgccacgtcggcgccatgtgtgcaccacgtggtgcgccccctcccccggtcccgtggactcggtccaccgtggactggcgcacctgtgccacctccatgtggggcccgcctattggcgccgctctctccgatgacgtcatccgaggtatttaatgcgcaataattcaattaaggacttttctgttatagtaataaacacagtgaatcttctaaaattcatagaaaattcatccgtgctccgtttaagcccattgaagtctcagtaaatcaagaaaaatgcaaagaatctattaaaaatggttttgttctctatttcagtagtcttatagcctgtttgcattgtttgccttgtatgtcgcatagattccggctctcccgacgctctggtgtacttcgaaatagtcgctgaggtccctccaaccgcagagctaggcaagtcatgcttgtcacttgaacatattgaccccatgttgcaaattctctatgtttcctttaaattatgcattgttttataatgttactatacgggatgttacctactatgctcagccatattatttgtgtacctcatttctttgttagcttgggttgtaatatgactagatgttggattaggatttgcttagccatgcttagttcaactagcacacaagagggaatcacattattgcatagacattggcttttagcataactttggatgggtgccaccgcaatggtgttaattaattaaaatacactaaatggtaggctgtgggtgcatggttttgctagtcgtgcccatggcaattaaggaccggttcgcggaatgcccaggaagaacttatcgtacttaccacaagccaacatgggcaatggctaggcttgtagtgtagctttcctctagctaatgtagctaggctagggtgagcgagatggggttgggtcggccggggtgctcggttgatcggcttacggattcaccgtggcacgagagggggcttgcggattcaccgtggcaccagaggatgctatgggctcgaggttttaccccgggatggagaaacggtgaagggcggcgacgcgtggtgcggtgcggacgaagcaaaggcggctagctgttggtgacgccaaaagtgttcgacgcatggttcccggtgtccggtggtcctcagcttccccaatggcaacggcggcagcacgacaccccctccactccctccaaccaccagctccgaacggggagtcccgcaatatggtctttggtagcggtgagattacgcacacaaggtgttcgacgaaatgtattcgggaagaaagctgagaggaatggggatttttgttaggggcttagcttagggtgtaaggaaacggtgtggataagatcaccagcacatgcccatgcgaaatagagctctaatggctatcggataagggcaaggaggtggatgacgtggataaggtttgatctcctcctccattaaggttctgtagctccatcatcgtacctaaagcctaaagtctgtgcgttctagctctagctatggcaggaggctccgttttacctagcggacataaggaggggcgccaaaacatcatgagatgtggataaggttttctcttctctctcacactcagggattgggggaatcaaatggccggtattaggtttgcaggcctcaaagctaggggtgaagaagggcgaggtggcggccgttatccctcggcgtcgagaggcgacgcgcgatggcgacatcgatgacgccggcgctcgtggcggcatgggcggagcggcttccgcggctggggcccacgtgcgagcacggcatggcacacggtctcgctaaccatggtgcatggtcacgcggtggagtggcgcacggttacgcaaagaggggcgcgtggtgggggctgggtcgctgggtgttcggctcactaggttcgagtcgaacacctggcgcgcaatgaacagtgccatgctggaagaaaaagagatttttagggttttggttgatttaaaaatcgagaaagatagctaattcaatttgtattttcaccaatgcatttgatcaacaatattaagtattcaaatgtcaatttggtccaaaattaatattgtccaatattttaaattttactatagcttttatgatttcctatataacttgtaggctctgatatttataaaaattaatcaaaatattctaatgtgactactattaatacaattagctcattggttgtacttatttgtctagcaatgtattttacacggaaaagtttaatctattttattctagaggtaatttgagacttggtataatattgatctaagtatttaattagatactaccatccttcaatctttatatatagggatccatttattttatgtgaccaattattttatatgagtgaattttatgccatgagagatttgttgtaagttagagatattaatttaattattccagtggaacactcctatatatagagagtcattgtagtggcaactatttcatggttactcagatgtcatgacactattcaatccgtaacttatagaaactaataattgacttgtactttatttggctttgctatcttgtgtatcaatatttatatggttaataataaataatatattattgtgattattacttagatgtatatatttagtttaattttccattgtgacaattttatagtttagcgagcaataacaatcataacagccagcatgatgcaaaagttttaaaaagttcgaaattttagtgatttttattatcaggaattttcaggatgttacactctatctccccttcctccctagagttcgagtatgcgtcagatggtggctactcggaggagtagacttcgtctgtgccatcgaggatgcatgtggaatggtgtcgcccgctgctatccaagtcaagacctagtttaggtttatcctttaatttccgttgtatttatgtaagactttaatatgtttgtaagacgtggatatgtatgtcaacattgtcgtttatgtaccctggccagtcctggactggggttttaatgcacattctgcttggacttctattcgggaatttctgggcatgacacaatatctcctatgttatctactcaaggcttcgggctttatatatgatttttttacggttaaaacagcaggagaggctcctactgtgcggctttatttatgattgctacttgatttgatgtgttcatttcaattagcaaatataatgtatagcccagggttctccactgataaaaattgtgaattccatttccaaacttagaaaacttcatggggaactgaaagtagacttttcctacattttattatatccacaagttaaattataaacaccttaacattaggcaatgtgctggacaaaaaattataccttccacaaagtcggcattttgttctttggggcctcacttaaggttgctaattaattcttattgttgataatcttgataatcttgtagatgtcgttcatttggcagccattgggctactccggggggttcgaagaaggaaccttgccccatacactatggctcatgttacaaatcctcggctataaccatcaaccggagtaccactgcttttctgccgagcgaagctcttcacttagaattttcagatcagagttgtatatccaagggagatgggcaaatgaaacagccctcatttccgtggttacgtctgggatgcaccctcagctatgcttgaagttgcttaccaagctatcgtgtattttcagcaccatatgccggggataaccaccagtcactatccaggtttagaagggcggtcagggaaccttaacacaccacttcatcttgcaggcttagtccagtcattggataggtacctcaccttagcattgaatgagcttgacagggttcaaactagagtcgccacacttgatagacagattgaaccattgggtcatcagggatattttagcaatgatcttatctatggtacactacaagaaatatgaccttctgtgacgaattcctcatgacgtcagagctattcgtcattagcacaatccattttatgacgattagtatgagatggggtggcttagtgacgaaaaaaaggtgttcgtcgttaataccaactagaaatcgtcataaagtatttcgatgggagatcgtgacgaatattaatttgtcataaggggcacaaagcaaatgtcatagatttatataatgcatttatagaaaaatatattaaaagttaaagcaatttagtcaagtgaattaaatgaagaaactaaaattttcctataaaaatgatggctagaaatatttttgtaatattctacgtggtctaaattattctctgaaattttccatcaattttaggagcttaataactaattttaataccacaaagttcatttaacctattaaaataaaataaaaaccaattaaaatcccttttgtctttgggcctttttcggcccaagtattactctctccctccttcggcccgcagccactctttccctcattgggccggcttcccctcctccctcttgggccgccggcccaacccttttgctcctccctcgccgaaaagtctatttaacctctctctcctctcaattcaaataatttttcgggtactaaatgatttcaaatgaaaaaaattgtcaacaataaagttgtataacttatcaagatctacaacttttattttggtcattttgctatatgactttgtttcaataatttgaatttgaatttcaaattatgacaacttcaaacaatattttcaagtattaaatggtttcaaccgaaaaggttatcagcaacaatgttttataactcatcaatatctgcaacttttgttttggtcattttgctatatgactttatttaaataatttgaatttgaatttcaaatcataacaacttcaaacaacattttcaaatactaaatgatttcaaccgaaaaagttattaacaacaaagttgtataactcatcaatatctataacttttattttggtcatttcttcatccgacaaaatgatagtaacattgttcacaaaatttgtatatatctcttataatttataaaaccatgtaagagatatgtaaattttgtgaacaatattactattacttcgtcggatgaagaaattaccaaaataaagttatagatattgataagttatacaactttgttgttgatgacttgttcagttcaaatcatttactatttgaaaatattgattgaagttgtcataatttaaaattcaaattcaagttattgaaacaaagtcatatagtaaaatgaccaaaataaaagttatagttattgatgagttatacaactttgttgttgatgactttttcatttgaaatcatttagtatttgaaaatattgtttgaagttgtcataatttgaaattcaaattttatataggtcaatcaaactcaaatgaagaaataaccaaaataaaataggtagatctcaataagttgtacaactt

SEQ ID NO: 15037 - DNA, 5650 bp, Oryza sativa
tgaaaaagtcatcaacaacaaagttgtaaaactcatcaatatatataacttttattttggtcatttcttcatccgataaaacgacagtaatattgttcacaaaatgtagataccagatatctatattttgtgaacaatgttacaaatcactttgtcgcaaatgaccaaaataaaaattgtagatctagatggattatacaactttgttgttgatgacattttcagttgaagtcgttcactgataaaaaattctatttgaagtgctcaaactttgaatttcaatttcaaattattcaaatagagtcagatggagaaatgacaaaaataaaaattttgcatatcgatgagttctataacttcagttttggtgaagtttctatttgaaatcatttattaaccccattttttgttcgaagttgtcaaattttaaaaattcaaaatttgaattgttcaaatgaacttatttgtaaaaatgaccaatacaatagttgtagttctcgatgtgttctaaaattttgttgtttataatttttgcatttgaaacacaaaaatcagcctaaaattaaatttaagttctcataaatttaaggtgaaatgtccattttgtccatacaattttgtagctactacagcacaccagggacattttggtaaattcgcatagaattgctccctgtccatataatagctcaaccagtgaccaacgaaaccttatcctctccctctccaatctccctcttcctctcctcagatcggggcgccggctgagaccgagcggcggctgctcgttgcgatcggggcaggaccccgcttctcccgtccaatccggcggtggctcggtgacgagagtaggggcggcgagagctcggctcctccctcgcctcttctcccctccaatcccggtggcagcggcggcggcggctccgcgacaaggaagggcggcgggagcttggttcctccctcccctcttctccccttcaatcccggcggcggctcggcgacaagtaaggacggcgggagctcggctcctccctcccctcttctcctcttctcatccccgcttctcctctctaatcccggtggggtggtgtaggtgcgggacaagggcggcggctcggcaacggcggctcagcggcgacgacgacgacagcgacatgggaggggccttggcgactttgacgacgaccgtgacgacggagggcctcgtcgacatcgacggcgcgcggtggacggcgacgagcggatccggcaccacctcctccatccaccgcgccacctccatctccgcccccagccacctcgtcgcccttccccgcctcgctcccccagccagggaagggacggtggcgcgcggatctgccgcctcccggcctcgggagcgacggcggcgcatgaatccagcggcctccgtcctcgggagcgccctggcgtgagcgggagtgccggcagcacgcagattcgcaacgacggtgacggtggctgcaacgacgacgacagcggcgatggtagctgcgacgacgacgacggcgatgacagcggctgtgatgaaaacgacaacgctgtgatgcaagtagcggcggtgctctcttcctctgtcctccgccatcagcagcaccagtataccctgatcataagagccgtagtactatggctgatcctgcacttgctagtgatccagagttacacgggctgtcttatatctatgagaggaatggtcgtcattattgtttaaccatggcaactcctactgtagtacctaatcctccagccaaattttcagaaagtgcttagaccttgtattagggatcttcgaaaaattgtaattctcttttaagggcacacagtagtatctcgatataaactctctggtagtccaattttgtaacaccatgtcttgtacttagtctagaatggctaccatctatctttatgtatgactaccatatatatcaatgagaaaccatgtgatccatcaagattattctcacatttcgaattaaaatgcttgctgtccagaatttattgttatgtaaagttgagcttaatttatttaaaatgggcaaattgcactattgaaacgtaaatctagtgctctattcagctatcataaaatttagcacatctttgtgcggccagctcatgtactcttttgtactttgagtgcaggatgacttgcaccctatccatggctgctgcaaccgggagtcagggctccgatcgagacaactccttccaatccaatccgccccggtactcattcgtcggggcaatccagcagcagtcggcgagctgctgaaggcgatcgtcatgatgaagagccctctctacctcacattttagccacacaaaaccagctgtttgaacggatgctagcaaacagtgaaaatatgggttctgccatggctcacaatgcaaatcaaggacagtccaaattagcagatgttcaacgcacccatcctctacacttctcctctgctagttgcggatccacttgtcgcagatgatttgcttcgcgatattgaggccaagctcaatctttggctgttcatcaggaggtattcaggtctgctcatattctcgccggcctcatggaaatcaataagaaggaatttctcaacctgaaacaggcaaacatgccttttatggagttcttggatcgtttcaactatcttggtcgttatcaggaccgtcccgtgaaattcaggggcctgtgcaaaatcttaatagaatgctaaacttaattgctaaaataaaatgaataatttaatacttcataatatatttcatagcaacataaaatagtcaaaaaaattatacctatgcgtaatcttcacttgaaaagcatcgttcttttagtgtttcttgagataaaatcttcaattatatgttcatattgaatattcttcagaatgtatgttcatattgaatcttcttcagaatgtcaccctcaagtgctattatcaacacaattaggttcattggcaacgttaatatcaagtgtttgattattggatggaccttgtgattcttttgtaatataactctgcatagcttctttctaagattgagttaaatcttctattctttttttttcttcttacgattataatacaagaaaggcggataggcctaaggtactcagcccaccctatgctaataactcgatggttcactatgaggtacccaagtaccgtataccctacagtagccccgggtactaagcttggtactagttttctgtatcatcaaaaccgtcaaagaagaacaaaacgtgatgagtactcaaagcctgaatgccgccgagctatatatcatgaccgagtaacctccacttgaactgaggaattgaatcatcaaagaggtatttcagactttatcgaaaaaacttctagggctggcccattgaagcgccttcttactctataaatagcgacctagacggaacgaatctcacccaaatcccaatttgagcaacagtagtcgtgcctcttcatcttcttcacctcacccatttttcttcttgattccaactagggttttttaaacctaaaccaaacaacttatccacccaaaatctgaaactttccaaccttccggattcgaatccccgaacttctcctcctcaaaatgtcgggttcattgggtgaatccgtgtttctaccagatcgcaatctcatcaatgaccgtcgggcaccgcctccctagcttccatgccatcgcccgcacctcccggcctccataaccgccaggcgccacctccctaacctccacaacaaccatgcaccccctgccagccctccacaattgcaagggaccacctcaaaagcctctaggccatcgccggcacctccacgctttggccaatgaatcatgtcctcacccacaatacctgataataaataataaagaactatctccgctttttcatttacttgtcactttttgcacttttagtacgcaaatagttgtcactacgcgcttacggaagttgtggttcctatattcttcttagtgggcctaaaattatatttatgtggcatatgtgtttagaagtttatctgttttatatcccactaaactcaggggcattttggtcattattaattaagttttaggttgagctgaacggtcgcacacgaaacgagagatcttcaggtcatgattaattgagtattaactattataaacttcagaaagtgggtatatttaacttttaaaaaaataagttttatatacaaatttttgtacgaaacacattgtttagcggtatatggaaagcgtgctcaaaataaactatgaagtacctgccccccaatagcggataagaactcacccttaaccctgttattgcataacggagtattacttacgagctatttggtgcagagctaatccaggaagaaattgctcttgtaacctattcgccactccaaaattcgttcccatgttaatgggataatttgttttttttttaaaaaaaaatctggagagactcaatgtttaagctctctgccgatccaaggtccaatgctcactatacagacttcattcaatcagtagaaatccacttatgcagatgaaaaaaaaagcaactcttgattgcaatcaatgaatgatccttacagaagcctgtttagttactcatcaacggtagtgtatttgatgtctgggtatatatgagtggcctctactccgaccgttggtttgatctcaaagttgatgtgatctccatttatatatacagaatgaagtatggccagatcgatgcttagtggtgaacactctgcaagaccaaatacaatgatttttatatatattccaactatatagacactattaagatttgatatatagcaacaatcagacaagtatagaattcatttccatggtgtttctttaaaaaaataaacaacattgttaacttatttcaattattcaaaacaaatatgtagtaaatgggaaggtttaattctaattggaatattttataatctcatattagtaatttcagagtgatattggtatattgttgtgatggagtcgtgatcaagtgcatgagtctatcgagcaggatataaatcgtggtgtccacagtaataataactttgggcattctagtttatgcaaaaaaaacttatacttctataatctaaaaactgttggaaacaaaaacggaacactcagttactgagcctaggagcaccagtactgacctgtgatttgcttgaggattgcctcttcagtgagatatgtagaatcgaatcacaagaactaagccaaccagagagggggggggggtgaatggttggtatacccaaaaaccgaaaacttttagcagaaataaaaggtaccctcgaaatcgatggatcgtggtctgattgaagtagttgtgtcggtctgaccgcttgatgaacgtcggtctgaccgatgtagatcgatcggtcgaatcgccgaaaacgcctgccgccgactcctgtcgccgccggtctgaccgcgtgtgcccaccggtcggatcgccacgatgccgccggtctgaccgtcggtgcgccaccggttagaccgccgaaacccagtgaaccacaaatcgaagaactcttaaagtagataacgactttattacttctctctatgttttacaaagtgcaccaac

SEQ ID NO: 15038 - DNA, 1251 bp, Oryza sativa
accaagcatctccaccttgactcattagcagcaaacaatagtattacatacgtatagtatccgtctagaagtcataatcatgaaataaactctagaagtcataatcataaatacacccccccgtaggatatccaaataaacaacccgaaaccgaaaccgacacagtgtcggccagtcagaccgcgggttgcgccggtctgaccgcgcattacacgccggtctgaccggctaccagagcccggtctgaccggtcacacaaaatgataaaatcctgcgatcacctgtaaatccaatcatcttcaaaaccactttgtgaataaattccaaataacaaaaccaataatctccaatgcccaattgttcatcacagaataataatcaaaaacacctttgattttacaatctcccccttgatgaacacattggcaaatccataaaaatgttttggtgtttgaaaaataaaaacaaaagtggtaaaaagcacacttcgtacaaacgtacacatcgtgctcgaaaaatccaaaagaaaacttctccccctttttaaaagaaagaaattcccaattgaaccaaaaacatgctcttctcaacaactctccaaaaattcatcttgcttctcccaaaaatccaaaaattttcacattacttctcccccttttgacaataatttcattaagcataggaattatgttcattaatgttcaagagcttagcatacatatagcatatcatgtcatgtggtgcaataaaaagaagatgaacccatctataacataacaagcatgcattaaagtataaccatgaaccaaagattttacaattaagcttgaatcaacaatcagaattcatgatttcatatgatttataatgcaacatcttaacaagcacataggttgaagaataaacactaaacacatatacctattgcatttatcactctttctcaaataacctttagcacaaaataaccaagagaattttttaactttttctttttcttgagcctttttgctcatatttttctcttttattccgagtacgtccctgtcgtcaagactgtttccagggattcggcacccattattttgctcacatcgaatacgtccttgtcgtcaagactgtttctaaggattcggtattcatttttttcatatttttattctctttttcacaatgagcaattaaagctatttgaggaataacaagttaataaaacatatatatatatatatatatatatatatatatata

SEQ ID NO: 15039 - DNA, 10691 bp, Oryza sativa
ttctttagggaggagaaccaatttttatcaccggtcatgtgccgcgaacaaccaaaatccacaatccacacgttctccttccttgccaccaaagcctacacacaagcagaagtcgaagcctcagtactggggttagatgataataaaaatttaggaatccagtactgagacacacgaccagaagatccaatagacaaatatccacgtgcaaaatcaattttagaattttcagaaaaattcatccgaggccggtctgaccgaggtacggtggccggtctgactaggggccggtctgaccgaggcttcaccgccggtctgaccggtggtcggtctgaccgaggctgttcaaccggtctgaccggtcgccagtctaaccgcgggacccactgcggtctgaccggtgtcctcgagggaaaaccggatttttgccactttgattttgcaaaagcaatctctctctcctttttctgttatgagctaatctgaaacaaaaatcaacaatatgtccatctttgccaaaaaaaagaacaagtatatttttcacgttgtttagacacattgttagagccagaagatttagcaacacaagcagaaacaggaggttttgcatgcacaacattggattttgaagaagatgcattcatggtagacatgataccagcagatttaaacacagttttattagtatcatgtttaatcaaaatctcaccacttctagcaccaacacctaacacaataggaggatgtctagaattatgagcataaggatcaaaacctaaaccacggttatgtgtgctaacctttgattgatccaaaatctttttaccatcagaaaatcttagcaaagaatttttcaaataagaaacctcttttttcaaattagcacaattttttcacaatctaccatgacacctgtcacgtccggaaattcactagtaatttccgaactaatttgtgcataaaaatccttgtccaggaatcagccaaggtacacaaattgacaatttaatatacaaatccatcataaaaataacgttacatacttacaaaagaaaagaaaacagcagcggaataacggtctagcgatggcttcagctccactcccacaggcagctcaactagggtataagccaaacgtcttctccttctggatcctttttcttcaactgaggttgattgattattgcaaggtgagcatatgacatactccgcaagccacacagcaaatatgcaagtgcacaaggataccaaaggatggcataatataggctcatttgcaaaaacagcatttagcaaacatttagaagtaaaacagtagagtaatcaatcatcaattttaaccaacactgcacaacaccccaatgctgcacaggcccaaccatcctgaacaaccatacccggctgtacagatctaactccaaaccaggagctaagcaaatcattatcagttataacatccataattattgtgagaggtgtgagactaattacgaaaaacattgctcaacccgcccatgaccgcgggcacggctattcgaatagttttactctggccagaggtgtaccactgtatccacaagacacatcctcaacatcatgtctaccatgcgttgcgatactggaaagtacccgaatagaggctgtgacaataccctctgcacaacacaactcaccacagtgcaccatacctggatcataatcaccccctctacaaccagaggcatggactccccagcgacccccacgaacttctcgccgcttctcagtctggcaccccgtaatgaaccatgctatacaaaaggtaaagctgttgcccacgctggcttgtagctggtacggttaagtttcacaacagtagctcgcgaaccgatccttaattgtcatgagcacgaccttcaaaaccatgtgctcacaacccaccattaatcatattttaattatcaattaattatcataacacgattgaccatcgtgagctaccattaaatattaccataagtaataatgtagtatatatgattcatcccattaatgagctaatgtttctaagcatggctaagcaattatatatatatatatatatatatatatagcatttagctgaaccaatccaatgtgtaaggtccaagctaatcaaattataacccagaggaaaataaagtcatcttcggccataatcaactgggaaggctcaccacccgatgacattcgaaaataatgcatacgttgaaataaaacaatagctttaaatgggttcaacatgctcaaagggttgtttgggatctgtgtgacttgccttgagcttccgcaaacacttccgaaccttccttaacgaaaacgctctcctccggaacgtcggaaactaaagcgaaagaacaaaatcaacaaaacagtacaaaaacaagcataaccagtacatgtagatatttttaacatgtagatctcgattttagatgaatttagcaacttgaaccactcgaatctgagttacgatgatttagttatgaatttccgaagtttaatcgattttcatctaataaagaaaactaagaatagggattaatgatgtcatcgctgacatcatcaatgtcgactcgacatcagcgacgacctcgccggcgctagaagactcggccggacttttggagggtacctacgcgtagaggagaacaacgcgatctcaccggtactaaccaatgcgacgaacgacgacggatgacgaccggcgacgagcttgtgcggcggcggcggttcggtggacggcggcggcggctctccggtgaccggtggcgacggcgaaggggcggcggagcttctactccaccgcgcgcatctaacggcggcgacgggaggcggccgtgacgacgcaagcggcggcgtgaggcggctgttcgccggccggcgacggcggcggtttgggtggcgcggcggcggcactacggggcacgagagagctcgggagatgggtcaaacgaaagagggcgactaggggatgctatttataggcttggattgaagagatcggactccaaccgagaggatttgagccggaaaaaccgagggttagttggagagataaactcgaaaacgaatccaatttcgcgtcgaattcaaagggataaagtcggatttttgggggaagagatagaggaggataagaggaatatttcccctcaactaattttgcaaacggagcacgggatgcggcggatttggtggaggaagcggcggttgcacaggtacaggacggctggctcgggctctgtccaagcttgaagacgacattgtagcagggagacgaattagacttttcgtcttgggctggctgaaaacaaagcaaagaaagaaagaggaggagctcggctgggccgacttgggctgcacagcacgcgcgcgagggagagacatgttgggctgaaatcagcccaacggcttaggagaggatttaaaaactttttccaattaaaataatcactgaaatgatctttgaattgttaaaaatacttccaatgctcaaatagtttcaagaaaaatcctgaaaatacttggacactcaaagtacttaaaaaaattataatcagaccatttaatgattaatttaatatgtggataattactgaaatgttctttgtagggttaaaattaggaattgagttccgaaaaatccgagaatattccagagagtataattaaccatggagaatttaataaaaattaaatccatccatgctttatatttaggaaattttatttcccacatttaacttcacttataaattaatgaacatttaatataaattctaataataatttattaaataattttttaaatcctaaaacgaaaatcaggatgtgacaacacctttgtttttacgacatttggggcaagaaagcacttcattgtttttcacaacatcttccatgtactcaacacgacctaaagcatcttttagtttcatcttattcaaattacatgttgagcaatccaaaacaacatgaggttgttttaactttttagcagaaatcatgttaaacatcaaactagcatgaaaggcaatttgatatttttgcaacaactttttagttaaaaacaactcatccaaagtgcgtgtgtgcaaagcaaaactacaagcaagagaagatctatttttcaaatcatgtgcagcattaacatctctaatttttgaaatctcattcattaaaacctcacaattttcacaatcatcatcattaggaataagatattttaatctatcaatttcagatttaagagattcaatgataaattcctgttttctatacatcttctcacacttcttattttttgcactcaaaatagtaatagcttcctcaaaagcactcacctcattgtcttcatactctgtgtcagattcaccacgcgccatgaagcaaacatcggagacgttctttcccttgtcatcatctccactttcaccatctacattacttagtggctcgaagggggcacaaactttttgaaaagccttcctaagattctccatcttcctcccttggtaagaacccttcgacttgttgttgttggtcttctcaccatccttgtcttctcttttgcctctcccaagcttaggacaatgcgaacgaagatgatcaattgaactacattcaaagcaacaatttggaccacctcttttcctgttcctggcattattcatagctcgagcaattctgttagcaaccaaagccaaatcctcctcctcgatttgttcgagttgatcatcggatgtggcattaaaaatagcaagaaaagacgacttagatgaagaggcatcaacatccaaagaggaggaagaagaaaccaaagcactcgatttagaatcaactgcgagaaagaacattcatctcatgtgttttcaattttgtataaagtgaatccaaagtcaaagtagacatgttaacagactcctgaatagatgtaactttcatctcccaaatagacatgtcgagaccattcaaaaagtgacgagaaatctcagattgtggataattagcatcataagaagaatcaacagatctaagattactcaaaattttattaaacctaaaaagatagtcatccaaagcttctctaggtttcatctcaaatttaatgtactcctttttaaaaagatctcgacgaagctctttaatgttatttgttccttgatgaaaattactcaaagcaacccaaatctcatgagcagtttgaagatgagcaacacgatcataatccgaacgagaaataccactcaaaagaatgttgcgagctttgcaattttgttcaaaagcagttttttcagcagcagtattaatagcttcaggaatcacataagcatgagaaacttttctccaaatatcataatcttcagccataatataagattgcatcctactacaccaatgagaaaaatccgttccatcgaaaacatgaggcttagttgaaaacctagcgggagtagccatggcaaaaactctagatcgataaaaatccaaagaagaaaacaaggctctgataccacttgtaggatcgaatcacaagaactaagccaaccagagggggggtgaatggttggtatacccaaaaaccgaaaacttttagcggaaataaaagttaccctcgaaatcgatggatcgcggtctgactgaagtagttgcgtcggtctgaccgcctgatgaatgtcggtctgaccgatgtagatcgatcggtcgaatcgccgaaaacgcctgccaccaactcctgtcgccgccggtctgaccgccgtgtgcccaccggtcggaccgccgcgatgccgccggtctgaccgccggtgcgccgccggttagaccgccgaaacccagtgaaccacaaatcgaagaactcttaaagtagataacgactttattacttctctctgtgtttacaaagtgcaccaatagcactccttacaaaaattttgactaaactcgaaaccctaactcaaaactcaactctattgctctctaaaacgataccgggaagcctcacgctccccctctatttatacatgaggtagacagcctaaagccacgaaccaaactcatactaggagtcctaaacaccttaggaaacccactagtacaagaaagaaactttacataaccaatcgtaccaaatttggactccttccaaattcaacttcgcatcctatacgcacacaataactccatcgtatgccatatggaatctccatcaaccacgtgcatcaactctagcctaagtatcccgcatgatctctgaccacaacggacgtcgtcttatccccaagccgactcccggtccatcaccgcaaatactctcccgagacattgagtcacctacacatggaacaaacaaagaaaccatattccgagaccaagctatctccaacttgattcattagcagcaaacaatagtattacatacgtataaactcggatatccaaataaacaacccgaaaccgaaaccgacacagtgtcggccggtcagaccgcgggctgcaccggtctgaccgcgcattacacgccggtctgaccggctactagagcccggtctgaccggtcacacaaaatgataaaatcctgcgatcccctgtaaatctaatcatctccaaaaccactttgtgaataaattccaaataacaaaaccaataatctccaatgcccaattgttcatcatagaataataattgattttacaagatagactctctcaaaggtcctccccatcttcttctcccacagggaaacgagatcgttcattgacagggcattctctggtggccttatatgcaggaccttgttcagcatccttggatcatccactcctttgatggtaaacgttgcaatgtcctcctcgtcgacaaatattgctgaaacatttcgcaaagaacgaaggccggccatagttcagtgcatctttttttttttaaaaaaaaagtttgtgaatatccatgcagaaatgttgatcaatgatcaataccagctctgaagtagctaatcagtactccctccgtcctaaaaagactcaattcttgagtttccgtgtctaacgtttgaccgtccgtcttatatgaaatttttttatgattagtattttcattattgatagatgataaaacatgaataatactttatgcatggcttatctttttaaatttttttcttattttttcaaagaagacggacggtcaaacgttagacattgaaacttaggaattgagttttttttgggacggagggagtatataactagccatataggtgcgctttgcgtgccttttgattctatttaagacttctgtgtatggtctattagtttacattagcttttaagaaggttctgatataagttaatttgtttacaaagtatggattgtaagagaaatcactagaagccacctttgttccctctctttgaatcatatgcttaattaggaggagatacagaaacctctggaaatttggttttttaatacatgcactctttcgatccgatgaccattgtttatccgaactcttcatcgacggctaatatatttttgatgatatggcacatcctcgtgcaagaaagcttactgctttcactattataatataagataagataagttaagattagtctgattttgcttttttcctttaaaatgtttgattttgctcttgtggaaacaaaatccattgtcttttttttttggcaagcgtgcatgagaactatgcatcattttacattaaaaattattttctctcgaaatccatgatgaaaaaatccttactatttggcttctgcgacaaaaaaaaagaagaacaagaaaatactccagaaagaaaaaaatgttattgagaaattactttgaggtaaatatattttatattaaaaattttactaattataagcaccaaattttacattataaaatataatatctctaggctctttaagaatggtaaatttacctcagcgctgcatgcatctacacacattcattgtgatgttaccgaaaaattaagggcctgttcactttgatgtcattttcaaccttaccaagttttggtaaagttaaaaaaaagtgactacatttagtttgctgtcaaattttagtaactatataagaaatcctgccaaaattttggcaagttaccaaaattttggtataattaccaaaatttagataatactaaaatttggtatactaaaatttggtaagttttttttggcatcaaagtgaacaggccctaactgaagatttgttactccgttttctttttaccttttggtgttgccgtctcccagaatgacaaccttgtcagctgggaggccgctggctccaggctgcacaagcgtggggagatagtaccccgcgaaaaagttgcagctgacgaacgtgtaggggatcccctcggcctccactgttcgccggatctgcgcctcgacgtcgaaggtcgccttcgccggctcgacgatatgcgcgtggtcggcgtcgttgccgaaatccgacgggatgaacctctgcaacttcccaattatttacagcttgatcagtgtatatatacagagccaacggaagcaggggcagcagatcgacatgagggcgttgaccttgatgtttccggcctccttgatggcggcgatgatcttcatctgttcgccgacgtcatggtagccgacgaccgatatcacgacgtcggcggccctcaccgccttcaccaggagatcgtggtcgccgatgtcgccctatatgtgtgtgtgatcgattcggatttcggacgacaagcatgttattatttcagacgcagaaacgatcgaacagcagcacgcgaggtacggttgtacgcacctgcaggatggtgacgccggcgtccctgaagctctgcagcagccgcgccctggagctgcttcctccgccgcccgtcgccggaggaggcggcgcggtggcgcgcacgagggcggaggtcgggtggccggcgcgcgcgctcgcggccacgatgaacttgccgaggtgccccgtgccgccgatgataaggatcctgctcttattacgatctccaggttccatcggattatcgattccgacgacgcggcgacgacggtggcggagctaaattcagcgcgaccgtgtgcgggcgggtgcacctgccgttggtgctggatcaggattattctatttattttctatagtagcaatgttgcggatgattgtatgactttctgattgggtatttgtcatgggagaatttattttatgccactacgaaatgtccactctcatatataatatactaagaagattatgcatcatttgttttatcattaaaaatgtactttaagcctgacttaaatctttgtatcactagcaaaagtatatgtacggtgcaacatgcgaagataattttcacaattgagaaaaacctctgccaatttaaatgacaaaccgaaataatacaagcaaaacaaagttagaaatcatatataggccgtgtttagtttcttgtcaaattcttttttatgtatatggacacacaaagtattaaatgtagactaatcacaaaacaaatcacaaaacaaattacagattccacctgtaaactgcgagacgaatctattaatcctaattaatctgtcattagcaaatgtttactgtagcaccacattgtcaaatcatgacacaattaggctcaaaagatttgtctcgcaatttacatgcaaactgtgcaattgatttttttcgtccatatttaatactccatacatgtgtccaaacatttgatgtgacgaattttttagaagtttaaagggaactaaatacagccataacattgaatctggatgcgctcgcatcatcgtcatgacacaaagaatcccccatgtacacaatatcggatgactattccataagttgtcccatgtatattttgctatacctaatcaatcaaagattgtcgttttgatgattcaattagtgaaagttttttaactgttgatggaatgcatttgcaaagtaacaaacttaccacatacacaccttaaacgatcataatttcaaaaggaaaatatttatgaggagataaattcggaagagaaaatatttatggtgccacaattttaccaaaaatcatttaactacattataactacattgtaatttatgaaaaatacattgtaaattttaagaattacattgtgattttaatacttacattgaaatcatgctaatattcactgtatatgaggtgttgactacaaattattaattcattgattatatatcaaaatagcgttgactaaggagctaagaaaagaaaacggaaaagagtaagaagcgaagggatacagatgtatgtgatagacaatatcggacgtatgaatgcaaagcccatcaggtggctggtcctagatctgattgaaatcagttacgaattgtgacagcagatttttaccaataccaaaagagaggaggaaaaaagagaggatattggaacaagatggcgaggatcagaatgattgggagaaaaagaaaaaaagagagacaaaaagcgatcgggagaggggcgcacgtggcttcaagtggaggcgtataagatggggtggcgggatgatgtgagccgattgggttgggttgggctggaagggggtgtataatagtcacgtcgaattggataaaggtgatacacaaccaac

SEQ ID NO: 15040 - DNA, 23035 bp, Oryza sativa
tataatactagagattacactaaatatttgaacaagataagtggttttggtacgtcatctgtgttagagttggtttttgagtttgtcgtccgtatctaattcgagagtctagaataactattatacaccccccagcccaacccaaccgagccacaccatcccgcgcgcatccactaggtgccacgtgctcccctcccctaattggcatctttttgtttctctggttttcgtttctgtttctcctttttctttctcctgatcatcatgatactctcccgatccttccttgcatattccaaatttctatcctcataatattttccttttgaaattataattgttataaggtgtgtatgcgaaaaatttgttactttgtaaatgcttttcatctactataagaaaactttcactaattgaataatcaaaacttcaatctttggtcgatgaggtatagaaaaatacacatgtgtcaacttatagaataactacccgatcaatttgtgaggccacgaaaaggtgtacacgaaagattttttgtgtgatgacgcatgaagctagtgtaaccgggcttaatgctatatataatttacgactttgttttgccattgttttgtttctcttgtttcaattttttatttaaattggcagagtttttatcaatcgtgaaaattgtttgtagcgcacatatattttgactagtatgttcaaaattcaacaacatataacaaacaagggattactaatttttaaacctccgtcttatgccacaactcggctgttggacaagggaaaaggaaaattgagttaggaggagtctgagatggatcaaccgactctagttcaaggaataggaggggttctgttggagtcaagtcgagtcggttgattgaactgactctgaaggatctattttggaagttcagtaatgatgttgtatctttccgatttcgtacatttcctattttgtgccgaatactttccgcatttatcttccatattttcttttgtgcacattactcgtttacttgtcggattgacctttcagccgatcgtttatgaattgcaagtcttataaagttctttatgggtttgttgttcgagtttacttcacctaggtaaattaggagttcttccttttcatcagaggaagagttttagtataagtcttaggtgtggtgcctaggctttatattttcaagagtaaaatacatggaggaccacttaacttgtttacgtgaattgtgtaggtcaatctactttcaaaatggacatctagatcactagtgtgagttaagtcaatcaatttgcctttctaactatccacatgagcataccttgtacacatgttatactatctatgattgaaaaatttgctatcagacatgtgcaaaaaaaccgcatgtgtttcttatcctttctcacagtactagcactgagaaatatacaaaattaggggaaccaaatcatttcacttgtgtctattttgatgaacttttcagttctcagtcctctctctcgtttgccatcaaacctgacagcggcgacaagctatgaatataaacaacgacgaaggcaaaatcctaggcagtggcggcgacaagctatgaatataaacagcaacagaggcaaaattcgaggaggcagtggctagggtgtgcaacggctgcagatgcctatacatgtgccacattatgtgtacaaggtgtgctcacgtggatagttagctagctaaataactcagttaactaatcctatgtggcacgcttcaggggcggatttaagatccggctagcctgggccgttgcccgggctcatgggcctgcattagtggacctactacttattatccatactaggaaaaagtacactgatggtccctcaatttgtcatcgagataaaaaacgccctggaaccacaaaaccagatatacagggtcccttaagtatacaaaaccggtcacccgagattcttcggtggttttgaccctggttttggtctacgtggcggctgagtcagcgtgggacccacgtgagccccacacgtccacgtcagcctcctctccctctttcccctcttctctcccttcctcatctctctctctcacttctctgtcgagacgagcggcggccgagattgacgagatgagtggtttccagcagggtggatagcgtgatgggcggcgaagagatgggcagctgccggcgaggaggatggcgcgacgagcggcgaccagtggggagaaggggcagcgcgcggtggtcggcagaaggacctatggagagatcgccgtcatcatcaatatctcgaacagcgagccaccggcgtcgtcgctgcggtggcggacgtcgcacaccatgcacaggcggccgtcgagctcccgcgagcgttttcccaaccgatatggccggtcacatggaagccaggcggcgggggggagcaaggcggcgacgcggtgccggcggcgacgacacgggagcaagggagcaaggcagcggaagcagcctcctctccgtgcgacgacgcgggagcaggggagcaaggcggcggcggcagcgtcctctccgcggcgccgctagccgacatgtggtaaggagagaaaggcggcagcggagggagcaagacaacgacgcggcggtggcgggagagcaaggcgtcggcggcgggacaatgggagggcgctcgcctcactcactaggccgaccctgtgcttccccactaggccgctgccgcctcagcctcctcctcgccgtgctcacctcaccaacgccgcgcgcgaggaggcccacgccatcacatgcgccgtgtcccgcgtcatcgccgcgcaccctggcccgttccctcgccgcgctcccgacacggccgtgctcccaacgccgcctgcttccccaacctctgcgacctcggcttctccctcatcggcatcaccaaccaggacatgcacagactccagcctccccgcgcctcatcgccaccgacaagccgacgccgacgccggcctccccgcgcctcgccaccaccgacaagctgaccccgtgcttccccactaggccgccgacgccgccaccaccgtcgctgtcgcggcgccgccctcatcctctcccgctcgccccggctaggttgcagataagtgaaagagatatgaggaagggagagaagaggggaaagagaagagagagaggaggcttacgtggattaccctgacatgtggggtccatgtgggtcccgcactgactcagcagccacgtaggataaaacccgggtcaaaaaccgccgagggaccttaggtgaccggttttgattagttaagggacgcgggatatctggttttgcggtttgacgacaattttgtatctcgatgacaagttgagggaccttgggtgtactttttcctccatactattccacagagaaaaccacctcccctcccaagcaatgagtgaatgaggcccacgtatttagcgccaagcccacgagattcggagactgtttagcttcctgtagcccattttggcgaaccacgcgaccacggcgacgcttcatttctcacgagacgcgggcacttatttccaacgcggtggcaggcagccagcgacgctcccaattccaaaaacttaacactgggcttgctgtgtcaagggcttcagcttgagcagattgcagtcacatcggcgcggccacgcgcccggccggccggccggtaagctcggagtcagaggcaccggcgattaggcacttagattagctagttcagttggcttcttgcctacttgttcactgttcagtttttcacacaggttgcagacttgcagttgtagcatcgtaggcgaagcaaatggcagagcagcaggagcaggggacaaggaaaaagcttggccagagaggtaaaaacttgaagttggattgttaaccagtctattgtttaaactatgtcattttaaattttaatcaactgaaacaagtgattggattagatttggaattttggatcctatatgcagacgtgcttattcttggctcttggctcttgctaaaatttcaggaatgagggaattcttggttgatttgaggagccaggaggaacctgttgttgctgatcctaatggaaggcatgggactcaaattcagaacaagaacagccaccggaagcacaagatcatttgcaaccaagaccaaacatgagtaattctatcagtgagttcaatccaaatgaaatcatatgcgatccttgcttgtgtttaaaactgttgcgttttagtttaaaactgttgcgtttcgcaaccttgtttgtgtgtgccgcgtgaatgattttacgcatatttgttattcatcatctggcttgcggctagcttgcccaagctcatgaaatatcctggatccgccactggcacgctttgtgtacatgatgtgttcacatggatagttagatagctaaaatgtttcacttaattcacattagttatcaatatgtgtattctatatgacacaactaaataagttggatgaccctccatgtattttactctattttcaaggaagttaaattagagaaacggacagatatagtaaattggagaacagcatcctttcaccacgttagctctagcatgtcggtgttggcgaacagggtagtatttaccatatgtggttacctattaatgtgcccaaagtaaatacatctgtatgggtttacctatgctcagttttactcgatctgaagttgtgctcgaccccaactatctcctctgacttcttgaactagataggtgttttgctttatccgtgttctaaaaatcttgccacattctttattagataaaacaccattctagctactatagattttctttgacaacacaaggttaaagagagatatactttaaccatccaagtgtcctttgggatcaatgtgatgtcccaaaataatctgtggtgaagtactttattacatgggcaaccataggccctgagccccttacatccaaaggtttaaaataaaagatagcacatcaaagactatatggatcagcattcacaggcacttaatgatggcacaaactactatcaaagccttctcctccattatctcctaacccaatgcttagcaacccatattggaaatgcatagcaatgtatgagaacataatgaactagcagatagggtttattttgcgtaaaaccatagtttaaacagtcaaagcacatttttaaacatgttcttgatccaatgtcattattgtaatatcatcaattttgcgtaatcccacgaatctatcttaactcagctaatccacatgactaaaccatcataatccattctcccaagatttacaaagttgggactaacttggagtaacattattcaacatgctcattgtaggaacgaatacaagaacgaagcctcaaaaacgaaatctttttgcagaataaaagaaaccctttaacatgaaggagcacggtgtgacctcaagtagttatgaggtctgacctctcatatacctacagtctaacttcctgatctctgtagatgctctagtctgacctcctagatgcttccggtctgacaacccgggtgtcgccgatctaactttattgcatcaacttgtgtttacaaagtgcatctaacacactcatttcacaactcatgaactagaatcgaaacctcaaagcaaacctttacttttctctctaaaagttgccttaattttgagactcaacccctcgtctatttatatccacaaacatggctacctacaaccatgaatgcaactagaacaaagaatcctaatcaaatcaatgatacacgcatccgcttacaactccaaactccaatcttaccaaacttggtctcctgcttcccatacacacaattcttgttgtatgccatatgaaaacttcacctccacacacattattctttagccttaatatcttgtatgatctccttggtagtctagacctcaacttctcccaactctagtctcgatccatcattggcaatactcccgaggtctcaagagaccatatccaagtacaagttcttccccaacttgactcacattagcacacaacagtatatatcacatataaaaacatctagaaatcatatacattaagaaatcaacatactccataaaattaactcgaaatcgactccctcctgaagtctatcagcctgacctcttgccccatgtcgatcagagaaagatgatactccttacggaaaaaccgaaaagaaataccatcgtctgcatctagcaaggtgcaaacaagaacccgactcatctaccacagcaaatttctcccatcctacaacattccaaactctacgaaaatcaacatccatacctatcttccgaagtagtttgaggtcgtatgcttgggtgtgagcaaacgtcctatccttgagcatatggtaggcttgcatctctcggtcacctacgaggtcgaggtcggaatcatgaaggagtcttggcggaacattcgcatcctccatcgaaacatcagtcgacgaacgtgtgcttgactcgtcttggtgacggcttgatcgagaatttgatcccttcttgagcagacgggtgatccgtctcttcatgactacagacagagcaagaatacaaggcaaactcgagcgggggttaagttaatacaaaaaattatacctatcggttagtcttgtactaagataacttgtatatgcaagaaattaaatcaaaatgcaagaaataaacttgagaccaactttgcaaagcttgagaagaatttgagagcaagaggaagtgaaaatgagttgaatgtgtgttgaacccccctccactagctacttcacttatatagtgcatccataacggtcacaactgtgatgtggggcccactagccattgccaaaaaaaaattggcaggcgactgttgcctggtcggttcagccgaaccccctggattggtgaacccctagtgggcccaaccggccccacatttagccattggctcccaatggctaaattggtgggagccacattgaatttagccgaaaatttcattttatttttgctcagaaaattcatttttgtaaatttgtctcaaatttaatcctgatgcaaagtttgaaatctaaacatgctttaatgcaaaaaatcaaattgatggaaataaatatgtgatacgtaccaatttacctattggtgagggcaacgtcgttttgggtccgacgagcacgacctgttcctccatcatatttaccttgatgatgtggcacccggctccggaggtggaggagcggatgtcatctgtttctcccgccacaacttctttgtttttggtgcggcttgtggcttcttgactggtttcacaggctttttagcctgtgcatctagctttgtcgatacattccttggacagggcatgctcacgactgcttccttttccaggaagttcttcagtgaaagctatcaacctatccgtctttggtggcttcatttcgacctcttgtatgttctatggattcggccgtacttgattctcaccatagaacactgctctatccttggtcaaaactcgaacttctcttccttcccattgatgtggagccgtatactcccagctcccacgtcaatgttggcctctgtggtgctaaggaatggacgacccaaaatgagcggcgtctccttatctgagtccatgtctaacaccacaaagtctaccgggatgaagaaatcctagatctttactagcacatctccggcgattcccgctaggtagcggaacaaagaatcggccagttggagccgcatcagtgttggtgccaacaccgtgaagttgcttgtcgaagacctccttgggcgtgacgcttacgcttgcaccaaggtcatagagggcttggtcaaagtgttgtctcccgattgagcaagtgattgtgggacaccccggatctttcttcttttcctggagccagtggagtatagcgttgctacactcctccgtaagcttcactaccttcgtggttggcagtggtctcttgttatccagaatgtccttcaggtagcgagcgtatgtaggtacctgcattgcatccaggagtggtacgtttatgtggatcttcttaatgactttgacaaaattaattaacgagcgaattgctcgtcgatggatggcttttgatatctctaaggaaatggcagcagatttgtgtcgtattattcctgcggcactaccttctccttctaggttgcctcctcggtcccagcggtgttagttggaacagcttcctcgctattcctcctagttcatgcagtgttaggatatggcgaatcccgagtggattttcctcccctcgtggtgattgctttagcattttctatggagggttcaggttgccccggaatcctcccatattcatttgtaggaactagagcagctagttgcaccagctgagtttgtagcatcttattaaaactcggttggttttggaaagtagaagcaaagccatctagcttgacatttatattttccaagatgttatcattggtagctaacttcttgtttaaagcatcagtggttttagcttgagcaaagacaagatccttcaaggaaggctaattattaaaattaccgttattgttgttgttgctgcctccttggtagaatgggcagggctggtttcacccatgacctccttgtggacgatatccgttgttcatgaacattgcctcctcatgagtctctggacagtctgtcccggaatgacccgtgttcccgtagacctcacacatgatgtgtgagtctaaggtcttgatggtgccttggggcttgttcttttcctggtcgtccaagcgcttcattaggaggtccagttttgcggccagtatttccgtctccttgttggtatgcatgccacattaacgagtctagagtcgttctcgctccagcctatgtttgagaccattttctctattaaatcgacggcacatctaaccgtcttagagaagaaagctcctccagtagcaaccgctaggtggtcccagtacgaagatgttaacccgttgtaaaagctttgtaggatcagccagtcgtccttcccgtgatgacgacaggtggcgacgtaatcctgcagcctttcccatgcttcaagaatggactcatcccttgtctactggaagcttgagattcttccgcgaaaggcattggtcttgcccatcaggaagaacttcgagaggaacgccatagagcatttgttccatgtgtccaccattgcatggttagcgtaaaaccattgtttcgccttcccaaggagggaaaacggaaacagtcagagcctgatggcatttgggctgatgcctttcatcgtgtatgtgctacaaatctcaaggaactattgcagatgagcactagcatcctcatttggcttgccacagaaggggctagcctgcgccattctaatgaggctggtcttcaagtcgaagtaaccgtctcccaagtcgatgtgtggcccaatgggcacattgttagcagagggagcggcgaactcacgggaggtcttctcagccatattcttaaagctcggggacgctgggatgactggtttgtttgtcgacaaagttttctgtggagggacaacttgcgaattgacacctaaaaaaaacttattggttgtcttggaagtttttcggcaagtcaaaaacagtcatacactaccttgttttcacaacaaagtaaaaacaatcaaggttagcctgtaaaggacaatgattatttagaggtaaatataaagttattagcacgtagtaatctcttaatcattaaccttcccgagcaatagcgccagaatcgcttgttgatatttcttaatgatattactagaaatataatccccagtaatggcgctgaaatattcttggtatattatggtcacgtatatgatctgcaaacgcacgaatataccattggaacatttcacttggaagtattccaaggtatcgtacttatttaatcccaagggaagatatgataagagagcactatgctaataatttatatgttacttgtatacatcaaagtctatataggggttagttaattcaaaagggtacgtgacacgaagaaagaagaaccaagataatctcactaaatataatctacactaagtggaaaaagaataagaaaagaattcattcctatacttatgttacacagtcatctttagtttacacttactattatacaaccatgtagccaataccccccccccccaactacgccctcctgatgtttcaagagaccatccctaattgtcgagttccttacgacaatccgtcatggccatccaactggaaatgaatacggaggagtacccatacctggaaagtgtcttaggaatacccctattaagttgtcaccatcagcggcccacctctattgtccgcagtatataaccccaaataatggtatctactaatctaagcctcatgcttacattattaaatactactctatgtcctctagaatgacatagagcaatcatttgaatgaacattaaaccccacaccagtgcatatctctagtaagctagctacataattatattaagacaagtataaagtaaagtcggtactcagataatatggatgaagtaaaatactgaagctgaataaagaagaatatttcattaattctataagtcttacaaaagaagtagaagctaagccatacccgaaatctcctgaagactcgaggactaagagaactattctaattctactccaccagtacaagaacactaagctaaacttcggagagagcttgatcttcttcttggagtgtgtgttggagagtgaatgagcacccctttatataacctctcagtgatggttatggcagttggaaatgccagaaacgccctccaaccgtcattgagagtacatctggaacgtccacgtggaaggacgggatgagtggctatggctagggtttggccgaacctaggccggcccatccagcctccacttttggcaggtgcatcttttgttgggctttattctccgtaatgtggtggttgggcctatatttaatgttattttactagatttgtaagcccatccacccataagtttatctcttgatggacagtgattgattattcagttatttttcatagattctcctccaaatatgtagcaatatctgcaaacaaataaaatccaagtacaagtgaagatagagtattctaaacaaaatatgcattgcagatatagttagttgtcctttattccaattatatcgacggtcgaaattggtctataacgatcgtcaacacctaccctcctcaatggtcaataggagaacggcaggctacagtgcaagccgattgttggtcacactagcttgtggtaagtacagaatgtcccctaaggggaacccgagaaccgatccttaattggcatcgatgcgactatcaaaacaatgcatccatggtctaccattaagaccaatgaaccatggccaaatgtcatgagcttgcaactcatcaagtaactaaagtataaagcaagttattattccatttgtgacatagtgagactaagcatggctaagtgtaacctatttctagctaggtcaacttgagagccctaggctagtcaagttaacacccgaattatgaaggaataagtaaacaataaacacaaccacataaagtatacataggcaatccctatccttaagtaattaatgaaacagtgaattacattagcggtacatcaacttagcaagtaggtgcaatgtttttagtgcaacaactggagaagtgagcatgctaagaacttaagaactgatgtaacaatttaattattttgaacatgttttttattatacacattaagttttcaagtacttattttatgaatatgcatgcgtagatttgtaaatttgaacttagcgaatgagcaaaacagtacatcaaaaaacagaagcaatacatggaagcatttgtaatggaattttcacaatttctgaaaaattatgcaagtcacattggaccaattcaaccgatcgagatgatccacgggagaccgatggccaggatttgcctacacagataaatgaccgggatcagccgacacacgatcatgcgggctcatcgtatgatggcgcacggggcggccacggcagactggcgcactgaggtggcaccgacatggcgccactgtggtgccgacatgggcaaccaagggaaagggccacacggatggcccggatgaggttagcttgcaggacagtccgactggacagtggtggcacgtggcccaatggatgctggtgcagcacccatctggcttggcgatgagctcgggaagcggcgcaaaggagtgggacgggatggggtcttcaccgaacgacgaggaggacgtcacgtggagctcgacactgaggttctggtggtggtggccttcagctagcagtggtgacggtcgtctggatgcgcttgttgaggaaggagcagtggtcgagtgtctctgggacctagggattttagaggaggggttagggagaggagtagtgtgttatagatcgatggccagaacccgacgaggcgaagcgggcttatgagggatagcagccagggaggcacttgggttgtcaccgacatcgaggaaccggcaaccggaattgctctcaacctcaagaagacgtggaagggttttccgttttcatagtctcgtgaagcaaacttgaggcctgggatgcggagtgaggcgacctggagcgcatccacctcgtttctgcaaacgagtgggggaggaggcaggggagcagtagcaatgtggttaacgtcagcccagacgcctcggttggaggtcagggttggatccaacaagttggccccatgtatcggtgcacaagggcggcaacggtgtagggggtaagccagcctcactaaaagaggtatactccctccgtcccaaaataagtacagttttgcactgttcatatacaacatttgatcgttcgtcttatttgaaatcttttgatgattaatatttttattgttattagatgataaaacatgaataatactttatgtgtgattaatttttataaatttttcaaataagacggacagtcaaacgttggacatggattccaacgactgcacttattttgggatggatgtattaattggaagttttagtctacttggtagaatagactggtgatagaattgtttggtggtattatgtgataccactgcaatgtagcactatggatgcaattttctgttttaacatttgagtaaatttgaagcacagctgagggaaaaacaaatgatcatatagtactatttgcttgagtaacactgagggtattgttggtgatatgccttagaggcaatcgtagagatgattatatcacatactatgtttacatatttatccgacattgttccttgaaatagataactcattattgcttaatgaatatgtgattctttcatgagactttttatattgtatgttgctatttctaaaggatccctgatcaaatatcatatgtggaacaaatatgtttagatgatcagcacatgtattaattgatgatcatgtctcatagatcatggtacagagataccgaattaataatgtagacacatgttcggaaacatgttgttggatagacccaacatgagacattgcaagagccatatgtgttgtgtcatcagtgatctcatttaatgttagtattgaatcattagacctgagattatcatggttcccaacatgtgtagtagcttacttagggactgctaatcgctactccataattgggtagttataaaagtagttttcgggtatgctataaaacatgttgtgagatatgaataataaagataggatttgcccctcatatggagagatatatctgggcccctcgatgttattgattatggaagtgcatggccatgccaaaggtgattgaggagtcaatcataagctatataatctatcacaagttcgagtgaatgattgaactattagaggatgtcccatatctagccttgagcttaatcgatatcgtgaggcaaaggggttcatataagtttacactagaagttcaaccgatatgatctttatgtatgctcggtgggtcaatacgttctgctagggaccgctgttgacacgtggaccgaaaagaagttttcgggttgcagccgagtgtatatgaacctacagggtcgcatgtttaaagggctagaataaagagattggatggatggagagccaatatgtactcaatcggatagggatacgagtaggactcctatgagcctcgaagccccagtcgtggatcctatatattcgtgagggggtgtgactggcggaattaacacaccacgtgaaatcctagccgtgactcccctccccgagcaaaccctagctgcgcgcgggtgctagcacatctgcccgtggtgtttcttccctggacatgtggataccggtagaggcgcctctgctttgcggtgctgattggcatgggagcacggcgaggagaacgcacgaagaggagaaggtcgagccggtgcgatcgactacttcctctacatcgacgcgcactaaatcgcgagggttccttcaccttcttagtgcttacttccgctgcgcagtgcgtcgagtggtaacgatctatgatctaatacttgcatgattcctggtttacgcgctagaaaattttgatttatgctatcatagcctgtgcgtatcccaacgggtatgaccaatcatttgtttaacatcctgaaaatgaaaaatgatctactacagcacaaaacaggtaattatgcaattttaaaagtactgagcaaaatgctctaagaagaaatatgtgtatcgatctaggacaagcactaagcactctgatttcaggagttactctttaaacataaatcagaatggcgatgtccaaagttggtggcttttgtcagaagcgacaggttgatctctaggatttttttttttaatttttgctacaagttcataaggaatactgaaaaacattttacagcatgtgatgtgtataacagaagtagattattttacatttacaacattgcacggttgcaggtatacaggatctgagtcatgcccgttctgctgcgagagtctgatatacccggagagttttgggtactcagcttcatcaacagcttgcggcttgcccgcccctcacactgacagtctcttgatggagcctttaatttttactgtaccttaggatgattagggctgtgttccggaaacgagatggtttattaatgtataattgattaaatattagctaaaaataacttaaaaatggattaatatgatttttttaaaaacaactttcgtttctgacaacatggtggtgaatgttattagctttttttttttcttttttttgtaaaaaacacacgttcagtagtttgaattcagcctaaggccatccattgtattggatccaatgaatttgaatttgttgtactacgcctggtagtatgagtaatgaataatttgataggcataagttggaaataaagtatacggtaaccgaatactattcatatttaaacttcgactattcatccttttaaatacacacacgcacacacacacataacaaagacgccatattatcaaaggtgttgcatccttcagactgacatgtgctgcctgccccttcagattttcaactgtatatgcaacagcagagaataaaatgcaactttcgacataaaacctgttcaccgtatgtctttatctaaaacaacctagtaaagaaaagcaaaagtactgcaaatacaaactctagaagaaacactagtacatggggttgaaaaaacatcccatcaagcatttcatctggacactactatctgctacaaactgtacaccagctggttgggcagtgtttgaaaatgtacaaagctccaaccaaaatcaaactcgactcatcagacgagggtcagcgatcgaggtttcgagaaaatgctgagctttcttgagatataccgagctgattttgatattggttgtttgcagatcgtgccaatgggcgaattctctgctgcaccattgacagccacctcacttgaacatgaattgccaaactggtcgctttgtctagagtccctgagaagttgaagcaacttgattgaagaagcctttgcaacctcagttccattgaccgacaaatcgaccagcgcagggatgacaccttccttcatgacaagaacacaatcgtcgatgctgcgagagcataaggcaagaaggatacctgacgcatgctcgcgttccacggagcttcctgtgtccagataatctgaaatagaactgaggcattgatcagttctgataatgagatccgcagcttgtttcccttcacttaaatttagtagaatctttaggcaacactcaggcgatttcccttgactgagaattggagatagctttgagattattccagaagaaattaggaaagattgtacatcatttttgaatgaaagctcgcagatgatcttcaaaactagttctaggcacagggagtctgcactatcccaagctagaaacacagatggagcaacaacagatgccatgagacgagatttccgacaacttggttgctgcagcagttcatggagtatctccaatgcttcagtttttaactctgaatcaagaaatgaagcaacgagacgcactgcatcttcactaatggatggaattcgggtcctgtatgaaaaggaaatcagccgttacaaaagtttattggagaacaaacaaaacaaattgccataatctgaaccctttgtttttaaaaagtagcacaaaacaatcttcgtttttggaggataaatatagggcactcagttttatttatggatttttattgaaaaaggtagaaacaggaaatatcttatgtttgtcaacagtaaaatctgcacaaggagatttttagataattaatgaattaaaaccagagctctacatccaacatggttgtacacagccaaacacaaggagaatatattatacaagaatgctcacctgctattacgtagaaaagcaagaaaaaactgaatgccagttctttgagcttccattgtgcattttccattatcgttcttaagaaactcaagaaatgcttctaaaaaaccattggaaatcatagaacgccaaatttgatattcacgattcagaacacttttgaaatctctgacagccttcacttgaagttccattggaagctcggacagctcgtaaaagaaattcagaaacatctccttgttgaagctgctgaaggacaaatacaactggtaataagcgtttgaaaaaaactgagtagaattagtccttgactcttctgtttcccgcattggagatgatacataactagaaccagataatgcaacagatgaactgctatgatcagacatgtaatctctctttgttccagcaactagaggtgctgagatattgtgtagacttgaaacagagtaactatgaaattgttcaggtaaagaagtgaattcaagctcattatctttgcaccagttgcagatcacagccttcatacaagtatttggagtaatcgtgaaattttctaactttaactgtgtcctaggacaaatatcatatccctcactgaaccatttctcaatgttctctctctcataggtttgtccagatgctattatcacaggatcgtacatcagcttcatagatagtgggcagcagaactctggaggagtagaaaatcgtgacaaattattctgctcttcacatcttccagtccaagagtttgtaggtgaaaagcatttctgtggagcatcggtaccactagcaattaggtttgtactcgaagtaacgtttgcaacatccacaccttcattctttgcactaccctcaggcttcatagtctttccatatttcctaactagatattgaaaaaatttgagtattccttcctttttgggatcattaccattgatcttgtccagtagtttcttgattgctcgtctttcaattaagatagcctttggtgacgtcaaatttaactttgacgctgcaaacaagaaagtctggagttcatgttcttgggttgcatcagactgccgaagcatctccaaaatggctttgccagcctcatcttcttctgggtcaacaatgaatttcacatccccaagatcatcatgaacatcagccacctaagacaaatagtcaagtataaacatgttaatgtgacaatctgtgcgatatttagataatggaagaactcattaaattgcatcgagatgatacaattgtcctgagaattgatgtgtgtgtttatactcacacatctgccatgtaatctaaaaaatcttttggagaaacaacaaaaaacatagatcatgtttctggatacagtactgtctaaacctccagataaatgtttgtgaataatatcctgaaattgttaggttttgttgatgccccagaaataacagacgcaagtactgtccaaggagagcttcatctctattacagacgcaagtttgatgttgtttgtgtcatcactagcttcaaacttttaacacagcaaaccatgtggttaatgctgtgcaatgtagaaaaagtttgcctgttattatcagttcaattaagtaaactaacctgattagctaatgatgacgggaccatattctgaaccaggaacaagcttcgcctcagcgcatctcttatcctttcgcaccgcattgcagttgcctcccctgtaatagcctgagatgtgcaaatttggtatcagaaagcaattgttcagaaaccagggaaaacaatctcaaataaaacaataagataaaaacaaaggagtcattatagtttcctgaacataatgactcatttatcaatattaaagaacaacataccaagtaaagactactgcactcaatgcagttctggattatgagttttcctttgtcaactatgttgtacaggttgcatagttcctctatacccgctttacatcctggttgagcagtttcgattgagggaagaatagaagagactttatctaacatcattgtcaattcactgcacattgagctgtgaacctaagacagaaagacaaaagaataattgcattaactgtaataaaatgttgaagaatatataatggggagataatcactactgaaaactatctatgaagtaaatgataatatttatatgaaacatcaaataatgatcttattgaaatactgcagttttaactctgcctctcaacaggtacaaaggaatcacatcatatcatagataagcatgcaagaaaaaatgtttgtatcaaagatatgttctttatgccatacaaagatatgatctttatgaggaaattattgtgcatctatcttgaatcagacaaagaaaacactcccaaatttgaactggatatgtgaccaattgaggtagtctcaaattctttgccatggagtcacaattttacacagcatttaccatctatagtgatgtgtagtctaagatttgtgtgcatgttacacaattaatgatatttactcagggataaaaccttaaagaactcaaatttcatacccatagatctttctggtactaagaaagcaacgtaaaactatttccaaccaatcaaataatgcaaatgataaagcaatatcataagaacctatattccaaacaaaacatggacggcaacaggtaacaagaaacattactaaaagatgaaagtttcagcggtccaatatccatacctttggattagaattacgccaggatattccaatcactccatcattattattctccatcgactaacagtaatccgtgataaaagtatcaaactgcccaataagagtcaacatacagtataacaatatcagcagaaaataccaaaatgatcatagctacaaaatactatcaattgtatggcaatcgagaaccttgggggcttgtgctataggatcatattaaagcaagatgcaaataaaggaacattgtcaaaacaggcagaaaggttacgccacatcaagctaagcagtcagttgaactttatctgaacttttcttaacttattgtagatatcctttttgtatttgtacgtgagtcatgcaaataaaaaaaagcaagtgctcagctttttcgtctttttatttgcaattaggattttttttatgttagtacagcaggaagaaaaaaaccaaattgatatttgaagtagtacagtttatcatacgtactcctggtggtgactatctaggtccaacacacattgtccaatgcagttcaaggtgatgtactcaaattctaagccgaacatgtacagcagggtcaaatcttagactaaagactattaataacacaggagatcggtgcaaattgaagagtgattctgatttcaacatcagatccaactataggtgaaagttgattaattggtctgaatgctgatttgtttttcaaaaatctttcttgacagttggaagttttcagattaacctagcagataataacactaaactttcttactatatttattttttaaaaacaattctaccattccacaaaaaaattgtatttcagaagacatataagcttctatggtctattggagtctctaaatataattgacatgaataagatatttacagaagatctacaatgctccaagagaaatatgcatattatgttaaggaactgtttggttaaaaaaaaatttcttaacataaaaagattatgcggggataaaaataatatatttttaagcacctgtaacaactcagtgccaattggttggtgccaatcaaataatttctctctaatacatgcttcacaatcttggtattctatatttactggaaaagaaatcattcgagtgaaccaaaaaaaattgcaaacgtaactaaattcttccaaaagaaaataattatcacttgccactatgtatctagattgtagacgatcaatcgtagtcagtaggagtgtaggaccacctttttttttttgttttgaaaggtcaattatactgtacccttttctttagtgggaatatgctgtaccatatgatggaatttccaacctaaaggataacagagagctcatacacgaaaaagaagggaagcggtacgaaagtaaatattttttaaacagataaaattaacagagcactatcctaagcaagcagataagtacataaagggaaaaggtaaaggagaaaaagtatagtggcctagagaacaagagattcggaatagagagatttgaactcaaaaagtaaaaaggctttatttttgaaatttcgttctctacatctatatgcagagcaataagcaactcagaatactgctgaggaagagctgagaagataggcacccacaagcgaactccagcggataatcaacaaaagaatttagcaaaacaaagctcagcagaaggtgaaacttgaggaagaaactgacctcttttggatttgcccctcttcctttcttgtcccagagagcaaaagtgattataatctgctggaatacacaaagatagcctaaaaaaacagtgattcatgcgcaaaaaaaataatttaacatgtaaaaactgactcttttttttaaaaaaaaattaaaaataaaaagggatgtaacagaacaaaagagtaccagtaaactgcttctgtcctgagtttctggagcagatgaagaaaccttaaactgccctaattaagcagaggaaacattcaatagatgctgagaaaaaagaaagaaaaaagtaaagaagaaacaagacaggttggaaccctcaccccgcgggacagatagaaataatcttggctggattcttggctgacccagactagttctttcgttcacaagattgggttcttcccccctaaaattgttggacttagctgctgcagcctgcagctagctagctaccgcgggatcgattcggcgggactgcctgctacatcacggcgacggctgccgctcaagtgggaggaggagaagcaagacgccggcaaggggtaggatcgaggagggagagaggacgaaacacgaggacttctccttcctgcgccggtgagacctgagagtgagtggggagttaatggtacggactacggagagagacgaggagtactagaagagaacggaaatgcttagagcagttacagtagtaaactattagccagctacgactatattttaatgagataaaaaaggagagagctaccgatcgggcgcccgatcggggccggggaaatcgggcgctgatatcatgctgatgtcagcgtcagatttacgtgtaaaactgttttaaactgatttctcttaaattacttatctaaattatgatccgattacaccattaaattcgttgcaattaaatcttcaaaacaagaccacacatggatatattccgacgaaaaaaattagcttattattaaattatttttaaatattacacgatgttccaccaggtatatcggaattgtttcactaagtagtgcgaaaatgtttcactcgtttaaatcgggtgttgtttcaccttatataaaagcaatgtttcagcaaatagcgaaataatgtttcagttcactacaacattagatctatacatagtgaaacattgtatgtacactaggtgaaacatttttcggtagaacaaaaaataaaccaaattcctttaatagggagtttccaaaatatatggggttttttttccaatggaatgtttcgttcactataacattaaatctatacatagtgaaacattatgagtgtactaggtgaaatatttttggtggaacaaaaaataaaccaaattcccttaatagagaattttcaaaatatgtgggttttttgttgcaaaagagtattttaattcactgcaacattggatctataaatagtgaaatattgtaagtagactaggtgaaatattttttttggaaaaaagggagaaagaagtgggtgggtccaacagtacaagcgtggggagggacgcgcgggggg

SEQ ID NO: 15041 - DNA, 11871 bp, Oryza sativa
tgacctggcgcacctgggagaagggtgcggccaccgcgtccacctcttgcttgggcttcaaggctgcgccaagggtgccgccgtagtacgggacgctcccttgactgtaggttggttcatggcatctcttgaccgttatgttgttgtgtttggtttatgagtaggagtgtgtgattgagctcaagaaccgatctttggcttggagagaatcattgagggaaggggagtagagacccgatctattaatcttggaatgacgacgcagtggttctccaatatggtaaatttttttgtcatctcaatgttatgttaatcgtgctgtggattcgagtatggtggtgtctgctgatatcgttcgatggtttctttggtggcaggtgatggatgagccaagcttttttcaccaatggcattcggatgggctactggagcagtacacgaagcggtagatcaccgaggcgttcgggcaggccagcgaggtggacgcggtggcgggggagcaccggccgtggaaggcggcgaaggtcaacactagctgggactcgtgcatcacggagtagggctctttcgcggactcctccttcggcggagagagccccgtactacgacgccccgtactacgacggtgcccccagcgcggccttcaagcccaagcaggagctggacgcggcagccacgcccttctcctaggcgcgtccagtcaagcggagctacaatgccatgatcgccgcctacaatgcccttggccgctgcctcccggcctgcctaccagaaccaggaacacatcctcgccgagaggaagcaccatggcctacggtggcagtgggaaatggcctaagggcatttttgacatttcacacgatttctcactcctcacccagaaattattattttaatgggttctgtgtccaccagcaaatattcaacttttgagagtgtcttcccccaaaagtcacttcgcgcggttgccattaaaataatatcaaatgggctcaaccactacactactgggctgagtaatcaacgaggagtgcacctgtcaagttttgggccagttgggctaggccagggttcggccgaaccctgggttcggtcgaatccccatatcggccgttgacatccaggatccctccccaatgacggttatgtggtatttccgaccattccaaccaccacaaccatcattggtagcctatataaggccatcatctcttccactccctcacacactccaacaagaagatcaagagatctctctcaattttagtttagtgttctagtgctaatagagtaggaatagaatagttctcttagtactcgagtctttaggagatttcgggtgtacggctctagtagcttttccttcttttgtaagacttttagaattaatgaaatcttcttcatatagcttcgttcttttatttattttatattatttgagcactgactttactttatacttgtcttgatataattgtgtagctagcttaccaaagatatgcattggtgtgggtttaatgttcatgcgagtgatttctctatgtcattcctagggatgtaaagtagtatttaataatataagcgtggtgcttggattattagatatcattaattagggttatatactgcgggtcagaagaggtaggccgctgattgtgacggctcagtacgggtagtcctccacgttagtatatagtcctaagacactttcctggtatgggtactcctctgtattcatttccggttggatggttatgacggattgtcgtaagtaactcgacaatcagggtggtctctcaaaacactaggagggcatagttagggggtattggctacatgattgtatactagtaagtgtaaactaaagatggctgtatactagaagtataggaatgactattttcttattctttcttcacttagcctagattatattttagtgagagtattctggttcttccttcttcgtgtcaaccttatcctatccttgaattaattaacccctgcatagactttgatgtacacaactaatatataaattattagcaaagtattctcttatcatatctttccttgggattaagtaaatacgataccttagaatacttccgggtgtaatgctccaatggtatatccgtgcgcttgcgaattatatatgtaaacataatataccgcgaatatttcggcaccattgctgggaattatatttctagtaatgtcactaagaaatatcggctatgcctatgcaatgtttctttgcttcacggggcaagatgtccgaacaacctgtctcacctgagaaggaggctaagtttgaggtgacggattgcctgttccgtgtagcattaatcaatgtactagctgacaacatagtggacatgtatatgcacatgccttcagggaaggacatgtgggatgcacttgaggccaagttcggagtctccgatgctggcagtgagttgtatgtaatggagcagttctatgactacaacatggtcgatgactgatctgtagtggaacaagctcatgagattcagatgctggcaaaggaacttgagaacaacaaatgtgtgttgtcggataagttggtggcaggtggcattattgccaaattgccacattcgtggtcggactttgccacttctctgaaacacaagaggcaagagttcagtgttactgatttcattggctctttgggtgttggagagaaggcgagggcaaaagacaaccgcggctaaaaggtcgagggaggttctagcgccaatttggtgcagaagaagaacccccatgcatctcacaacaacaagaaagtcaaacctgatgtcaaacccaagacaacaatcaattctaagaagaaaggcaaggaaaaagtgaaaggcgactactttgtgtgcggtaagcttgggcattgggccaaggattgtcctgatcgcaaggacaaaaattctgcaaacatggttgttagcaatggcagaggaacaatggggtacggtaatttttacctacaattctctctatttttcactcacctaattggcgggttgataatggtgctaatagtcatttgtgtgctgacattttcctgttttcttcttatcagatcgccggaggttcttccttgttgatggggaacagatcgcttgcagctattcatggtgttggtatggtagttctgaagtttacttcgggaaagaccttgcagctgaagaacgtgcagcatgtcccctcaataaagagaaatctagttagcggctctcatcatgtagagatggttttatacttgtgtttaaatccaatagatgtgtcgtatctaaatatggaacttttattggttaaggttatgatagcggaggcttgttccgcttttctttagatgataggtgtaatatagttgtgaaccatgtaagcaatgatgatgagtccaatgtgtggcaatagccactttgccatgtgaattttggttgtatgacacgcttagctaacatgagtttaatctcgaaattcactttagccaagggttctaagtgtcatacttgtgttcaatcgaaacaacctcgcaagcctcacaagcatcagaggcgagaaatttagcacctttagaacttgttcattccgatatgtgtgaaatgaacgtcgtgttgactaaaggaggaaagaaatacttcatgacacttatagatgattgcactagattttgttgtgtacttattgaaaacaaatgatgaagcattgcattactttatgatctgtaaggctgaggtagaaaccaacttgaaaggaaaatcaaacagttggggtctgatcagggtggagagtatttttctaccgagtttacttcattttgcgaagagtttggaatttttcatgagaggatgcctctctattcaccccagtcaaatggggtagccgaaagaaagaaccgcactctaactgagttggtgaatgccatgttagacactgcgggactttccaaggaatggtggggtgaggcaatattgactgcttgtcatgtcctgaatagaatttctactaaaaaaagaagtaacatcattcgaggaatgggaaaagaagaagttaaatctctcatacttgcgcacatagggatgtttggctaaggtcaatgtgcctatagtcaaaaagcgcaaacttagactaaaaaccgtagattgtgtgtttcttggttatgttatccacggcgtgggatatagattcttaatagcaaattctagagtatcacagcgttagaatcaacaccattacctttgcaacaaatgagagaatcaatcccgatttgattatcggattaactctgttgattgctctggtaaaggacctgtggtcatggcgagggcgaggcatggcttggcttgctgctgctgctctctctctctctctctctctatctctctctctattttgcaacggacgggaattgaatctgcaacggttgagaatcaacaccattacctttgcaacaaataagagaatccatcccgatttgattatcggattaactttgttgaccaatcacttggacaggcagagacacatctctcggctctgtcttctctagtgcactgtcttcttcctttgcggttctctatttcctctattcctgcgctaccttttgtttccccggttttgatcacctgagctcacgggtgctcaggacgagcatgcctccagaactccatccgcttgtgtacctgcacgggtaggctggtgattaggtttttgggaagtgtcatccgacgcgacaactctgcatcggatatgtcctctgccacatctactcctcagcatcaattgtctgcgatgtctagtggagcgttctttggttatatctctattctaacctttgttttaatcatgttgctagatgtttttgtacctattagcatgatcatgtttagcactagatcacttcctcctgcgatcatcatgattattatttttttctagattaaaatatgccaatttatgactaaatttccaacatatgttgtggtattccatttgtattcttattcagaacttttgcatccacatttgtcttttatcctaaagttggggggtcaatgtagtttgaatctttatttattcaaaccatgcatacatacatttccttttatgacccatatgattcaccatacattattcatgatatatattattcattttcatcgttgtagccaccaactaaagagttacatttcctcttaatcatagacagggggtcatgtagtagagtcaaaatggtctttaaataatagattggttaaacctattagcaaagtactgttgggaaaatcaaccaatttggatgaaggtctttgtgaaaagcatggtgctctctagctagctagcagctgagtcaactactttactaaggtaaactaataaccacttagcatcagtatctcactcatggcatccataaaatctgcagcgctttctaacattaatacaatagtaattacagataacgaccacatttgataaggaaattacctacaaaagaagagaacttttgggtgcacaatttatcttagtggtgcccaaaacaccactgggtaaattttcaaagaatatcgaaatcacgcatgctcgctccttcattccttcctttcccctccctttcggtcattgtcccactgttagttgaaagaattttttataattatttatgtaagaattgaaaatttcacatgaaattcctgtgttgtcggttgatcagattttactagttggacattgtagagtgcggacaccatcaacactacaacagaagatgcatgcacattggcatccatgctggcggctaagtttacggtttgtctacatcagcagtagtatcttcccagaaatatcaaacactacacttgttgccatttatattgccatgctctacagggagcatgtgtaggaacaagtgtacaagagactatgtcgatacccaagaacttaccagaatacagatgcttgtgtggattgcacgaaacaactgcaattacacgtgctaaaagtgaatatatttgttttatgtgtaattatcttcgtgcgtctggatcatatatttgttcatatatgtagaatggcaaattaaaactgaccatgtttgtactacctccatcccagaatacttgtttagcatgtagtaaggttaagagaaaaagattataatgcccctcaacaaatgatgtatagttggatgtgagatgatggttgggggtagaatggggagaaatttcaattggaagttgttgatgtgataagtactacttcaaagtgataactattttgggataacttttgaatagtactagaaagaaaaatattgtgggacaaaggaagtaataatatgaaaaccttgggaaagaataagataattaacatgatctgttcaatagcggctgcagagttgttcagacaaatcaaatggttgaggtatatatacaaggagatagacgatgctagttgtttgtgaagtaattgatgagagtttgctagctgttctccagattaattattagactagcactggttaatatttgtttgttcctctcccctaaagctgtctgtgtcatgatgactgggatgtcaatgaattaacccaaagatgggatacttttttatatataatttatttagatacttaagtacactggtgataccatgtttgtggcatttcaattcaagcccaaaaaagaccaagcaggtacatgcaactactccctagtacaacgaatttggacttgagcctttgttaaaaaaaccaacctagacaacaatgggttataacctactataatgaatctggacatgcagacgatacaattaatctggacatgactaggttatgtcccatcgttgtttaggttagcctttttctttaagaacagagggagtggatcactgtctctggtgattactaattcacatgtggaaagttgtgccttctctccattcatttttttttcagaatttccatttacaaaacatgctttactcagtacactggagagatgtttaactccgatggtgttggaatgtaggcacaaacctgttcttcagtctgtgtcctgcgatgtcaaatacgcccttgattcccaagtataagggattctagatttttctggaaatattaaggatagaggaaaaaaactataatatccattattaatgtaatgaccacacatgagtggttaggtaagatgcggagaaatttgaatgagagatgattgatggaatatgtagtactccccaatctcttatgtttggagaaaattttgaatatcccaaccacatttgggaatggagggaataactactactgttgttgttgttattattattattattattattattattattattattattattattattattattattattattattattattattattattattattattattattattattattattattattattgctgcaaattacagattgttgtagtttgagttatggctgaattgaaaggtgtaggaaaagttctttcaggcaattacatggataaggatcatttcgctcttgtcactgattctcttctgaaagttggttgtcccattgaaaaaaatgtcacaaactttggtaagaaacatgatcaaaagctaaaggcaaaaatgagttgttctagagatttctttcctttcatttcttaaaaggagtttctttgctgtgaatgggttcacacttatccaccaaatgggtggggctgatttaacaagaagtaaacaggtaattctaacaaatgtccaaatgcttcatcaaaatatttcttattccccaacaattagacctctgtttggaaaaaaagtcctaatggaattgaactgtctgatctgaaactccagtgttagaaatggaacctatgcccttttaataaaagggttagttctcttttctctgttgaaatgaagtgtaaaattgtactacagttattaagctgccaggtatgccgctcgattttttggcattccctatcaatgaaggtaggaagatgaaaagttcccgcttgaaagataccgagggtaggtttggatgaaaggattttcagtttgctggaatggaaagcgaaattccttccaactaagggcagagggtagagcttattaatgcttgttttgagtagtactccaatatcattctttctgtaatgtcgttctacagtccaccacattagagcttgacaagtgacaactgtggcaataagctgtaggattctcgtgcactggaagcaacatctagccaaattgacatagtgttatgtctacatgacatgcatctttgacaaatgtttatcactttgtctataggggcttcaagtggaagttaattgccagatgcccagatggatattctacatggattcttaacaaatggtgtacagctttcgtagagattgtttggaagatcaagtcattgttattctcatccatttggttgttggcaagaggtgttttttaaatataaaggaagattttattgatcttagatgattatatcaaattcatagaaccgtactaagaatactttcaggatctgcataactatgatgcacacggtcaaaacacacacgcgcccacaaaagagttttgtaacatatgaaagaaagcaataaaatctaaggagcgccgatcttcagactagaccgtcacctatacctttgggtaaaatactccctgaccaccttctccaagtgttgacacgccactgcaaccaaatccaatgaaccaggcttttaaaggatagtgtaggtatagagccagtggatagctaaaaaaataacccgtcaagaagagtacagagccagcgtagagttttctttcgtcaaacaccatctcattaatagcgacttcaagtctttcttaattcttcgtagccaattgttagcaagaggtgtgagtatgagaaaatataatctaattaaaatatggacacagtaaagaaaaataatgagtaccagacagtttcttcagattttgctgcagaatttgaactgctaaactgatgttaaagaagtccaatagccaatatgatataaaccatttactctgctattctcttggcaattgaaattcaatcctaacgcgaaaacatgtgtcacctcatgggccacgataaaataggatatcaatatcactataccagctgattgatcatagttggtgtgttgtagtgttgttggcaacattcgaaaaagagggagaaaagggcagcatagcgcgttttggtttcaaacaagatcttaacaaagattatgggctcgatggcgatagctcatgggctgattagctgatatggctatggccctgatcgtttcttcgtttccttgtttagcagttgtagttttctctttttcgttagcataatttctaaactattgaatggtgagtgttttttttaaaaaaaacttatattaagcttttttaaaatcaaataaacatatttttcaagtttgtaataattcatactcaattaataatgtgctaatgacttatatcgttttacgtgcaactgaaaagctaatagctagaattgagcataagtgctggatagataggccaagctttacttttcctctacttcttaatgttttaaggtctctctagctaggctaatgggcgccagagaggaggccacattcttcataggaaaggcggccttccactggcttcttttctcttctgaaggatcacatctgctttataactagcataggccataggttacaagcttttgcaggatagcgtggctttttggattttggtacacaacaatctttttccataattcttataggaaatgaactgctttctggagaaaattctacaattctgatttgagttgttggacctacacctaagaaattcagagattagggatggccggcctgcctgcagaaaatgagagaaaagacagcaattggaagtgaaatagctcacctcagtcgtccttgattctgtttctcgtacgaggagatctaataaaggatggtgttcgatgcatccaaggaccaaactagctagatcaccaggtcaccacagaattctgtgtcacctgtacagacttgtacacgatgatgctactgctgttctatcatctcaatcagtacatactgctgtcttgcaaaaatctcaacgcggccccctcttttatttttttgattttttttccgtcttaacagattatcatgggaaagcttctcaaactcctaaacaacagtaacacgttttttttttggcaaaagatttctatatgtaagttcattcaaacactattttgaaacaacttttcaactttgtaggtgttgatttattcgtttgtatccttggaatattatcacaaaattggatgatctatcagcttagataaaaagaacccagtacatgactagtagctattgtgagccatccatccatccatgctggaaaaatgtactgttgcaagcttgaattttgatttatagcattagagcatcgacctataatgtaaaaatgcttgacacacgctgaagaagattatcgtgtcctatcttagggctgcttgagattgcaggaattttatagaaaaaaatggaggactttgaaccttgagattttttccttatacagtttttttttcatcataagatttgtttcctatataggactttgaaaatatttttttcctggagaagaccgacaggaagatgagtggtgtcgattggccccgaatgatgtcctggcgacctggccagatcggtggcctagagtggccaggtgcatcaaaggaggtcggggtgggttccagacgtcaacgatggcgggagctcagggccgggtaccaatgctggcgaggccggtggtgtcggcgtaaataggaggcgggggaggagctggtggaggaagaagtcggggtagcagaggccgagatcgaagggcggaggcggagaacagcaggacgacgagtggtagcgttgatgtggtgggggctcacgcgtgcgtcgagggctgacggcagaggcggagagcatccgcgaagcagatcggatcgcatagctcgagctcactaactccctcgcctctctcctcttctcctcgtccgccatccctcttccggccggtgaactcccggggaagagggggaatttaactatttgccacttttaggtttaccgattatccaaatgtccttcttatgtttgtctttaatttttttcctccctataagagggtggaatcttaactatttgttacttttgcccatgtggtatgccaacatagcaacacagtgtaaaaatcgacgtgggacccacttgtcaaccgcaagctatcgccttccctcctctctcgctctctggcatacccgtcgactgccgtcgctactcctctctttcccggcagcacgccggctcgcggctgcggaggagggggagccgagcgctgctcctctctttcccggaggcgaaccatgtcagcggcagcgacagcgtgctggctcgcggcaacggaggagggggagccgagcgccaccgtagtcgaggatgtacgcgctggactggacgtgcaaggttgtgctcatgtcgtttgcaccgacggtggtcgccgtcctcgccaagcgcctatctctctcgccatggagccatggaaggaggagggggagccgagtgctgcaacgagtccgacctctgcctggctatgctcgaccgcaaccacggccttcaatcagccgacggcggcgtccctccctccccggccatccactgacgacgcggacgggtccgcggatctagccgactcgatcccgccgatgacgattccatccccgcggatctaagcttgagtattctatagtgtc

SEQ ID NO: 15042 - DNA, 332 bp, Oryza sativa
cagtggttgccaatcagatagtgtctccagatctttaaagcatgaaccactgctgccaattccaggtcatgagttgaataattcccttcgtgtggatgcaactgccgcaaggcatacgcgaccactctgccctcttgcattagaacacatccaagcccgtggcgggatgcgtcgcaacagacttggaagtctttcatctggtcgggcagaatcaaaactggtgcggatactaatttctttttgagctcctcaaaactcttgtcgcactcagctgtccatttaaactctcatctttcttaagcaactaagtcatgggtcgggcgatccttgag

SEQ ID NO: 15043 - DNA, 709 bp, Oryza sativa
acttcaacaaatggtgcaaaaggaagtgccaaaagatcaagcaactatactcgtaaggaggacattcaattgtgcatttcatggcagagcattagctcagatcctattattggcaatgagcaaccagggaaggcatattggcagaggatcgcagagcactaccatgctaaccgtgattttgagtctgataggaatgcaaactctcttgagcaccattggggtaacattcagaaggaagtaagcaagtttcaaggttgctacaatcaaattgagcgtcatcatccaagtggcataccacatcaagagcttgtaagttaaattgtttatttattattattaataacaatcttgtatgtatgtgaactaaaacttaaattatgttgcaggttcttgaagctgaggcattatactcgtccactgcaccaaagaatagggcatttcagtttaatcattgttggctcaagttgaggaattctccaaagtttcaaacactagaatcccacaagaggccacggtctaggaagtctttgaccccaattgagagagctggtgaagaagatgaaggagatgatgctagcaagagtacagctcctgatttatctcagccgagtgctaaaaagagaccaataggtaggaagcaagcaaaggagaagttgaagaatggaggagaagatggaccatacaaagaggcgatgaaagatttgcttga

SEQ ID NO: 15044 - DNA, 707 bp, Oryza sativa
atttttaatccgaaatacagtatatctttagcctttgtaccgactgacaagtgggaccccgggtttattcctttttctaccgaattattttctaaaggaaattggatggtgctaatgacaggtggggcccacaacctattctcttctcttttctcgttctctctatcgtcttctacctccagaccgagcgggagcagcaggggagacgcggcgcgcgcagcaaggccggccgagggcgacccgacggtgaccaggggagggagcggcaagactccggtgtcctcctgccggcagtcacggcacaggacggcgcgggggcgagaggcgccgcatggccgccatggccgggcacgggtagctaggtgctagggcgatacggagggtttccgaccaaattggtgagggcgtgagcatttatggcgcatgagggttccgtttttctagaaaaatcgaagggagagcccccgggatggcatgtccacggtgacctccttgggcggagcttcggagctcgggcttgtcacgattatggccctaatcgacgaaatagttgggggaggtagttcctagaggaataggaggagtaacaggagtgaggacttaccgagggacggcggaacgacgaagttccgcggcggcggtggagccgggaagaagctacagcacgcccacaagatgttcgacgaaatgtgtagaagggtgaagaa

SEQ ID NO: 15045 - DNA, 739 bp, Oryza sativa
gcatcgatatcggcgacgactggctactacgactacgacaacttcatctcgactacatcgactatggcacaaagggctatcatccatgttaagcactcttgccggtttcttctccagtccaagtgtccgcgctgctcacgcttggactgcggggggatgttagagtatatggtagttagagatgtattaggataggattgatttatgtggattccttccttatctgtaatccttccttatctcctccacatgtactcctatatataccggccccctgaggctcaatacaatcatccaacgtttcatagtatatctctcctatactatccaacaatggcatggcgcggtgcacggcgcggggcacagtgatgggacggcgcgcggcgacgggacgtggcacggggcttggtgtggtgcgacgcgacggacgacggcgcagcagtggcacatggcttggcggtgcgtgtctcagggcggcgacgcgacgggcaacggcgatgggacggcgggcgcgacggcaacggtacgcggcgcgggcggtgctcgaggtggtgatagcgatggcggcgacacgacgacgtgcactagtagagatcggtacatctatgatgatctacttttgtcatggaagatgcaataatcgtcgtaaaataacatctatgatgaacttatgacgaaataggattagtcatagaactcgcgtcacataagtttctctatgacaaaatggtagatttcg

SEQ ID NO: 15046 - DNA, 1050 bp, Oryza sativa
gaaaataatttttttcctagctgtcacatcatagactccccaagaccatattcacctccatcttttgtcttaaatttgatttaatctaatccatgaccagataactgatgtcatcaccaaatagataaaacaaactcaccagacatgaagaactaaatattttcttccttgtcgtcttatgaaccaagctaataaatctaacatccacgctttcccgtatccgtagactgaattcctgataatttgaaaaaattcaccattgccttgaatccccgaagaaattatcactacagtgctcgctctacttcttcagtgacgcagattccgtatacctctatcgtgcaaaccctgcatatcttggatatatcatgtactgccaaacagacccgttgacgtccttttgctcgggtccatatcccgccaactccaccgcagctccacgctctagaagccgtctgtggagattatggataccccatacctacacgacatgtatagtccgactgggtatggggtgccatgtatagatagaatatttttaaagggactcgggttaaattccaaactcgtatgtcaaggaaatacccgagatcctagtcggttacgattgtatcttatcagtaactacctattccgttagggatatggattgtgctttgtaatacggacccctttccctatataaggaggggttcgggtgcctctaggggcacgattttctcccagatcaaacgatcaataatacactcggcggatcaatccccggacaggagtagggtattacttcttgattaagaaggcctgaacctgtataaattccttgtctttcaacccatccacttttccagcttgatagccacccccttttagtattgccgaaatcttgtttcgacagttgccgcgccaggtaggggtagcatcaagttcttcgccgactagtgcgatgggtttcgtctccggcattgacgacttcgtcttcccacctgggcaggcgtttcggtttggcagcctcgacttcatcaccaacgacttcggcaagatttctctcct

SEQ ID NO: 15047 - DNA, 460 bp, Oryza sativa
gcaaagctatggcaaattatctgcccgtggccctagcggattctgcccggtcctagcttcacgggctaccccgtggcacaatcgaatcttgggcggaacttcgcgaccacttcatcgctaatttctagggtacctttgaacgccctagcacccagtttgatctttacaacgttgtccagaagtccggagaatcccttcgagattagatctgacgtttttccgagcaacgcaacaagatctccgacatcatcgacgacgtcatcatcaccgccttcaccaagggcattcgccacgatctcttagtcggcaagtttggacgcaagcctcccaggatagtcaagcagatgttcgaaaaagccaatgagtacgccaaagccgaagatgccgtcaccgcatccaagcagtcgggcaccacttggaagccgaagaaagatacgccgactacagggggagtggaagt

SEQ ID NO: 15048 - DNA, 1365 bp, Oryza sativa
atggggagaaatcagttgggggtagaaaggcttaggaaccctctgctcatcaccacccctggaggggttatgacagcaaagtattatagccctgccgttcctatagaaatccagggaatcccttttcccttggatttgattcttctggacaccaataacttggatgtgatccttgggatgaattggttggctcaattccaaggagtagtggattgcgcaaggcgcactgtcactctgtatcgggggccggaacaaccggttgttttctttgcaccctcaacctctgtcggcagttcagaacttcatcagataggactgtcagaaatacccatcgtcagagagttcggagatgtgtttccggaagaactacccggtatgctgcccaagcgagagattgagttccggatagatcttgctccaggaaccactcctctatacaagcggccctaccgtatggccgcgaatgaactggccgaagtcaagaagtagttggaagagctgaaggaaaaggggtacatacggccgagcactttcccctagggtgctctcgtgatttttgtgggaaagaaggacaagacaaagaggatgtgtgttgactacagagctctcaatgaagttactataaaaaacaagtaccctcttccccggatcgatgatctgttcgatcagcttaaagctgccactatcttttctaaaatcaatcttcgctccggatatcaccaattgcgtattcgtgaagaagatatcccgaagaccgcattcaccacgcgttatgggctgtatgaattcacggtgatgtcgttcggtctgaccaatgctcctaccttggataagtttgttgtggttttcatcgacgacattctggtgtactcacaatcagaggaagaccatcagcagcatctccgtctagtgttgggaaagctgcgggaacatcaactttatgccaagtttagcaagtgtgagttctggttgtccgaagtcaagttcttagggcacgtgatatctgctaaaggagttgctgtggaccccgaaacagtgaccgccgtcactgattggaagcaacccaagacagtcactcaagtccgcagctttttgggtttggccgggtactatcggaggttcatcgagaacttctccaaaatcgctcgacccatgacacagttgctgaagaaagaagaaaaatttgtgtggagcccgcaatgcgagaaggcattccaaactctcaaggaaaagctggtttcctagccagttttaatcttaccagatactcacaaggacttcctggtgtactgtgacgcttcgcgccaaggattggggtgcgtgctcatgcaggaaggtcatgtggtagcctatgcctcacgccag

SEQ ID NO: 15049 - DNA, 1406 bp, Oryza sativa
aatccgcgaggctcaaaagaatgatccagatatgcatggactcctcaagaatatgaaacagggtaaagcccctggtttcacagaggatgaacacggaatcctatggaacggaaatcgggtatgcgttccagacgacagggaacttaaacagttgatacttcaggaagctcacgaaagtccttattccatccaccctggctgtacgaagatgtacttggacttgaaagagaaatattggtgggttagtatgaagcgggagattgcagagttcgtggccctttgtgatgtgtgccagcgtgtcaaggcagagcaccaatgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagaccacctatggagggaacaaactagccgaactctacttcgctaggatcgtaagtctccatggcattcctaagaaaattgtatctgatcgggaagccaattcacctctcatttctggaagaagctccaagaagagttgggtacccgattaaatttcagcaccgcgtatcacccgcagacagatggacagaccgagcgtctaaatcagatcctagaagatatgcttcgcgcatgtgtcctagatttcaggaagacctgggataagagtctcccctatgccgagttctcctacaataacagctaccaagccagcatacaaatggcaccctacgaagcgttgtatggccgcaaatgccggacaccgctattgtgggaccaagttggggaaagccaagtgttcgggactgatatcctgagagaagctgaagctaaagtcagaaccattcgggataatctaaaggtggcacagtcccggcaaaagagttatgcagataaccgacgccgtaacctagaattcacagtggacgattttgtgtacctacgggtcacgccattgcgaggagtacacaggtttcagacgaaagggaagctcgcacctcggttcatgggtcctttccgtatcattgctcgacgcggagaagtcgcttaccagttggagctgcccgcatccttgggcaacgtgcatgatgtgttccatgtgtcgcaactcaagaaatgtcttcgagtgccatcggagcaggccgattcagagcaaattgaagttcgcgaagacttgacctacgtggagaggccagtgaaaatcctggacaccatggagcgcaggaccaggaaccgggtaatccgtttttgcaaggtccaatggagcaaccacgctgaggaagaagctacttgggaacgtgaagacgagctgaaggcagcccatcccgatct

SEQ ID NO: 15050 - DNA, 495 bp, Oryza sativa
cgattttctaaaatggcacatttcataccatgtcataaaactgatgatgcttctcatattgctgatttgttctttcagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaa

SEQ ID NO: 15051 - DNA, 1340 bp, Oryza sativa
aaaccctagcgggttcgcatcaagttcaccttgggaaaaatccaaattaatctaaaaacaattcaattgtgggtgaataaattaataaccaaataaagcatttgaatttacaaatccaaaatatgttgagctacatttcaattccaaatccaacaccattttgcagattagcccttccacttttcctttttcctttccttcttttctctctttcctcctgtcggcactattcattgcccaggacgtattcgttctgggcccaagcctcttccctgtgtcacgcatgccatccctgtcaccatcgcgcgccgttgcagcgccgcacgaacgtcgccctcgcgtcgccgctcctgccgcgtcgagccccgcgtctcacgccgtcgtgtcgccatcgccttcgctcagccgcgcgctgccacgtaaatcgcccatctatgacgttttcctcatgatgttgtatattttcgtcattgaatagaccatatctatgacaaaattttctatttcgtcatggatcagtcatggcgggataggtaccaaaactctatgacgaaattaaaaatggcgtcaaggtacaatagaaaatttcgtcacaaataatgcacacctttcatttattaatacctgttggtcccacagcgcatacgtggatatccaaatttcatttattatacctgttggtcccaccgtgcatatgtggcactggtcccaccgcccgcccaaattatatgtgccactggtcctatatgtggctatcattttttttataaaaaaaaatacacctgggaatcgaacccagtccatgagcatttgcgtaaaaagctctaccaccatgatactaagatctttgagtgaaagcttgtttttttgttaattgtcctttatgcggtgaacctggagaggacgcggcggccgtggcgccaccatgtggaacacacccactcggcggtgtcgtgtttcatcatctcccacgttgggctgttccccaccaggtggtttggatctgaatccccttgaatagttgatttacgattgtgccctcattatatgtgtgttgtagtgttgtaccgatatgaacgaggggtaagtcagtccaaaccacaagaaaattcacaagaatagcagcaggtttttacttttaatgcatgaataaaattttaaagtagtttatctcactcatatgagttcgaaattagacgattcctttttcattattcatataaaaatattgtctacaatttcgagcacgtttagaatgttgtcaagtaaacagtgaagactcataaattgaaattcaaaattttgaattgtagaacaactgtgtggcttttcttttaaat

SEQ ID NO: 15052 - DNA, 703 bp, Oryza sativa
  unsure (1)..(703): unsure at all n locations
agctatcactcatggttcgaatatttaatatctgatttttaatttataatagaaattaatatttgactttactatcttgtgcataaatattggtagggttaacaataatatattctcgtaaattatatctattgcttaaatgtcgatcttttctttactttctttgtgatcatttatggtttggcaagcaatagcaatcataacaaccagcatgatgcaaaagtttaaaaagttcgaaattttagtgatttttattgtcaggaatttttaggatgttacactaactcagcgcctattacaacagtcttagtaggatcggaaggatctagaggaattttcttggtcttggcgttgctttcttcgctctttgtcatcttggtcgcaggcacttgtccttcggttgctgtggacgcagctagtcggatttcttctcgggcgagcgtgatctcgcgggtctgagccatctcgcagctttccttgtcgcaagtgacggctagcttaatatcgctccgcagggatatgactccttggggacctggcatcttcatcatcatgtaggtggagtacgggacagccatgaacttggctaatgccggtcgtncgagcatggcatggtacgctgtctcgaaataacaacttcgaagcaaatattctctgtgcgaaaattctcccgagtgccgaaagcaaccggcagagtgatctg

SEQ ID NO: 15053 - DNA, 511 bp, Oryza sativa
gcaagcaagcgagctaaaactccaaactaattacaatataagctagaagagaactgtaataatatcttagttaactatttatatagatgtagactattaaaggtcataaccacaaatgcaacatccaagagaattctacatacatataattctatgggaatacctcaaaaaaggtgtcaccgtaacgtgagaagttgagatccgaggactcgatacttttggcaacaagttcctgtcagtgaaaggtctttataagaattgattgcacaggataaaatacaagtaaaacatatgtatgtgaaggtcggcaagatagttttacatataaatataatgttagcttgtatgtcgatattctagcacttcaaataatgttcaacatgattacaagaataaaaaaattaaaatttactatgaagtcataattggtgtatagcatgtaatgctttggattgaatacactaagagatgaaaatgattacattattcactaaatatgttgagtacgggg

SEQ ID NO: 15054 - DNA, 787 bp, Oryza sativa
attttcttgaggtattcacaaaaattgcagtaatatttttttgcagttgaattttggcgattgatgcaaaatgtcagttatctgtgacatgagagcagtattaggttaaagtcagcgtcacttaccgtgttatagatggcattagggtggtaatagttgcctgcacaggccacataattggacggccagtcgtaagcggcgaacgaactttcacaaatcagtgaatcagatctgttgtgagtgcaaacaccaaatctaccatgttggacatttggttggccatttcctcttacctgattactccttcaattactactaccacattgagtgcaccgtcaacctgcccaatagtaccagtagataacaagttatagtgccactcatgtccttgtgtcagttgcgtagtcacagttaagtttagagtctaatctacgaccatgtgatattacatgcttcgaaactactgtggtataaacccggggaatattgcaagtatttttatgaaatgacaatataatgtcttaagttgcctctaaaatagattaaggctgtgttcactccagccggatcccaacccaaacagtgtgcacggaaaacgaagcggtccattagcacgtgattaattaagtattagctaaatttttttttcaaaaatggattaatttgatttttttaagcaactttcgcatagaaaacttttacaaaaaacgcaccgtttagcagtttgaaaagcatgtgcgcggaaaacgagggagaggggttgggaacttggggtgccgaacgcacc

SEQ ID NO: 15055 - DNA, 848 bp, Oryza sativa
  unsure (1)..(848): unsure at all n locations
gaaactaactaccaatgcgaactttagattgcaatcactagtggataatatttgtttcatgtagatgttgtagagtttcagttatgtttaaaattgctataatatttgcattttaatgtcaggcaatctttcgtcaaagcactgaaaccttttgttaaatggctggaggaggccaaggaggaggaataaatggtgctactggaggctgtgcgaatgtattgtttgaatatttccttatatcccaagtttccagctaaagttatgtatcttttgctcccttgttactgggccgaccattttatgatcacatgctgatcctaatagtctactgaatgttaaaatcccatgcaagaagttattccaggatttgctaaattattggttgttacaacttacaagaatgttccatatgttatttctcaactgttggtacttaagatattttaaattcttatgatttcattactgtgaccggacctttccggccagtagggactctaggaagcccatttttttttcactattttgctcgaaatgaacgacaaatttgccattcggatcgccacatgtaacgtggttttgcactcccggtggcatttgacggccgtttagagggaaatccacttatttatgaatttagatatggatgcgaattagtgcttatctnccgttcttaacaagagccatcacgactcaatcaaatgatgcttcctacggntttatngtttggacagcgatattttctctaaacatatanttgagtatgggtttaaaatttacgtagcgttaataaacgtgttttccagcgctcccctagacatgtacaatggtggctaataacggtctct

SEQ ID NO: 15056 - DNA, 546 bp, Oryza sativa
aaaggagagagaagccgagcgtggcagcggctctagggctagggaaaaattcaggaaaaaaagtaggaaacggaagaggaggcccgaggcatgctatttatagccaaaggaggaggagatcggctcggatacgaggggaatcggcggcggaagggctagggttcgccagcaaaatagaagataaactccacttcgaatccacgcgatataccacgggatatactccgattcttgaggggaaagaaagaggaggataagggcaacaaatcccctcaatcaatttcggaaacgggacacaagatgcgacggatttggcggtggtagcggctgcacacacggctcggcagggagtctggaggttgggggcgacactgtagcagagggacacaatacagacttcttgccgggctttctttctcggcccgattggaagagggagacaaagcagacttcgccgcgagagacagccgctgctcgggctgaagaagagagagagagaaaggagaggagtgggccggattaggccggatttggcccggagctagg

SEQ ID NO: 15057 - DNA, 701 bp, Oryza sativa
gaagtagaattcgaatctttgcgatttcgtaacttcagcgaggagcgctatggagaagaccgagtagatgatctttaccgactggaagaagcccgtgaagcaaccttaattcagtcggctcggtatttacaagggatgcgccgttatcacaatcgcaatgttcgatcacgagctttcttagtcggcgacctggttctgaggaaaattcaaactacacgagatcggcacaagttatctcccttgtgggaaggactgttcatagtttctgaagttactcggccaggttcttattgactcaaacgtgaagacggtactcatatcgacaactcttggaatatcgaacatcttcgtcgtttttatgcttaggcattattttttgtatcttcttctttgactgttaacatcaagttcttacttgagttatcagtcgggggctactataataataatggagtgtgatttttatcaattcaatttgcttacttgatttatcattgccttggttgattttttggctttagttaatgaggactgaaagtttttaacagcttttgcgggttctaggctcagtaaggtttgacaaaaacttttaagaaatcaggagctgagtttaaatcatcaagcacaacataaattcatcagtattgtacaaattgtgcctccatcatcatcatcattgtcagaatacaatatcaatcagt

SEQ ID NO: 15058 - DNA, 1174 bp, Oryza sativa
gcatttcatcatcccaccacttgactaatatgggtgggcgagaatcttcacctgatcgtatctggaggacctcttcttcattaccgatcattggcccttatatattcatgaataatggtgaagcaattgaagaaagtttgtcggatcaagacagatttggaggacttgtttacccattataatttccggtcggggacgagcaggtccttgcaccctaacaggagagttagttccagggtcagcagcagcgtccgtcttgggagggctgttggcttgagcttccacttctgggatatctctattttgttctgtacccaactggtttccagtcgggggctcttgatcagcaccgacttcagcttcggctgactggtttccagtcgggggctcgttgctagtatctatattgccggttgccggttgattattacctgggcggtcttcagcagttggcccagtttctgctgaaggactagtctctgtgccagtcggcatggggtcttttccaaagggatctatgtcagatggtttcctccaaatttgagacatgctatcagctttgcttcaatagtgagtgactagcgaaacaggggaaattgctagatgacacatacctggatgacttccttatttttggcatgggacgactggacgttttcttcttcggattggcttgctttggctgtttcccaatcacccctttgttgtccgtcttttccgcgtcatcaccttcatcgtcacttgaaaccaacttcctcttacgagaatctgactggttagttgacctcgaggtgttgggttggacgtccgactggatcttcggccctccactggcttggccagtgtgccggcgaggtgagcggcgttgagcaattggagtatcggatttcatcaaagcgaattcctgtgcatggtattccaagttttcagtcgaccttacagaagataaaagcatgctttgagaaaggctaaggtgtataatacataccggtggaggagggttgaacgtattgtatggcacgactagcaataagtgtgaatagctgaccacaatggcattcgagaagattttgtacattctctcctacataattttgaactcaagagactctgggttctctcggttggggtcatgcttgccatcaaactcaaaagctgtgcgggatctctcctt

SEQ ID NO: 15059 - DNA, 781 bp, Oryza sativa
  unsure (1)..(781): unsure at all n locations
gctgctcaccttccgccctggctcgtcgcagaagtagacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaacgaatttaatagcagtaataaattcaagaattatggtagtcgtgggtggttagttttaatagtcagctctctctgtttgccggttctgtgtgggattttcagatggtgacaaccaggagaagtgctgctaccggtgaaggcagtcaccccgaaggcagcaaccacaacaagcatggcagcccacctncaccttcttccccgccaccaccaccaccaccagacaccaactccatcctcacccaaatcctcgcccagcaggccaacatgatggctgctttcctccatcacatccaaaatccgccacagcataatgctccacctccaccaccacccccgcaacattctaaactcgctgagttcctccgcatccgtccgcctaccttctctagttccaataaccccgtggatgccttggattggttgcatgccgtggggaaaaagttggataccgtgcagtgcaacgatgaggagaaagtcatctttgctgctcaccaactgcagggacccgcatctctatggtgggaccacttccaggctcgcagccaaaaggacagcctattacttgggcccgcttcaccgccgctttccggaggaccca

SEQ ID NO: 15060 - DNA, 449 bp, Oryza sativa
accttacgaactttatccaaagtatttgggacacaatgtccctcagggagcaaaagacagaataagtgaagtatttgctccatggcattgttactgataccatacatgcacttaatctgaaatagcctgacaatgaaagataccatggtagcctccttgcaccctgggtataattctttccgatcttcttccattaatttgaaaaaattctttgctgactcatttggcacctcaatattactatctctgattagcgaagaaagccgattatcgatagagccgccatcatcaacttcgggttcactaatctcctgatcatccacaaccataggtttactaacagaatgtttctattttatgaaatccttatcaaaccctttaccaagcaaagtgttgttgaacctcaattttcgttctgtatgccatgcaacgacacctagtacatggac

SEQ ID NO: 15061 - DNA, 2066 bp, Oryza sativa
acgtgcgtgtattattccatgtcccagaaggcaaggtataccaaaagttgatacattttagagcttatcaagcggaagcgtaaatagttaatttattacctgggcggcgaaggcccagcacacaagaagacaaacgaaaaacagcggaggactagggcgacgaccacaggcgcttgacggcaggcacgagctagacaccaaagccttcatcttccaggaactcctcttctgggtttgggaaaaattgagcaagactgagtacaaccaccgtactcaacaagacacacccataagtgcagaataaatgcaagggagtacaagggagccataatataggggttagggtttgcagtaaacagcattaaaagacacttagttgctcaaagctattttgtaaatacgaccctagagctatacaatattattaatcaaggccgtgaacccacacgaacctgccttaacccaaggcctacgatgattcagaccgaactggcaacctgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggatggaagacgtgacatagtttccaacccatcctagccatacacaagagtccgacccaaccccacctacggtcggaacatccgggacaggtaggcaggactgagcccctagcagcaggacaccggccctgtgccatgacatctcgactaccgggccgcagctcgtgtagccttcatttgccctagagatgtccatcgacccccgacttcgtccatctccatctgtgtacttttgtttataaccagactgatccacaaactaagccttacccactagacatgtggaagtatggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccaaccattccataatgtccaggtgatatgaatattcccaaagtctagagctgtaaaaccacctaatgttgcctaattaagcggcgaagcatctacctaaattcatactagtggtaccatgagtagagtgtccactagttggggttttgtttattctagggtgaacaaggtaataataacaatagcaataataataaggtcataacaaaggtaaataggcatggctaaataaaacagtgataacgcgggaatttaaataaagcaataatgcaataatttaaatcaaaataattttataaattgggattcaatatgttcaaggatgatgtgacttgccttgctcgctttccaaaacgtcggcttcaacctccacgaagagcggatctacacgaccaacggaaaagaaaaggctttactctaataaactccatataacaagcaggaacaaagcacaaaaatggattcttgacttcttaaggaaaaattagagacttgaacggtccaattccgagtttaaatggccaagttatggccatttgaagtttatatgctctttaaatgaatatttgccaatttcttcatttaaattttaatttaaaaagggtttattgcgtcagccgagggggaggggcgcgcggaccgggtccatgggagtgggacccacgcggcagcctcacggtccacggtggaccgggtgcacccgggctcacacctgccgacgccgtgggccccacacgtcagccgcacccgagggcgcgggcggctgacggctgggccccacgcggcagccactcggtgcgcccgagggcggccatgccggcgcggtcgacgagaggcggcgcttggcgcgggcggggcggcgggagcggcgggaggacggggatgacgggtgggccccaccc

SEQ ID NO: 15062 - DNA, 678 bp, Oryza sativa
ttaggcatcatacgggatgtaaagcttgtcaacagttcgttaatgttcaattggtgcccgccgcagtgttcaatcctattattaaaccatcgccgttccgaagttgggctttagatttcataggtcaaatttatccttcgtcatccaaaatgcatcagttcgtgccagttgtaatggattatttcaccaaatgggccaaactcatgctgctatgacttacacggaggtaattgactttattttaaagcatattgctcataaatttggcattcctcaaacttttatgtctaaggaggtaagaagtttttccaaattttatggtattaaattgttaagttcatctctttactacgctcaggctaatggacaagccgagttgagtaataagatgtcgttgaaattagtcaagaaaaagatcgaagaacatccaaagaggtggcatgaggtgctttcgaaagcattatggaatgataggatatctgaacatggtgctactaaagttactccttaattttgagtaggcttatggacaagaagccgttttaccgatagaggtgaatcatggctctcttagatacataaagcaagatgacttattggttgaagaatagaaaacatttatgggagacaatctttatgatgtgaccgataagtgtttgaaggctttggaagtgatag

SEQ ID NO: 15063 - DNA, 101 bp, Oryza sativa
acgaaccattggtgacaaggcctatcggcagggttttttctggcccacagctgtatccgatgctgacaaaatcgtgcgaacatgtgagggttgccaatttt

SEQ ID NO: 15064 - DNA, 1167 bp, Oryza sativa
gtctgaatatacaacagatggatataaagttgaaaccactttctatgcatgaaacacttatttttcttctttttaggcaagtttatggaggaagctacactttgtcgtgaagatcagagtttagtttatttgcttatttccactgcgtttgtaagaattatttattatttttgaatgatgtggatctctgtatcaatttgtccgttgtgtactctggctggccctggacagagattttaatacacattctgcttgaaattcgggttagcgaatttctaggcgtgacacttgaccggcccaccagggttcggccgaactaggacaagcgccaatcgcccccaaaatttgaacactcgatctgcctactctgtcaacagtagaactgaatcattcgtgcggtagctcgttggatcgacccagttcattaaaatctctctcttgttcatctccctgtccactccaccttatccattcaagccactactctctttagctcgaatccataagtccagtccatacccaagatcttcaatggctgggaaatccttgttccgtatggtgctacatgctgaaacgcatttgatctcaatggagagccctctccggcgaatcaattggtttcgggagaaaactgggcgatggaagaagcaaatgcgatcttcatagaccccctggacaccatcgcggtggactccatgagtatgcggccgatcttttctgctcctagtttagccgaacctaggtcgggcgaaccctggtcggcctcgatcaaccccctgtttggccggtcgccagtctcgccacgctacaaaactccgactaaagtacggggtgtttcccaagcgcagaggccgacgacaggagaattgggtctactaaagcgagcacgatgactttttgaagacaaggagaaggccacatcttccgccagcgagcattatgtgggatctcttgatgtgactgtcacaccccgaagttcttctcccaagccaaaaatttaatttataagcgaccctaaaaaaaaaaccggtgcaaagcaagagtaaacccttttaaatcaatgcaaataataatcgaatctgacatgtggaattttttcttgagttctacatgtcgaaatttactaacaggatttttagtggaattttcagagccctagaaataatt

SEQ ID NO: 15065 - DNA, 505 bp, Oryza sativa
ccgagctaagccaaggcctcgaccaatggaaagctagtgaggatcatagctctgaaagatgagatagcacgcttgaagaaaaagaatgctcagttgaagggtctcccagcgccaggggagtccggatccgcaccacgccccgcaagacggcgactgcacccgtgcgcattcagcttgcgcccaggaacccacctccgcccgcaattctcgcagctccagctccaaccccagctccagttccagtgccagctcccgcgtccgctctctccttcgctccagcgtcagctgccaggggtccagccagtggcaacggaggttggttgtctgctactcccagtggcagccgcgaccacagcagcagcagttccagtggctcagagccgggcagcagggagacgtatctgccagactccaggagccgctaagagggatctggtgacgagcaggaggatgccttcgactccaccgaccgcaggagccgttccgagcattaggcttgctttcc

SEQ ID NO: 15066 - DNA, 560 bp, Oryza sativa
  unsure (1)..(560): unsure at all n locations
tcggggtcgtccccttcctccggccgcccgctccacgtngccaccaccgccgaaactgccgccacgcccaccttcgtcttctccgggccacgacgtccatgtggccctcgcgcccgcgcctnccgcgcccactcccctctctctctcccgcccgcgcccacgcccgagatgaccgggatccgattttcgaatcccgcctctctctccttccctactccccgcgttggccggcggaatcccgcccctcccggccacgtccgggattcccctcccctatttaagcttccccgtcactccctcttgctttttccccatttcgccgaactctcccgagctccccatcgctcccgcgccgtgcaaccacccgccgccgccgttttcgccactccggccgccgctagccgccgctagactcgccgccgcaccgcgccgtcgccgccgtcgggttcgcgaggctaagctccaccccgtccgccccttccccgtcgagattcgtcaccggaattcgcatcccctcacgctccggtgagttcaaccgctaccgccgctttcggccatgg

SEQ ID NO: 15067 - DNA, 155 bp, Oryza sativa
ccaacctcatccttctcgaatccaaagatctagacgtcattcttgggatggattggctgaccaagtttaagggcgtcattgattgtgcgaatcacacagtcaccttgaccaatgagaagggagaaaccgtggtgtacaagtcaccagtctcaccg

SEQ ID NO: 15068 - DNA, 685 bp, Oryza sativa
accatcagggaaaggttgagaattgcccaatctcgacagaagaactacgcggacaaccgccgaagggagctcacttttgaaacaggggattacgtgtatcttcgtgttactccgctccggggagtgcaccgttttcaaaccaaaggcaagttggcaccacgtttcgtgggaccatacaaaatcttggaacgaaggggagaagttgcttatcagctagagcttccttccaacatgatcggcatccatgacgtgttccatgtatcccaattaaagaagtgcttgagggtacccgaggaacaagccaattcggagcacattgatattcaagaagatctgacgtatgtggagaggccacttcgaattcttaagaccagtgaaagaagaaccagaaacaaggtcactaggttctgcagggttcagtggagtcaccattcagaggaggaagcaacctgggaaagggaagatgagttgaaggccgcccatccgcacctcttcgccagctcctccgaatctcggggtcgagattccgtttaagagggggggtaggtttgtcacaccccgaagttccttcccaagcctaaattggagttttaaatggtctcaagaaaatacctgtgtcaagcaagagtaaaccttaataaattaatgcaaataataatcggaattggcatgtggaatttttctt

SEQ ID NO: 15069 - DNA, 11213 bp, Oryza sativa
  unsure (1)..(11213): unsure at all n locations
atgaaattggtcagctgagtgcagtatttttttttaaaaaaaatatatcattatgttcagaaacaatatctaatctaaagttgcaaacttgctgtactaatcaaattgtgacaagtgatgccatggttcagtccaattcatgaagttcctggttcagaacaatctctgaactaaaattatcagtgtgaaaatctgtctcagggattcctgaaacactgaacatttcctttccaacaaaatttgtctcagggattcctgaaacactgaacattttcctttccaacaaaatctgtctcagggatatcgtgtagtagcagataactgggctaaaatagacagttcaatgcaaaatgtacaaaatactaattaagaatattactcattttacagatctacaatagcaagacaaaatatcgcagcaaaacaaaaacttatcacaattccaaaattgcagaaacctaggcctagactatggataagtgggcagaacccacaatgctcttcttgccgctgggacttccatgaattctacccctccatctttcacattggatatcttcaaacacgccttatccccgggataaaacatgtagacgcaatccgccttcagtccacgatcgtcggccgaacacgatgcaccgaaatacccaggagctagcaggaaagcacggccaccaaggtcatcggctctgcaccaccgctgctcagagaaatccatcttatggacttgggtttcaccggcaatcatgtcgcagccaaagccatagaccaggctgaccatgtagagctcctcctcggatcccaccaagaacaccttcgccctgttcgcagcctcgagctctccaccgagctcgagcgagctgaacgccggcgtgggggagaactctgagcacaccgatgtcggtgaggctctcgctgttgaagtagaacttgccccggcaagcggcgatcgggcatatcggcaccttctcgtgcaggtcactgactggatccaagagctgcgttccaatgtcgtactcgtgtctcgcccacttcttgccgtcgacgccacagtgccagatgacattggcattgggctcgacaaggagaacaatgcagccaggaagagtaggcttgtccgagagcaagcaggagctggttcttggtaagtcgtcaggtagatgtggcatctgaaccttctcgtcaggattcagagggctgaacatgaaggtggacagcgaagttttgtcgtgaactaggatccaaccctgcggcgtcacccagaatttgctgctgttgttcgtcagggcatcgatgtcgcaggcgatgtcctgtccctcgaagatgttgaacagtgtcgtcttcactgattccgggccgtgctgctgctgctgcaaggcgaggcagggcacagggagaggagccatcccaaatatcgtgctctaaatctcccaagcaagctgtggcgacacctagagagtatcgtaccctttactacttttatatggatctagcaagatctgtctcgatgaagagaaactacccttgtggcgtggcgatatcttaaataggcgaaccaaacagccctttggagagcagaaccagaatccgactccgagtcgatcaaatcggattactgaaataccatcagatattcagatatcagaagttcatcagaacatgtcgaatcagttgaataatcgaccttctagtaccgagcacttgccttccaaaaggccgcgccggccggcaagtgacgccgccccccgccgggcacctctctgctcagggcttcagacctcttgccctagaagatgcccgcggctttgggcttgcattccacgcatatgaccgttcgtttgggaggggatgggacaagcaaagctaaggtcttctttgggcatgtactagtatgtggagcttaacattctgaggtcatatttgttttaattaagattattgtaatccaaattattaaaccagattagtataaacagaattataataagttatgagttgtttgtttctttgaattatcggagacatatattattgagtttaaatggctaatgtctttaatgcccttagctattgcggaatgggatatatactccaacactccccctcacgcgagacccctctcaagtctcaagcgtggaatattagagtgggctgcaattattttatttaattgcgcgccagccaagattcgaactcgagacctctggctctgataccatattaagctacatgcaccagccagttgcacctaaaagcctaaactgatagggaaagacgatcaattcactttatatactccaacggatgagacggcgacaacgacgcgccttggggaaggagtcgggctcagggtgggggctcgggggaaggatttgcgcagcgcagggtggggacttgggaaggatttgcgcacgatagggagagaggaagcggatgcacacacggccgggggaggcaccggattcgcgcacactagggagagaggatcagaggaagcggatgtgctcgatcaattgggttcgatggcagtggtgggtaatttgcataaaacttttaagggtaaggtaatggtctttagccacctaataatctgaaaaggcacatttagagaagattatcatattatactaatctagcttatagattataataatgtatcataataatctacatatttgtttcaaattattgctaataatccatattataataattctaagttgaaacaaacaaggcctggaaaagtagagttgctacaatctgaaaatatagagttgtcaaaatatgaaaaggttggattttttagtctggcttttagtttattttttgaattctacaactataacttatcagaatttaaactaaaaattagattgtttggggagcttcggattctgatacaagctttcccaaatagactcttcatcatgttgccatcatcacctactaactaattcgagaacaggtgcaaccggaagaaagtaattgattgcaaccatgaacttgttcccgttgcatcccacaagcacgtttgctagtatgctacaatatcaaaaaggagaagaaaaataaactggccaaatccaaacataaatgaagtataagcgactgtttggttgattttagttattgtcacatcggatgtttgaacactaattagaaatattaaacgtaggcgacaaaactcattctatgattagcctatataaacatatgctaattagggattaattaggcttaaaaaatttatctcgcgaattagctctcatttatgcaattagttttatcattagtttacgtttaatacttgtaattagtgtcaatcatctgatacgacagtgactaaaattatccaaacaccacctaataattccaagctgaaactatggatcaacgtgcagaatccacgacgctctgttcgccggtggaagtccgacgaactcctccccgccgcgctctctcacgctcgatatcttcacgcacgcgtcctcccccgggtagaacatgtacacgcagtccgcctccagcccgcactcgccggcgtcgcacgacgccgcgaaataccacggagccatcacgaacgcgcgcccgccgccgaggtcgcgcgccctgcgccaccgccgcggcggcggctgctcgtgctcggagagcctgtgcacccgcgtctcgcagtccgtcatcccggcgccgccgagctcgtacaccaggctgaccatgtacagctccccctgggactccaccaggaagaagtgcgcgtggtcgacgtcgcccagctccccggcgtcgatgtcgagggaggcgaacgccggcgccgcggaggcgaggtcgagcacgccgaggttgccggccgcgtcggcgttgaagtagaacgcgccgtggcgagcggcggcgaccgggcagatcggcaccttctcgacgcgcaggctcgcgtcgtcgacgctctgcgtgccgatgtcgtactcgtgcttcgcccactcgccgtcgccgtcgccgccgacgcggcagtgccagaacacggtggagaaagggtggacgaggaggacgacgcagccgccgtcgccgccggccggcttgccggagaggaggcaggtgcacctcctcggcggcaagtcgtcttggggcagatgcgggagaggaatcgtgtcgtaggagtcgcgagggttctgcaggaacgtggcggcggcggcgtcgcgcactaggatccagccctgcggcgtcgcccaggcgttggcattcgtcagcccagggatgtcgccgccgccgtcgatgaccttcctctccgagatgctgaacagcaccggcttgtcggagccgccgccggcgtgctccagggcgaggcagggtagacgaacgccgctgctcgacgtgtccatcgttttcgccgcccaacacaaagaagaaattttgacggcgacgacgtcgctttggtttcttgtaatttctggctagattgatcttgcgagaaacaagaaaaaatcttgtggcttatctgatttggtttacgataactgcgtgcaaacgcgatactctgaaaaaggaaaaccgaacttgagtagaactcggaagaaacaattttaattgtccccttttggtattttgagtttaaaagaataattcatcagccgggcatgtaaaggagacatgtttgatgtactcaatccaaatccaaacagtgtgactgaatctttttttttttagcaaaagtataaaatcacctgtccatgttctgaaacttgagacaaatttaccaaacgtattatacttcggtttggagtttggactgggaacagtggaagacagttccatcctccacaaaatttggttgagacatgtggcgcccgttccgtcgtggcgcctagcgggaaaattatctcttaaaaaccctaattacgagatttgtttctttgcttgttgtctagtgtccgtgccatctcaagatctcaatccccgatctatcgtcaagttcaaatccgaatccaaatccttccaaatcaaattcctccgcaaaagtctattttgcctcctccggggtcgatgggccgaatctcgctcggcccatctctccctcccctcccccggcgcgctccttctccccctctctctctctctctcgccccctcccctcccccggcgcgctccctttccccctctccctccgctccgctccgccccgcccgcgcgccgcgcgcgcgtgcgcgtgagccgccgcgccgagcgccccctccctttaacctcgctctgcccgcgcgtgcgcgtgagccgcccgcgccgagccgagcgcccctcctccgctcccttcgctctgcccgcgcgtgagcgcgtgagccgcccgcgccgagccgagccctcatttccgctccctcgatgccgctccccgcgcgtcgttcgcgcgcgcgcccgcgtggtccttgctcgcgtcgcatctgcgccgcccggccccgctgccctgccgcgcctgcagccgctcggccccgcagccagcgcgcgtgcccgagccgcgccactccatccgccgcgccctcccgttgtttcccgcgcgcgcgtgccgagtggccgaccatctggtcgccgccgccgtcactctctgccgcgccagcccgcgcctatcgcccgtgtcgtcgcgccgctccaaaccgccccgccgtcatcgccgtcgtcatcgcctcggccccgccactccgcacgcaagccgccaagggacggaggccgagccctcctccctctgccgcgacgcccccgctcccctcctcctttttcctaaatcggcaagggggcaagcccctttctccccctcctttttccccttttcctcccgccggcgtcatcctccctccctctgtcaccgtcttggccgcgagcgccgagtgccagctcgcgccttgaccgcccaaggtcggttttcaaaccgacatcgtcgtcctataaaccaaggcgccctcccatccattccccctcccgtttcgctcgccgccaccgcgccattgccatccctctgtttcgccgtcgccgttcgtcgttgcgcgtgtcggaggagccggcacgagcaaggacgcggaaggggacttcggccgcgccctctccttcctcttccccggcccgaggccggagagattactcccgcgccgtcggcctctcgtcactgcgccccgacccgcacggtagtgcctctctccgttcttcctcctcgctccatcttccccccttagttttcggtggtagcacgagtagcctccccgtagctagccggcgccgccccgaccgttgccgtcgctcgccgtgtgctcgtcgtcgtcgccgctcgagctccgtagcacccgctcgtcgccagcctcgctcggcgtagctccgcccaatccgacgctagcatcggattcccgtagccgcgtagatgctctcgccgccgggaatcggcccctcgtgacctcgtcgccgttttcctcttccctccccgccggttgccgccgccgcgattcgccgccgtcaagcttcctccggcgaatccgagccgttggctcgtctccccttatctcgtgcaaccacccggtgtgctcgctttcgccggtatcgccgtggttcgctccgccgctcgccgctgttgtccgccgtccgttccggccggcgtcgtcgtctacctcccgccggcccgcgtggcagccacgtaggcgccacgtcggcgccagctcagccgaggtcaggacgggccgaccccggtcagcccctcccgagcgcgcgttccaccgcaagccgtgaggctgcgcgtgggcccgctgcatccgttcctccgcagaccgcgcgtgtgcaccgcgtccctcccccgcccgcgcgcgtgcgccgcgtgctccctccgcacggtgagccgagccgctgacaagcgggtcccactcgggaccgcgcacggtgagcctggtctaccggccctctctctcctcccctcccgcgcgcgcgcacttgggccgccttgggccggccggcccatttagctcgtccggtccgctccttttcccttgggccgcgccctagccgcccgaggaaaagtctataatccctccctattttcttttcttttctttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcactgataggatcgcacttaatctgttgtcccgtctgcaaggcagattggcggacttacataatttgctgcatttgatcctccctttgttaattgttatatcatgtccccttgtaaccatctagttgcgtctcgatatccgtgcatcctgcgcgagtatcgacggacgccttcaaacttaaaatctgaaaaacttcttgggtaaaacttgggtttacaaaagacttggaaaacccgacacctgggtcggtgcttgcgaactaaatgaatttccaaaaccgcggaccggggaacgtaccgggtgtacggtttcccgctctcgcacttaaggaccatttccttggaatttcatccaaacataagacaagtacgaccacatgggtggaatgggacacccctggcggagtaactagcttaccaggggagccttgatgccgagagacatgtggattcgccgggctggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctaggtgatccgggttagtaatgtcgtgtgggtaaagtgtaccccctctgcagaggttaacaaactgttcgaacagccatgcccacggtcatgggcggatgtgaggtgattcctagtgtagttttctttgactaccgcttgtgaaattgctgttgtggaaaggggttcgatgtttgaaagattctgcagctgatgggatcagctaggcccgggtggccgtttgaaagttgttggcccgggtggccggttgaaaagctgttggccaggtgccaatcttgtgtcatttctaaagattgatacattgcacatactccgaccggacgagacgcactgtctcatccgtgtcgtttgagaagcactcacctagttgttttcagaaaggagttcaaataaaatcaattgcaaaaacaacagcccttcccttaaagcctgcattaaacacttatttcccatggcttgctgagtactcccgtactcacccttgctctatataaataatctcccccagttgctgaagaagatgaagcgaatcctgctgatgaggagttcttccaggagcaagccggctacgatgagttttagggtttcggcctagttcccaagtcacgcctgtattgtttgatccaagtcctggcttccattccccttttgtaatgcagttgtgagctcgggatctgtccgcagcccaacatgactgtacctctactctataataaagagacctctgttgctgtgataatctgtcttcctgtgataccagcactgtttcctgggactggtatcgattaacaggttaatttggagcgtcacgggctagttccagtcggtactagttcggggcgtgacaggacagtctggagtggagttatggtgctgtctaaatctagctccacaactctagttcattttgtgagagagcttcatccagctccactcccagttttggtggagctgaaactgtttggctgagctccagctccaggaggggtggagctggagctggagctgtaccaaacaggccctaagttaggtctggagtggagttgtggagctgcctaaacccagctccacaactctagttcattttgtgagagagctccacccagctccactcccagttttggtggagctgaaactgtttggctgagctccagctccaggaggggtggagctggagctggagttgtgccaaacaggcccaactcctagagctaaatttaggagttggagttgtatcaaacaggtccttagtatgaaaatctgtctttaatgacaacctgaagcatactttttctttctaacaaaatttcttcagatgctatttgtgccctgtagataattgggctacaatagactgtttgatgcaaaatgacacatcgaaacagtccgaaaacaagatactggtaacaaaggaagatatttttatcaaatttgacccaaaaaaaaatgtcaaatgtatcaacccccaatgttgatttgctaaaacctgaacatttttgctgtgactacaaatcctaaacaactactcaatcagtaggcaggatccacaattactctgtgggccgctggaagctacaagaactccaccattgccatctctcacgttggaaatcttagacgaacgcgtcgccatcatggcctgggaagaacagggagatttgcaataatgacactacaaacattgacatttgctatacacaaaccggctctcatccgccgagcacgacgccgcgaagtagcactgagccatgaggattctgctgcaggaacgtggttgcggcggcggtgtcgcgaacaagaatccgcccctgcggcgtcacccacgatttgctgctcgtcagggcggcaatgtcgcggccaccttcgatttccttctcatcggagatgctgaaaattctcggtttttatcttgctgcaagacgaggcaaggctgaagcggatccatcaaatcaaaattattgtctgaaaatgctcgagggtgaggtggaaatctctctctctctctctctctctctctctctctctctctctctctcttgtggcagatcaatggatggagaaattgaccttgttgaattctcgcatatatgcggaagcaaccagagtacaactcgttttcgagttcgtctccacgatcagcaacaagtaagagaacctattcaaatggatcaatccaatagccaatcaatcaaatcacttgtctgggcgctaattgcgaatttgtgattacaaattttggattcgaacccattttaccaaaagaaaaaaagaaacacatagattgtgattacaaattatcacactgaactcaacatgaagaacaaccaaattaaccacttcatgtacaccaccgcggcacgaacagtacagtatagcaagaaaaagaaatgagccgattcagcagcagcagcagccgaggctgatcagacgagattctcggggccgtccttcttcgccgtgaacggctccggcggcggcgctccgacgccgggcggcggcagcggcgtgccgtagacctgggcgccgacgccggtgcgcatctcctcgcggcccttgtgcttgccgaggaagtagcagccgaagccgagcaggatggagaagaagatgaagggcagcgagatcaccagcacgaaccccatctcctcctcctccttcttggctaccacctctcacaagctccttatggcgtcaatggcgtggcgaggtgagatccaagaaacagaagaagcttgcgaggcaggtggagagaagaagtatctgttctttgctttgcgttgctcttgccttgggagacgaagctggcaggggaaggagttggtgtataaataggggagaccagccatggatggaagctggtaatctgcggggtgcagcagaggttgaagaatcctatggaagaaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15070 - DNA, 8463 bp, Oryza sativa
catcccttaatatcttagtggcatttttatataaatgaatcagtgaaaagcgctgggtggtccttggccaaacagaagcaactgcttcactgattgctgtagattgatcgatcataactgtttttggttgcttgccactcattgcagatttgaaagtttcaaacaaccatttgaaggattcaactgattcatcataaaccaatgctgcaccaaatatgactggctgcttatgatggttaacaccaataaacaacaatagaggcctactatgatcacttgtgctatatcttgtgtcaacacacagtacatcaccaaagtagtggtaatccagaatcgacttaacatctgcccagaatacatttgtcaactggtcatcttcatccacttggatggcataaaagaaagaaggatgttcacctttcttcctctgcaaatattcataaattgcctgggtatcacctaattgcatatcttttgtgtgccttgtccttacataatttttataatcatttggtatcaaaacaactcttggtggatctggaggctgctgtaactttgctaataacttatgtgatctcagaacctggatgtccaccaaaggagtttcaagatcatgattatgatcagccacatactcagtcactacatatttgccactcacagtgattttaatagtcatgtgtgccagacaaccagttcttgtttctggccgtggcttcttgggatcagtactgacacttttagagcggaatccctctttagaacagacatatgcccgagattttgtagtatttgttgctgttttttccaaccatccttttcggacgctgaaccccacagttccagcataggtgacatagcagtcataggccttgtcttcattcaggaaaaccattccaacttttggttctcctccaggtccagcaactacttccatttctggatctggttctccttcaattatttcatcttctttactctcaccctggaccaaagaaaacaactgtatgtgttaaagcaatgaggaatcgaatataaagaagtggttcatttggaatttttttggggttcattaggaattaataatgtaaagtttaaagtataagccattgttcccttttgttacccaatcaaaaataagacggaggacacaaacaattagcttcaatgcagcattgcagagaaaaaacttttcaaataaacatacatcatttcacaagtgggtcttaccttatcttcttttttgagattttgcttttcaagacgtttagagcgcctttccgaaggttgctgcagtggttgccaattcatgaatataagaaaatacaacaagatggcataaatgaaatatctatgtggaaccaatatagaattaatgtatagtttgtgcagcagatgccaagaagtgtcacagaatacacagtttgttttgatattaaccccagagaagtgaacaattacattggtatgcaataaaagatttgtgtattgctaataattcctagttcagtaacaaacacaaactgtgcaaactacaaatgaagtgatagtgcattctttcaaaaaaaaaaaggaaatttatatgccagtttgcaagtgagtatatcaagtgcagtgagttgtaaactgagttgtgtgacctctaacttctgaggtactaactgctagataccagatgtgtactattttggctcttctcattggctaattaatcacgtactaaaatggaaaaaaaatacaaacagagcatcagcaatatccattagtaacatggaagggaagttaccgtcagtccttcgcttgacagaaatctacctccatcaccacgttttcgtctttcagccaaagcttgatgtgaggcgatctgaaaacgacaagcatatacttaccaagtgaaactagttaaccgatgtgcatgtaccaactactgttggtatatatccagacaattcaacacttgtagcacatgcttatgtgttgacatttctagcacaaatgtatatatcctcacatgcttttgttgaaatttgaaaaactatctgaaatccttaaatatgatcaaccttgcatgcatcacgtatgaaaatgtgtgtgcatgacctagcgacataaatatcttatattgcctgggcacaatggtcagcttccaatcactacaagaaaaatgacagcatatatttctatccaaagctatatattgttcctgatttccagttgtgggctacagcgctttgtcgctttcctatttggatcactatccagttgagcgactgctaatcattttgagacaacattgagttcaaaactcttgacatatatatatgctcatttgcataaataaagcatagctacctgtgcagcttctattaagtgtgtgactagtacaaaaaaataacttccttccctttctatgttaaaagacatgacgaccagtaaaatgtcacgtatcaagcttcttactttccatcttatcagtgttcagtggtgcctacatacattcaaatctaccccctcagtaatttatattcatctttgtcacagctaataactaactccaaatattttaccttggcaggccttgccgaaacaggtctgctctgtcgctttgagaggtacttactaactatcttcttcctctcctcattagtgtactgtgatgccctcaaaccgagttccctcagcacacgtgcctgcagggcattgccctcggcatctgctttcctcggccttcccctccctctcttttcctgcacttccacttgtacctcctcttccatttcctcctccccttcccctttctgctcctcaacatcatcaccatcttgcgccaccacctcgtcctccttttcggcctccaattcgacaacaggcttctcatccttctctgtaacatcctttttagtcctacccctcttagaacccctcatcttgcgcgcctcttgcccgttatttgggactgctgtcccgacacccttctccgcagagctctccacttcgatcacctctgagttatttttcacagggttgggattcctcttattattggcgcccctcttcctcttgcctgcagcaccatcctgcacctcctcctctttcaactcatccaaaccatttgccttgttcctccgattggcgtaatttcctctggagcagaggaacctctgcatgatcatgacgccattaccaaccgatcggcgattggagcccgtgcgcgccttgaaccccaccctctcgccgtatccgtagtagaaccccttggcggcgtgcacggattcgaactccatccccatcaccggcaccgccgcggccacctccccctccccctccccgcacggcgccacctccacctcgtggttgtgctccaccaccagcttcgacaccctccacttccccccgaccgcgtccttcttcaccacctccatcatcgccctgcacctctcctccacccccacccccacccccacccccgccgccgacgaaggcgctgcctcctcctcctcctcctcctcatcagcatcagcagcgtccccgccctgacggagcgaggggtccgcgtccgcggcggcggaggcggcggcgtggtcagccatgagcggggggggcgaggcgaggctagggttgggggggatttgaaatggcgcggggatttgggcggcaagcgggcggcgcggggggattatatagtgatcggagatgggaggggagatcgggtgtggggaggaggcgtcttgccttggctgcggcggccggcgagaggaggcgagagagtgtggggggagctgggtgtggatgcggggcgagaggggatccgagggagaccgagaggcatctactactccgagatgcgggtacacgggctctgtgactgacagtggtggcccacaggggggtatggcccgcgtggcagtgggggtggacttgccggtgagtgtgacgttttagataggcggcggtggggctcgtggcggcgaccggaggtgggcgacagtgtggtgccagtgggggcgcgacgcgtgtcccgaggcatagtggtgtgggtttaaaaggattaggatgccggatttgtgcgggtcccaagcgtcagtgggttggggctagtgatactgtggtacaagtggacaactggatggcaattgtccgatcaaggtttatactcatgcttatcggctaaaatttgaatttttaatcttaaattttgaattgtttcaaggtttttttcattaatttttattttttatcttttacttttatatcgctaagaacacatatataaaagttttattcacaaattattttttttacaaatatgtttcgcttattcgaaatgatggctagcctagctgggctaaatataatttcgtttatttaccggatataatttcgtttatttacaaatataattatatcaggcctttagctgcctagctgggccgtcagagaattttaacgaggaaaaggtccactttgactccctttaaaataggccgaatctaattcgtacccctccaccgaaaatcagataagacaacttccctaactattgaaaccagtgcaatttgactccctcagcggttttgaagagtggttttgctgacgtggcgctgatgtgacggtgctaacctggtcttcatcccatgtggcgcctatgtggcattaaaattaaaaattatatgagggacccacttgtcattaaaataaaaaaatattgtggagcccacctatcatcctttctctctccaacccttcttcctcctccctctctctctcccccttgtctctctcttttctttcctcttccgtggtggcggcggcaggcggcgctacccttgcagagacagcgggaaatggctcccactaccgggggcggaggcggctgggcgttcggggacatcagtaccgtccgattttcttgacccactgccatccctagttgtcgtcgcgtgcttgacgtggacggtggcgacggtggacttgatggcgatggtggtcgcggcagcggcggtcgtaggtggtgacgatgaggcgtggcgcgcagtgatgcttcccgtcactagctgtgcaccctcgatcggttagggttttgtgggtggagttggcggtggtagcgaacctcgtgccgtgtgccgccccggcctccaccctctatttatgtggcgcagggtgacaaggcccaccagccattgggctgggcgcccccgatcagggcgcaggtcaagatccccgttgtgccgttgggcccaacggggaggggatctatctaacatgaagtagcccgtcctgaaggcctgggtgaggtcggaggcggtggagacggtcgccatgatgacgccgtaggcggcgagcccagtgaccacgccgccgtccttgagccccacccacgcgccgaatgcgaggaccaccaccttgccgaaggtggtcgcaatgttcatgtcgatgacgccggtgacgtacgtgttgcagaaggcgagcaccagcgcgacgaggcaggcgacggcgacgtggtggtactttcagctcggtgtagaggcgcagtacaacaatggtggacatgaccgacaggaccacatacccggcgacggcggccacgctgggcatccggtcacggacgaacacttgcttctgccgccggtcgtcgaagctctccgccgaaaaatcggacggcactgacgtccccgaacgcctagccgcctccgcccccggcagtggaagccatttcccctctctctgcaagggtagcgccatccgccgccaccacggaagaggaaagaaaagagctacaaggaagagagagggaggaggaagaagggttggagagtgaaaggatgataggtgggctccacaatatctttttttatttgaatgacaagtgggtccctcatatattttttaattttaatgccacataggcactacatgggatgaagatcaggtcagcaccaccacatcagcaccacatcagcaaaaccacccttcaaaaccattaagggagttaaattgcactagtttcaatagttggggagttgtcttatctggtttttcaattgagggtacgaattagatacggcctatttttaaggaagttaaagtggactttttccttctaatgaaccggtgattaggccggccgtcttggctgaatcagctggcatccgtccatggcccatctgcaaatggcccaatacaagctaaaatagaggggcccgcctacaaatttaacatatgccctctaaaaaaacaatttaacatgcgtaatttctgcatctcaatagacaattgaacatttgggatttcatttctgtttcattagtctttccctgaccattccgtgtaagctgcagtgtctgaactctgaaacacttccataatcttcccatcccaggcttgcacagaagatttcaaccggaaaacacactgaacttgcagtgctgatcattctccgaaaacgcagcggttcagttcagatgttacaaaaaaacccacttgtttccagtaggcttagccaaatcatcatgccgaggcaatcgaacagcactaatctactagagacgagacgaaacaaaaaataaagcaccagaatattttatctcaaaagagcattcaacttgccatattgcatattcgggttgctgtctgaaccatccctgtcatcgtctgccgcccagcccgccccgttacatacgttgtagaaaaacgaaggaaaaattctggtaaaatcgacggaaaactaacggaaacatcaccacactgcatgaccaagaggcttcgtttgtttgaaacaaaatcatcaatttaaatcagcctttcacacagcaagtgcatggctgatcgcattctttaaccccttttccctgcttcatcctcaccttggttatcttgagaggcacgaaagcatcgaaaatacgcaaatattgtgtacgtacgtctcgatcaaccaggatgaagcttccaagtaatacctggctaaccagcgcataaatatgccgatctcgcgaggccgctgcatgcaaacctgcaacacacaagaacaggactgagttgctgatcatgcgcttctcccgtctcgttttttttttattgtttggtgagacgagggattagcgacggtttcgatcgttttgttttgttttgttttgttctacagtgagccaagtacaggtcgatccgttggtgttgggtttaggccctgtttctttcagcttgggattattataatctagattatttggactaaactgaaagaaacagacaacttattgaagtagcttattataatttggagcccagcttattataatctgataagctcatttaggtgagctttttccagattattgggtgaaaaattatccaccatgccaccccactctctctttagacttgcaaacccaataatctaggctctaataatctagaaaagaaacaactaaccgcttattctactacagattataacaatctagtttatagtaatctgactcaataatttagattataataatcccaagctgaaagaaacatggccttaatataattaagcggcttattcgtagcacttctgccgttaatttgctagtggtgatattgccgcatgcttcatcaatttaccagtgaatcatcagctctgcgcttttcagcttcttaggtcccggccgtttgaactagggcggctgatggattatggctgaaattgatttcgtgatcattatttgagggaaaaagtatgaattacccccctaactatcgcggtcgtccgaaattcccccctgaaccacaaaaccggacatttttcacccccaactatacaaaccggacgaattacccccctcgacctaaatccgcggtggttttggtctacgtggcgtacgcgtggcagtccagtcagcattctatttattaaaaaaatgtgggacccacctgtcattctcctcccactcttcctctctcctctccctcactcttcctctctctcttctctcactctctgtctcactcaacctctctctcacgcccacggcgagtagggcggaggggcggcggcagcggtgagcgcggcggcgagtgaggaagggtggagggacggcggcggcggcgaagtgagcgcggcggcggaggaggcgaggcggcggcggcgaggcgagcgtggcggcggaggaggcgaggcggcggcgaggcagggcggcggcgagtgaggaagggcggagggacggcggcggcggcgaagcgagcgtggcggcggacgaggcgaggcggtggcaaggcagggcggcggtggcgaggcgagcgcggcggcgaacgaggcgaggtggcggcgaggcagggcggaggcagggcggcggcggggcggaggaggcgaggtggcggcgaggcagggcgaaggggcatcggcagcgaggcagggcggaagggcggcagcggcggcaaagcgagcgcggcggcggaggtccacgccggcgacgggatgag

SEQ ID NO: 15071 - DNA, 6276 bp, Oryza sativa
catcaccagcttgctcatctaggcgccgtggaactccttgccgccgctcgtcttcgcgaagactccggcctccccgtccttcttgacgacgccgacgacctccgcgccgccgctgctgctgccctgcctcgcgatcgcctcgccgtcgcactcgccgccgccgccgcccctccgctctgcctcgccgccgctgcccctccgccctgctcaccgtgcgcgtgagagaagagagagagaggaagagtagtgagagagagaagagagagaggggaagagtgggaggagtatgacaggttggtcccacatttttttaataaatagaatgctgactgaactgccacgtgtgcgccacgtagaccaaaaccaccgcggattggatcgaggggggtaattcgtccggtttgtaaagttgggggtgaagaatgtccggttttatggttcagggggtaattcagacgaccgcgatagtttggggggtaatttgtactttttccttatttgagggcacaaattaaatgaacaaattgaatatcaggaagttgaaaattttgttttaaaactaacgttttatatgaaatgccaatgaagaaagttctcgaataaaccataccatttagctttttaattaggaagtattcccgcgataataatccataatccacctacagttccaaacgggattagtgagtacgatcacaaaatgtacgatgatttgaacaataatacctatggagaactgactgaactgtgatgatacataattatgcttgcattactgctaccaatcagtactatatcgataatagtggcagccctataaaaaaagctacttccctaatcataaatagttgacgtttcgaataagttttggtcaaatttcaaccatcattaacacctcaaattcttgttttttttaaaaaagactacatgtgtagatttattttcaaaagcactatcataatattttaaaccaattagattttataaaccatttctcaaataaaactgattgttatttgatttgaaaagcactaccataatatcataagcttattaaattttataaaccatttcttatataaaattgattgttatagttttaagggtttgaccaaatctcttattctaaaaatcaaatacttataatcaggaggatacaaatttcttgagataacgtcgatcaagagggagaaaggagttatatatgaagtataattctataattctataagtttcaaaaaaaaatctataattctatatttccagtgatcgatgtatcttaacctttttctgtatactcgtgtgtttcaaagacgtgcattgatttcaggaagcgtttctgtgtttagtttgacagcgcaaacaaaatcatccatcctacaaatctgaacattaagaagcattagaaagtacgtgaacatacatgagtaccgaaagttgtgtgatgagagcatttgatgtcaacgtatttttaccgggccagcccaaggagaccgaccaatttcattaagctacaaatacatcgataataagatgtcgaaaaacagggtcccaaaagtaccaacagcacctcccgcaagtaaggccctatttaggttctaaacaaaaaaaattttcatcatgtcacatcaaatgtttagacacatgtacggagtataaaatatagataaaaaactaattaaacatattgcatgtaaattacgagacaaatcttttaaggctaattgagccataatttaacaatgtggtactacagtaaacatttgctaatgacggattaattaggtttaataatttcgtctcgcagttttcagatggaatctgtaatttgttttattattagtctacgtttaatacttcaaatgtgtgtccgtatatctgatgtgacacgccgaaaattttcatccgcgaattaaacaggtcctgagaactaacaggaactgctccaagtcgatatcattcttaaggactcacattcttaaacattctaactttttttttctaaatggtaagtaactactgaataccaacaatgcgttatattttagggtagtgatagtagaaataaagtatcactcttcctgttttatattataagcagctttgatttttaaagttaaacttatatgattttgatcaaatttatagagaaaatatagcaactctcttataatacgaagttagtttcattaaacctaatattgaatatatttttacatcgtgtttgttttttgaaaatgttggtatgtttttatataaatttagtcaaacttaaaaaatcaacttaagaaaagttaaaacgatttactccctccgtcccaaaatataagcatttatagcatacaagtcaaacatttttaactttgaccattaatagcaaacaaatgaaaaaatcaataatgcaaaattaatgttgctatatttatcattaaacaaactatcataatatgcaactctttttttatttaaaacatcttactttagtaggtattattggtcaaaataacatatcggagacagtgtcagggtctaaaaatatctttattttaggacggagggagtagtttattactcctacctatatctctcaggctgtgatccaaacttcagtccttttacatcacatcaaactgtcatacatacacaacttttcagtcacatcatctctaattttaactaaaatctaaactttacgctgaactaaacacagcctcaatgtgtaatgtttagttaatttgaactaaccaatgttaaataaaaaaacagagaaagtactaaactaacatagatgtcaacgtcgaggccgacgtggtcgtggatacccgagctatagctcccaatctcccatgcaccacccggcccacgggccaatccaaaatttccaccacgccgcgttggtgcacaacgcggtagccggtagggggcgctgcttccgccccggttgagcgccaccgagagagagccaggcacacgaaagtttcgtctccaacacgacaacccccacatttttcctcttccctccacttcgcccaatcccctcataaaagcgtgtgcagtccatcccactcagaatccatcgcccaccccgccattcgctgctgctgctgctgctgctaccaactactaccaccacaccacctccgcttcgcttcttccccaccctcccaaaacctccccaaaatccgcgcgcgatgtcacggaagcgcgagcgcccgctcgaggtcgtcgcgccgccggcgaccccgctctccccgagcaagcggctgcggcgggcggggctcgtcgttatgtggctgtgagttcccgctctcgtccctccccccgcttctggttccttccccctcccccttggaatagcgactcaccagtgccggttgcgtttggttcgcgtgggatctgtgctcttgcaggcgcaggaagccgaagccggtcggcgtggagcagatggcggcgcgcctgattcggcaggtgggttgtggtctctgcatttgggatcgtctcccaattagttttctgggtgatggttcatgttagttgattcagtttttttttctttggggggtgaagttggttttgatttaattaatttctactacttcattcgtgcaatagatgcaagtgcagatggtcaaattgtttatgcttctcatgtttctcgtcgcgcgccttggcaacgtggagaggctgcttctcgagcaaccgtatctgatccgaaggttgcttgaggagcactttggtatttttcagaggtttgcttctgtttactcgagtggaacacatacattttttttacaagcatgaaattcgagattcattgtcgggtttagatgttaccagtgaacgctgccagctcgttgtcgacaatgcatcggtaatcattatgggggcgtgacttgggggaagtggaggaggttggattgggggtatagtatagggtctcaacacgctcacaatttcttctatttatttgagaaccaagttcctccttggttgccatcattttattggatgtgtgttgggggtagtagagagaatttaggggtttttatttttgaatgatccaaaaagtgcgtgacacttttttttttggaaaaaagctatatgcttgaatctgatagcgggatggtctgtttaaatttggttggtttacctgcaaatcctagaaaagtactggaataagtggaattcctcctctgtagaaaccaactggagaaacttgcttattaattgcataattgcagtaataactgtcagaaatgaaaggcaaaacattacaaagctccactaactacttcccgagaattatctgaaacagttcttgaccatttttttcttggcacttatgattttgaacatcatagtcctgttttaatttcagattaccaggttacctacataccatctagcaaataaaccaggatagaacttctgtttttccccaagtaacagaaacaccaccaaaatatggataaagcgttgttctcttgaaattctttctttgtatctgatctcaaactttgaatgttacggatgtgatagataaatgctaccatcattaatttggtctcttattgtttcttatccaaaagatctttgatggaatccatacaagatacggttcgcaaggctgtccactcagaggccagtattttggaccttattcacgtaaaatgtgtgatctatctatacatatgctttgtcttaactccttttgatatgtcatacaacagatgaaggaaagacagacaacattactttctggaggtgcttatcagcatccaaggtatctgccatttttgtatcttctcctaaaatgttgaaaactagatgggcatttaaattcctctattaaggcactttaaaagtttcttgatccatgtcatgatcctaaaaaccaagaaaatgaagtcgtgttatgcattctaacatttctttggtgcacaaatgaacctgagtgcactgcaagttctacctatgaactgcaaacatgtccaaaaggaacataataaccaaaaggaacataggaaccaaaaccgtgcgaggagccctaccaaactggccctaaagatacataggaagaatgcttaagaatgtgctctgttgttgcgatggagtgaaagtgtactatgatatgtattccatgtacatgtattaatctctcattgtatctcaaattgtagaccaaatatatcagaaggttttccacaaactggagggagcactagaatggttaagttattttttgttgatgttgagagaccagaagacccacttttcacaggttctccagtacaatggcaaaatggagccaacgctaaagttgcaatatttgaaaatgggagtcaaatcacacagggtggtctttctaaactacaaatcgagattttaccagtccatgatgatttcttcactgagcgaggaccagcaaatttcaccaaagaggaattcaacaagcagatatacatgtgcaaagggaaagagtcagtattgaaaactgtcaatttaacaaatggtgaggccaatcttggttccttcttctttacagagagttcccatgggaaaaggttaagattggcagcaagagtaaaatatcaggatcttgcagtcagggttcaggaagcaaccagctattcttttgttgtcaaagaccgtcgtagtaaatgtgagtatccacctgttcattttaacatcagaacccttttgaccatacatgattggaaactccaatacacgatgtatgtttctcacaaaatgcagcattttctatgcctaatcatctgaagaacatgatactcgcacaagtggctaccaagataatatagacaaaatatttataatgaacatattatatatatttcattagctattctggtctcgtacatgcaatggcacttttctagtgaaacgaagtttgccacttgtcttgcacttttagaagggaacacctccaggtctgagttctgaaataaacagtatgcaatcctagtcctttgacgtctgttatacttttgttgatcattggggattttcttatgacttacaatgtcttgcgcaatggaaaaaggttcagatcgctgtaattttgtacaatagacggtaaattaacagtacgcacagcaagttgtttcactttgccaggtacacatgtggtaaatacccctagaactaattgcaaagatggacaaactgaaccaattgcatactagcaaccagcaataattgtgtacatacatcttgtcttgacacagccaaccttattgcctactttcagtaaat

SEQ ID NO: 15072 - DNA, 1095 bp, Oryza sativa
accccagagtccgcacatcctcaaatacaaagcacttccctagttagatgtaggttagacttcccgttcgagaaactctaccttctatctgccctcaatttatgcacgattaatgaatgccacctgggtggaagcgagaggtggaaatggaaggtcttagttcggagggggatctctacctgatagttgcattgccattcatgatgatcccctggcattcgtccattcagccattcaccattcacccattcaactggaattttggttgaatgccggaattgtgtccacaaattgtggatggatagttggttggctagctggatggctggctggatggctggctggatggatggtgaatggctggcggccgatctgttgcttcgaagcatttgttgctatctaaattccatttaaggtcgtaccttatcgcccagcatcattttagtctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagcccaccttgcgggcactctcagtgtctatcagaatgccacgggcaagatctgcggtgtctggcgacgagttccacgtgattacaagcgcatcaagcgcgacgatcgtctccatgttgtcctcctctggggcaacaaacagcaggccgagttggctctggccggaaag

SEQ ID NO: 15073 - DNA, 6609 bp, Oryza sativa
agtacatgggaattctgagctgatcatcatagaaagtatggcaaattccatcaaccagaacgcctgtgcgtggtagatcttttttgaaggctgtgtattaattttatgattttctttatcatagactgggaaacaatcaacttaacagagaattaggagtcaactcacaactggaaccccccgtccccagagatggcatgcttggaccattgtgttccaactggcgttacagtttttggatagagatcgatgcaattcttcagatttcgcttagcctgcaagcacaggaccgtgaggcgaaagcataagtggcactttaattttttgaggtaaaagtggcacttcaattatcaatagaaatgtacctcaactagcttagagaataaaaaaacttgaaatccatttgcattgaattacagttattaatgttttagcgttgttaacaaaccatttgcattgaatttagaaaaaaaaatggaatatacgaggagaaccaaacaagcaaaccgttttttttaaaagcctcttaaaatctataaatattcatgtattattaagccaaactttgagtaatctttttaggtgggttgcagctagaacttcacccatagggaggcttaaaagccaccaatttataaatcgtacaaaaataagaaatttggcttaaaagttaatttatgtcaaaaagttgggccataataaagcgacattacatatcacctagaacccattatatctcgtctacttattatacttatatataaagaatccaccgtgagctaacttctctctaacaaatttcagtagtgcagatctcttgcccaaactgatagttacaattacgggctcagaccagccatgcttgaacgatgaggaagattagttcgatactaagaaaggtagtacatacatcaagtgatggtctcggaatgagaggtgtcgagaaagtatgttgaactagaggtctgcatctctgatccgatcggcctccccggagccgacgagcgcgccgccaacgccgatccgaagccgacggccgcgccagtttgaggaacctgtgactggggctaaggatctggactgtctgaacataaattttgttgagaacctgaacatgttatccagcacaaggtttctaatgatcaacagtcatgttacatacctaagcctgcgaaggcctatgcatatgcgtcttcttacagtttgagctgtaaactggtatctgtgcttaaagttttgtcactttcactgcaggaactttgattactctgaagagtcgatgaaccaacatgtactccctccgtcctaaaaaaacaaactctggtttccgtgtctaacgtttgaccgtccgtcttatttgaaaaaattatgaaaaaaattaaaaagacaagtgacgcataaaatattaatcatgttttatcatctaacaacaatgaaaatacaaattataaaaaaatttcatataagacggacaatcaaaattgaacacggaaactcagagttttttttttttgggacgaagggagtatattatagtttatttttttatacaaaatgctgaatcacaatgtatagttgacgccagcccgagtaaacagtcgtggttcaatcctttgcagttcatgggggatcaaaggcgattcatgggggagtcgatcatccgctactctacaaattcgtgaaccccgttaaaatggccaaaatcattcagaaattcagccttgtctttctcgttgaacccatcgcagtacggacccaaaattagttgctctgcttccgaagtaatctcactgttgagactataaatatactctgcattgttcttgaacatctcgaaccagcgagtcatctcagcatggtcacgctctttctcgtaagcctcgcaccagcgctcgtacaaggcccatatggcttcgtccgactctaagtcttttcccgagatatccttacctggctcaggatcatctatatcacaaaatacaacaacattgatacagtcaaacaacagcgaaattggaggcttgtaagttgcaatttggttggttgcgagcacaaagaaacgaaaaattcagatctactgtttagccttcggcttataaacacaattggacacgtgaattttgaagtttttcttcttaatttacttttcgtaatacacatataaaagttttacctacaaattatttttaatcactattgaaccaagattcaagacttcaagtactccttgcgaattgcaaactctccagaagggtatgggcagcagtgcaacattgggatagcatagaccttggatgctacacacgccgcgtaaccccataagatctctaaaatccctaataatcctaatagcctgagaactttggtgtgagagaaatgctaggatttttcgccgtatcgccgccactccagccaccatcgtcgcaaaaatcaagaaagagaccatgacctaggccaaggcgggagcctcaaagtttgctgagttaactcttttggaagagtccccgtaatttctttgttcgggctcccgtttctattgacatagccttataaatagacctttgttatggttgttttcttctaccctattaatatatgcgaggtaaagcttttgcctttttttcaaaaaaaaaaagaaaaaaaaaaagagattcaagcactaccagaaaagagagactgagtgaggggattggtttacatgatggcaatgggcgggtagcatggtcgtcgtcatcatcgtcgtcgacgaggtaatatgggacgcatgaggctacgcgggcggcgcgagacgccgcggcgcggcgagacgcgagcgcggcggctgccaggcgtgcgggacgacgacgacgagacggggcggccgcctaggagcgcgcggcacgagatacggcggccgcggctacgcgggcggcgtcgcgcgcggccgccgcgtcgcgtacgagccgcgccagcatcgacgacgccctaggtggcattgcgtatcaacgaggagggttttggtttgtctcgtcggcactcgatagaacccgtgccctggctgactgcgccgattggacgtggatcaggtgatcgtgtggctcatttccgttaggcctcgttttcaagcccatattggattggcgcatatttggagcccaaacttcgccaccgatggaatcaaggcccagctcttctctctcgggccgaataaagatgcatttggcacagaattgctaattagcacgtacgtgccatgtacttaactcgcgcgcatttttggcccataactctgcatgcggcccacgccctcatgcgcagcccattaatcttcgtcgcgcgtggcaaccgtcgttcctcttctttttttggtcgcgaagacgctgcatgtgcacaggaatcatgagaaaaaacagtgattagctgcgctttacgtgattagatctaataatcacggtcaatcaagatatatttctttttttcacacaacattattttccttttttacttaaagattcaaaacctatcaacttgaattttaaaaactttcaactacaaatttaaatttttaattcaatttgaaaacattcaagtcagattttgaaaaattttaactcaatttttaaaactttcaactcgaaatttgaattttttttgaagtcaaattttgaaaactttcaactttcatctcaaatttgaaaaacttttaacccagatttgaaaactttcaaattaaatttaaaaactttcaactcaaattagaaaactttcaacataaaattagaaaactttcaagtaaagatttaataacttttaattcaaaaataaaaactttcaattctacattcgtaaagaggtgtgcgaaagattgaaaaaaatcggaaagaaacaggaaaaaaaacatgctcagaggcgatcggaaaaagtgcgaataggaaaataaaaaaaaaaaggcacgggaggcggccgagctgacgcgcgccagctaaattgctgacgcgtacgcgcccattagcgccccccccccccccccatttggcaggccgtgtattgacgtccatcgcggcccaaaccccgtcgaccccggcactcaaacccagcattccaataactgccttctcaaaaacataaaaaaaagaaagaaaagaaaattccaacaactgtttccggtgcaacttcttcttctcctcctcctcctcctcctctactacgttctctaatctctaaggtttggaattcagcttcctcctctcataaatcatgtagggcctattcgttttgaagaaattttaacacagaaattacgaatagaaatggtgaaagaatatgaatgtatgcatatttcaagaggtttgagtgaatggaaaatttcctatgttttctctctacacattgtagaaaaggaatttgttttatttttctgtatctacatttaatgaattgaatggcttttatagaaattaattcttaggaaaccaaatcgtttgaaattcatccaaaacgaatatgaccgtacatctttcatcttggtgacatgttcggatatggacggttcataccggacctgctcatcgcagccaaagcttaggatgcgataagaggaggacaattgtagaatataataaagttaatggtaacaaaagagattaagagtggatcaaatgctaccaaattaacccaaaagatatataggatatgcatgctaccaatttgagacgttgagagaaaaaaaggacaatattaatgtcgtggagagatatactaggatatataacagttaaatgcattctaaatgatattaggaatggatcatccaatttctctatataaacacctaggagaggatcaccaaacatagggaactaaggataggctagctaccaccactcattagaaagctaattccctctaaatctgaatatggctcttcttggcaagactagttgcaaggctgccgtgttcttggcagctctagtggtcatggctactgctttttcatcctctcatgctgcccaaggacaaggtaacgataatacaattttcgttctgcaatcaacaaattaactataaatgatttactcgcagacaacaaataaatgatttaaataaatgattttgatcatgaatttattttgtctgcgatgagcatataattcgtttttggtctactatgctttaatttattttgatcatgaattatatattcttacggtttactatttgttctgcaatcaccgagtactattaattatgagcaattttaccatccaccatttgatatctcgagatatcacaaatttttattatctcaagatactttctaatataaaaattagtacctcgagataccattatgtggtaccttgaggtatcaaatgttgaatggtaaaattgctcattaattatatgttctgcgagtatatctttttaattactattgatatttatgcacgaatcaaacatattcatggcctaactactagctgcacattgcaattttttgtttaggcaatgtaggcgaagagaaaatggcgtgtaagccgctacaaggatgcaacacagaaatgtgcatgggctactgccaaatgctcagctaccaaggaggcacctgcatacacaacgatcctgatatgtgctgctgcccgtactaaggtctcgtgtccaatcacacggattaattgttagatttaattgggtaattaatccatttaaattaattaaatcaaataaattccaaggctcattatgctaggaattcatgtgaattcattcttctatgggatatcaatggaatgaagagttttgagaattaatccatttgattaaggaattggtaacttatatcaattagtcctaattgatggatggttgatggttgtgtagtggaggatggttcatggctagttgatgacaattagttgctatattcctcttcctattccattggtaactttcatcaattactcttaattgattgttggttgatggttgtgtagtgaaggatggttcatggctagttgatgacaattagttgctccattcctcttcctattccatgactcttactcttcatcttccattcctcttataaaatgggaatggatttgatctcccgcgagaagaagaagacacacttttatccattttcaaaagctgttgctgctacggtaatcccatcccgacgaatgtgtgcacacgcgttgggagagtaggcctccgaaaccacgcgttgctgcgacgtttgcacagacggccgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacattaagcatgctcatgttgattacattcaccactatcactggatcaaatcctattgtaaatatcatgattattatcttgttattttggattaaaatatgccgaattatgacca

SEQ ID NO: 15074 - DNA, 6780 bp, Oryza sativa
ccaagacaagatccatctccctcatctaccagaaggcttgtctaccagatgctcgtgccagctttccggcaagccttctctccccggctgcatcgtcctcgtcgtcgagcccatcgccaccgtcatatggtactgtcgcatcggcgatgacgagtggacgagacacgagtacgacattggaacgttgcccttcgatccacccatcgatggaaaggaccacgatgatgtggcgatatgccagattgccgcttgccatggcaagttctacttcaacggtttcttcgacaccatcggagtgctggagttcaccccaacaccggtgttcagctcgattgagatcgtcgacccgaccccgggaggattaggggtgacgggcgcggcgcacgtctatcttgtagagtccgaggacgaactatacatggtgtgcttgcggattgactatgagtttaccatctacgatatgacagtccacaagatggatttcttgagccgtcaatggcgcagagccgatgagattgggggtcgcgcattctttctagctccgttctattttggcgcttcatgttcggctgatgagtacgggcttgagaaggattctgtgtatgcctcgtatgcactggataaatgttttgaggtatccaaggtggaagatgatgaaaccgaggtgcatgagctcatcgatgctccagactcgagaagagggatgtggattttgcccgttgaaaaaaaaatagagatgttaatgtttggatacagtcggaaaactatataatctctatgaaatcgatgttgatagaaattgaaaaattcaaaatttatatatggctagaattggaagcggcatcacttgtacaaaacatacttggttggaaatttccgccaccgttttgaaccctagttgaaaggttgtaaagaagaatcattttccgaatgtaactgatttattatttgtttttgcagtgcttgatgcctgcactatatatgaaaataatatttcttttctttttggggtactttctactgagagcataaatattccgttggaaagaaagggttatgtacagagagaacacacaagaaaatgatgacctttatttttcgattattaaattgataaccaccttggcaccactcatctcggttttaatggtttattagcattatttagctcatattcgtaagttgtctgtcgaaaacaaccaagtagtggattcactggaaacaaaatactgtacctagctgaatttttttttcagtgtagctgtaaaattccaggttaacagtcatgtgttttttgttcctgttttcaacctgaaaccgaaagattagagcattgtgcgtacatgatgagaaagctgcaactacatgtgcaggctggaaattttcattcaaattgttagttgttggttcccatttcccccatgaatagttggaggcttggagcattttagatgttcctacctgatgagcgaaatctagcatgagcacgttttactcctgtccaggagccgttcggaatccggttatactccggacggctgcttgattccgattcggctgcaagttccctgcccagatgaagtataagaacacgatatttgggatggatcctctccctgtgccctgtctcgccttgcagcagcagcagcagcacggcctggaatcagtaaagacgacactgttcaacatcttcgagggacaggacatcgcctgcgacatcgatgccctgacgaacaacaacagcatccctgtttcttgtctcttttacctcaccacgaaaattggccttttgcctccaattccgattacttcagatgtctgatctctgatgagggatcgccggccgtgactgactctgagtcggaatcaaccctgcttaggtagcagcttcgcccatataagaggagcacagagcacgatttgcagatccaactaagaagagaggaatacaaggttgacaacaccacgccggccatggacaagccgagcggccgcgtctccgtgccttgcctctccatggagcaacacgacgagtctgctgcagataagccggcgctgttcagcatctcagacaagaaggccatcgacggtgacatccctgggctgaccaacaccaacgcctggttcaccccgcaggggtggatcctactacgccagagcaccgccaccttcctgcagaaccctcaggatccccaagacaagatccatctcccagaaggtctgtcaaccagatgctcctgccagctctccggcaagccatctctccctggctgcatcgtcctcctcgttgagcccgtcgccaccaacatatggtactgtcgcatcggcgacgatgaagagtggacgagacacgacgacgacattggaacccagccattggatccacccatggatggcaaggaccacgagaaggtgccgatatgcgagatcgccgcttgccggggcaagttctacttcaactgcttcttcgagagcatcggagtactggagtttacccccacgccggtgttcagcaccattgagatcgtcgatcctatccccggaggattaggggtgataggcgcggcggtcgtgttcttggtagaatccgaggacgaattgtacatgatctgtctgcggcttgaccacgacttcgccatatacgatatgaccgttcataggatggatttcttgagcttgcaatggcgcagagcctatgaggccgtgcgttttttctagctccgttatacttcggcgcttcatgctcggctgatgagtatgggcttgagaaagattctgtgtatgtctcgtatgcactagataaatgttttgaggtatccaaggtggaggatgatgcaactgaggtgcatgagctcatcgatgctccagactcaagaagagggatgtggattttgcctgttgaaaataagtagaaatgaaaatattcggaaactgcctgaaatgatatcatctctgtggaaacgggttgacacagaaagcagaaaaaattatataagactagaattggaaatggctgtcacttctagaaaatttatttggttggtccaaagtttctgtcatcattttcaagcctagttgaaagaatgtaaaggatttttttctcctaatgcaactttagtttattatttgtttctgcttgatgagtgcattatctatgaaattagagtatttttacggtccaacagcctgggtaggtaccaaatctacaccattcatttaacttgatcggatggctgagacagattcagtaccgggcagtaccaccgatcgattccatgcagtaccaccgcctgaagggcattttcgtaatttcgcgtagcctcagttcagatcagatcggctcagccagccgcctgcccgttctccatcccaggttctgagcttttttgcagcggcatcaacggcgtcagcccacaggatttgggccgacgacgagctacaggatttgggtcggtggtaggctgcgggatccgggtcaacggagtgcacgaagccgacggcggcggcgatgggctgcaggatgcgaagcggcagcgggctgcaggatccgttcgagggtgtgcgcgaggccggcgtcgatggcggatgggggaacctagctggcgtcgacgggctggcagggatctggccgccggcctctgtggtgcgcggcggccggcggggccggcgtcgagggcgacggcggcctgaatgttaagtcgacctgacaatgtttccaatcatgcccacggtaattgaacggttggatttcatttggtacctgatgtaccatctgctggaccgtaacaaatctcatgaaattaacatttttatatttttttccatcgtactatctattgaaagcatgagaagatatttcgttaaaagaggggactatgtacagagagaacacacggaaaattgatgacctttattttggtttattaaaaactgagtagtgaaccttggcgccactcatctcaattgtagtaatgacttagcattatttagttcatattcctaagatgcatgtctatcgaaaacatccaagtagtggattcaggggaaagaaaatactgcacgtagctgaatactcgtttttttatgtcacccaaataaccataattttttttaaaaaaattaacaaaatagattaatatgaggcacattgtccacaagcatataaggtcaaattcgacatttacaggttgtgataaaaataacaaattaaatatatacattcagtcatatttgttactttaacttgtatatttgtgctgtaaaatatcttatattaaactatcttgttaattggtttttaatattttagtgcacatgcaagaaataagttgatgtcccattaagggattaaaacacttttcttggataatgtcacactgcatgtgcccagttacatgtgaggatgaaattctctccctagttccaaatgaaagtaacacacttggtaaatatatttgaacttgtagaagagggataggctgtgaaattacaggtaaacagttatgtatgttaatttgttcttgtttccaccctgaagccgaaagattagagcattagctgtcctacttgatgggagagctgcaacctacttgttgatgatcagcaccgagaggtgaggacatcagaacaagtcgcttcagaattcagaattcagaattggacttggaaaagaagagaacgcaagaacctgatagtagcagcgcattgcaaccagaacttctgaagagtgaacaccagttatctgaattttaatggtttataaattacttatcacaaaacataaattacttatttgtctcaaagatgtctaatgcaccaaatattttaaatactgaaactctgtaaagttatcagtcaaaaaaaaaaaacctctgaaaaggggcagttctttggagggattggagatttaggagaaactcacacccgtcgctattactgtgattatctgtaaaactatattaaccatacttttagagactttcctctcttgcgatcacaatcaaaatcagaaaaggaacagaagacatcaaatccgtttccttgttaccaaaaactgaaccacatgaccgctgctataggaaggcgatcgatcttcttgtgactagttgtgagttgtgaaccgactctgaagccgactcgtctcgtcgtctgcaacacggcactgaatcggagtcttcgcctagagtatgtatgtaagagagccaaaagcgttgctacctgcagagatccaacgccgcatactcacatcgatcaccatgatggacaagacgagacatgtccctgtgccttgcaacgccctgaagcacggcgccgattcagacaagccggcgctattcagcatctcggagaaaaaggccatcgatgcctacatacccgggatgacgaacagcaacgcctggccgacgcagcagggatggatcctgatccgcgacgacgccaccatgtttctgcagaacccacaggatcctgacgaaaagattcatctgccgcacctaccggaagtcctgcacagcagatgtgcttgcgtgctcgctctccgacaagccgacgatccccggctgcatcgtgctcctcgtcgagcccgaagacaccatcatctggtactgtcacgtcggagaagatgaggagtgggttaggcacgagtacgatattggcacgcagcacttggatccacccatgaatggcaaggactatgagaaagtactgatatgctcgatcgcagcttgccaaggcaagttctacttcaacgccagattccacaacatcagtgtgctggagttcaccccagagccgacgttcagctccatcgcaatcaccgaccccatggattttgtgggcgcagcatgcatattcttggtggagtcggagagcgaactttacatggtatgtcagctgcttgagtacgacttcaagactgtctacgacgtcactgtttataagatggatttctccaagcatcaatggtgcatagccgaggacattggtggccgtacgttcttgatagctccttgttattttggtgcttcacgttcggctgatgagtgtgggctagagaaggattgtgtatatgctatttttgcgcgtgataaatattttgaggtatccaaggtagaggatggagaaactgacgagtatgatctcatcgaagctccaaattcagaaagagggatgtggattttgcccattactgggtagtctagtttcacaattgggaattggactttgttttatcatatatttcacctgtaaagaaacatgttcttaatcagtgtaaccgtagttaaattcgtgtttccaacttaatgagctatatatatatgaaacaatactatcgttcgtgtatcaatcagcatgacaagaatttttgttggaaagaaagggagggtcagtatttctaatgtgtgacacacagaaaatgcaggaatttgataacttaactttgtatactggtttagctagcatcgtttactttgtaagttctgtcaaaagagccaacacttgattatgtggaaacaaatgactacctagcagtgcatgttgccaaagccggccacctgtagatggaattatattttcatgcaaattattagtttttggttccctgaatagttgggtgttctacgtgatgaacaaagcacaaattactttgtcgatcagcttctgaagaggagcaaaccctgcagatccagcacatgtacttccttcagaattccgataagcctgattaggcccaaattgggaaaacgtctgtttatgcaagcccaaagcccaaattggcaa

SEQ ID NO: 15075 - DNA, 3645 bp, Oryza sativa
tttttcatgtcgtgtcaggctgcaattcgtggagcttcaggcagggattgctgtgaccgactcgtaatccaccgtttgtactccgcaacatctgaccttgtgactcgtctgcaaccagctagcaatcccctacataagagaggcttcggttcggttgcagatccaacgaagaggataggagatagatcagccttgatcaccatggacaagacgagccgtgtccccgtgccttgcctcgccctgtacctaaagcatggcgccgacacagacaagccggcgctgttcagcatctcggagaagaaggccatcaatggcggcgacatccccgggctgaccaacaccaactcctgggtgacgtcgcaggggtggatcctagtccgcgacaccgcctccgcaaccacatttttgcagaatcctcgcgatttcgacgataagattcagctaccccatctaccccaggacgtgcacatcagttccacatgtctgctctcctgcaagcccacgatgcctggctgcgtcgttctcctcgttgagccagtcggcactatcatctggtactgtcacattggagacgacgagaagtgggtggaacatgactacgacattggcacgcaggtcttggaccctcccttggatggcaaggaccacgagaaggtgccgatatgctggatcgccgcttgccagggcaagttctacttcaatggcggcttcgaaagcatcggcgtgctggagttctccccctcgccaacattcagctccatcgcaatcatcgaccccatcattggaggattaggggtgatgggcatggcaagcctgtacatggtcgagtccttggatgaactatacatggtttgccaaatgtatgactctgacatgaagaccatctacgatgttactgtttataggatggatttcttgaagcaacaatggtgcatagccgaggacattggtggtcgtgcgttcttggtagcttcatgctattttggtgcttcacgttcagctgatgagtgtgggctggagaaggattgtgtctactctatttttgcgcgcgataagtattttgaggtgtgtaaggtggaggatggagaaactgaagagtatgatctcatcgaagctccagattcacaaggagggatgtggattttgcccgttgaaaaaaagtagagatgaaaactgttcagaactgtaggaaacaatatcatctctatggaaacaacgctaatagaaattagaaaaatcaaatgttatatatagctagaaacaaggaaacgaatcatttctatgaaaatgatacttggtcaattggaatttctgccactgttttcaacctgtagcgtccgttccgtcgtggcgcctagcgggaaaatttaaattctaaaaaccctaattgcgaaaattgtttcttcgcttgcagtcagtctccgcgccattccggatctcgaatccccgatccatcgtcaaatccaaaccctaatctcaatcttccttcccaaatcaattcctctgcaaaagtctattttgcctccctcaggttcgatgggccgaattcctctcggcccatctctctccccatctctctctcccccctctctctctctctccctctctccctcgctctgcccgtgcgccgcgcgcgcgtgcgcgtgagccgcgccgagccgagcgcggagagccctcactgccgcttcccgccgacgccgcccaaatcgccgcgccgcccgttgcttcccgcgcgcgcacgccgtggtggccgaccggccagtcgccgccgccgtcagcacctgccgcgcctgccccgcgtttgccgcccgtgtcgccgctccgctccaaaccggtccgccgtcatcgccgtcgtcatcgacccggccccgccaccaccgcgcgctagcttccaagggacggaggtagagcccctcctccctctgccgcgtcgttctctctccctccttcttttcccaaagaagcaaggaggcaagccccatttccctcttcctttcttctttttcctcccatcgctggcgtcaccctcccttggaccgagcgctactcgctcccttgaccgccctaggtcagttcccaaaccaacatcgcctcctatttaaccaaggcgacctcccatcgattcctcccccccgtttcgctcgccaccaccgcgccattgccgcccctctgtctcgcctctgccgttcattgccaagcgccgggagagccggtgcgtgcgaaggacgcgtgaaggggactccgggtgcaccctctccttcctcttccccggcccgaggccggagcgatcacgccccgcgccgtcggccgtcgtcactgcgcccgcccgcacggtagtgcatcttcccgttctccctccttgccccccctcttcctcttagctttcggtagaagcttgtgtagcctccccgtagctagctggcgccgccccgactgctgccgtcgctcgcagtgggctcgccgccgtcgccgcccgagtccggtagccacctctcatcgccggcctcccacggcgtgtttcctcctaatccggcgcaagggatggattcccggagtcacgtagatgctctagctcgcccgaactgatctcccgtcgcaccgtcgccgtttccatcttctctcgccgccggatgccgccgccgcaatccgccgccgtcgaactccatccggtgaatccaagccgttggctcgctccctctcgttctccctcatcattccggtgtacaccccgtcgcccctcgtcgtcgcacggtgtcccggagaaaccgccgctgcccgccgtccattcgcagccggcgccttcgtcttcctccagccggcccgcgtggcagccacgtaggcgccacgtcggtgccacctcggcacgaccggatcggctgaccccggtcagccgcttcctccggccccgctcgcgcgcgcggtccaccgcgagccatgaggctgcgcgtgggcctgccgcatccgcgtccaccacgaaccgcgcgcatgcaccgcgcctccctccccaaaccctagcacgccccacgtgcacctcgctcacggtgagccaagttgccgacaagcgggtcccactcgggaccacgcgggatggacccgacccaccggctctctctctctctctcctccccgcccgcgcgcgcgccttgggccgccttctcgggccggccggcccattaagctcggtcgagccgcccctttctctcgggccgcgccctagccgcccgagggaagtctaattcccttccctctttcttttcttttcttttctcaaaaaggatttaaataaatcctctttctttagatcaaaaatctaataatcttagaaattcaatatctcctcaaccgtatgtccgtttgactccgttcaacttccaaaattcctcaaatcttgagatctatctaatggcacgcttagaggtcaataatagggctttattttcgctgtttgttgagttatcccgttcggcgtgtagtttcggagcctgaagacccgcagtgcgaggatttcgaggatcaagctcaagatctcgagcaaggcaagtcacctttgatcagcttgcacctataaattaaatctaagtatttctttttgcaaatattgcatgaataggattaacacaagtaattcggccgcggcttgcgaga

SEQ ID NO: 15076 - DNA, 1200 bp, Oryza sativa
gttcctgctcttgcacttaaggaccgtttccttggaatttcatccgaacataagacaagtgcgaccacatgggtggaatgggacacccctggctgagtaactagctaatcgggggagccatgatgccaagagacatgtggattcaatggggtggtgtcggggagaacccccaggtttcctggcacagtatggtctgggacctaatctggtgttggtctgggacccctctcgttggcatatggtgaacctgtgtctgctctcgaaatgccttgtcatgaaagcccttaggtcaccagacgtggccgttctgcatgggctggatgatccgggttagtaatgtcgtgtgggtaaagtgtactccctctgtagaggttaacaaactgttcgaacagccgtgcccacggtcatgggcggatgtgaggtgattcctagcgtagttttgtttgactactgctttgtgaaattgctgttgtggaatgggttcgatgtttggaaaatctacggctgatgggatcagccaggcccgggtggccgtttgaaagctgttggccgggtgccaaccttgatcaattcaaaagactgatacatcgcacatactccgatcggacgagacgcactgtcccatccgtgtcgtttgagaagtactcacttagttgtttcaaaaaggagtttaaataaaatcaattgtaaaaacaacagccttccccttgaagcctacattaaacacttatttcccatggcttgctgagtacccctgtactcacccttgctctatataaataattccccccccccagttgctaaagaagatgatgtggcccctgctgacgaggagttcttccaggagcaagtcggctacgatgagttttagggtttcggcctagttcccaagtcgcgtctgtcatgtttggtccaagtcttggcttccactttcccttttgtaatgcaattgtgagctcgggatctgtccgcagcccaacatgactgtactcctactctataataaagagacctctgttgctgtgatatactgtcatcctgtgataccagcactgtttcctgggactggtatcgattaacaggttaatttggagcgtcacgggctagttccgctcggggctagttcggggcgtgacacaaccctagttgaaatactataaaatctttttttctagtttaactctagtttattactccctc

SEQ ID NO: 15077 - DNA, 5645 bp, Oryza sativa
ttattcaaaaaaattacgtaattataatttattttgttatgagttgttttatcactcatagtactttaagtgtgatttatatcttatgcatttacataaaatttttgaataagacgaatggtcaatcatgtgagaaaaagtcaacagcgtcatctattaaaaaatggaggtagtatttgtttttgcagcgcttaatgagtgcactatctatgaaattaacatttctcctttttgcatcgtattgtctactgaaagcataacaagatatttcattggaaagaaagggttatgtacaattgatgatcctattctgttgtattaaaaagtgagtagtgaaccttggtgccactcatctcaggtttaatggtttagcattatttggttcatattcataaattgtctgtcgacgaaccaagtagtggattcagcgcaaacaaaataatgaacctagcagaataatgccacattaaatggagcaccacaagaaaatttgttggaaagaaacggttcgttattatttctcatgttgccgaggcagatttttgtaggcagagggaagacaagacacatgaacttgatgaccttactcaaagcatgagtgaacctgggcgccacttatatcaagtctactgattcagcattgtttagtttgtaagttctgttagaataaccaaatgcttgattatgtggaaacaaagtactccactgtacctagcagtgtcaacttccaagtgtcgatggaattatctgtcgagatccaacttccatgttgaagtaacaaaattaacatatccacttgaacctgtactaatttgtaaacatgcataggccttaaaattatagtcatgctgctatgtgtttgttcctgttccccctgaatggtttgagcattaggacattaggtgtgtctactggacaagcaaagcagcaattttcctctttttttttttggtcatctacttcagagttcagaattcagcatatccaacttcagaattcagcacatctaatttcagaattcagacggtgacagctacaagaaatttgcactcgtcgacagcccaggtcctgaaactgattggtagtagtgcattacaatctgaagagtgaatacatattttaccagttatatatcaattttaattccgttcaaaaaaatatcaattttaacggtttaaattttgtccaaagtttgttcaagccagggttcgattcctgaactcctcaccttccgcctggattaaatgaagggttggaaatatgtgactcctcctatcttaattccattggatggctagctccttctagccatcccaaccttttgttcaagcaaaaaatccttgtcccaaggtaaataattctgaacatcactacctctgaataatggagtgattggggattggagaaattcagatgagaggctacttaaattagtgcacatttggagagtaaatttgctctctgaaataatcacaatcacaaaaagcaaaataaaatgtatcgaatccttgtccttattacaaactgaacgaagtgagtaaccaacatcaaaattcgcagaacagacagttctgcacgaacgagcagcgtgggattagatcaacgccaagaaggcgcaactgcgatccgatctcctccttcctcctcttgcggttgggtgggctaattgcagagcaagtacctggtgagcacgaggacgccgcaggcggcgccgaagaggaggaagacggcgaggtccctggccgcccagcgcttgggcctctcgccgccggcgccgcccttggcctcgacgcgcaggctcttggcgcggcgcagcgcgtccacctccttgaggaggtcgaactcgagccccttccgcttgagctcggcgacgcacttgccgagcagcagcgcgtcctcccgctcccgcgccagcagccgctccagcaccgcctccgtgtccgccttgtaccgcagcgcccacagcatggccagcgacgagagcagcgacacgaggcaggggatccacgagcgccggcacgccgcggaggtggaggcggaggcggagaggaagaggaggaggatggaggcggcgtggaaggcgaagaaggcgcagtagaggaaggcgatctccttgcgggcgccgtcgaggcgggcctcccgcagggcgacgcggcgggcgagcaggtcctcctccttgagccactgcttcagcagcagccggtgcgtcccgctctccgcgatctggctcagcgggtgcctcgccttcgcctgccccgccacgacgagcgcgtcggccgccatggattcgtcgaggtggtttcgcgtgcgtcgtgggggtgaggggatttggttgcggttttggcgtgtttgtggggggtggatttgaagggggaattttgggcggaatcgagggtggctggctggcaacggtcggggtggaaaagcgggcgcgcacctgaggcggacgcaacggtcggaatcgaatcggtggcgtgtggtggaatcattcgggcttggcggtggtcgaatcgggtgcacgcgcccggctaaatgggctacgagttattgggccgcgtcgcgagaggcgattttgggctttcggtctgcttgtcgcgttcggtgtgtgactgtgaagatgacgaggcctatggagcgcctacgagcgtcgctctgattatcagggaaaatatcagtccatgtcatcacgaggaattttactagtagatttactcacgagtaaaaattttagtgagtggtgatgtggacgaatcttagacgttcatttttcgattcaacagtaattttcactacatatatggtttgcagtatatattttcccaattatcatgacaaattccccgtctatgcttttgatgaatattgtcaaccaccaactcataatctcatttgtttgctcatgtgttctcatatcagtatgtataagtatccaatggcggatttaggccatttctgtggggtcggctgaccccacagctttttgaaaaacatcttataaatcttaattttcatgtataaatccaaaagaatttagagaaatgaccccacttaaatacaaaccactagtaattgacctcacagatttaaatttctggctccaccactgtaagtatccacctactcacttctatctatgtactggagtagtccttaatgcatatatatctcctcctctttggacatcacatcatctcactaagactgagaacaactcaatgtcaagcaacatctgtacgtacaattaaccatacatacttgaagttcgtgcacacacactctctctcaagtatccaagttttggcataggaaatgggggcgtcaggaaaaacaccttcgacagtgtaggccgctagtacagctcgccagcgttgtcatggctcatgcatagatatttgcctctttgggcaacagtagtaaggctcaacggaccatctccatagttatctagcttctccgattctcatcaaaatgtctgcttgcacttgcagcggctttcaactactgaagccgtatggtagcaatcgcggccgatcaaggccaatgcgtacttctagcgtgctatgcacttgggaattacatccctgggtttagcaattaccacccgttgcgaattgcgatcaaccctcggaggttaatttagggctcctatgaaacgcgtcaatgaaaatcgtagaaataagaaaaaaaatacataaatcaaatgtacgccatataaaatcttataggaatttatcaaatttgtggtcttgattgtcggggcctctgatctcaagcgtggggaggaaacccccctctgatgatgatgtgcttttgaattttgtcaaccaccatctcataacctcatttacattgcccatgtgtacgcatgccagcatatatatccgcgtactcacttccctggcctggagtccattcacactactcttcggacattgtcaaaaaaaaaaagggggggtacaatctggtgacaaggttgatatggctttggtttctcactcccctccctcttgaaaaatagttttggacttagaaatgggagacgtcaggaaaacacgttcgacaatgttagacaattctcctacagctaccaagaataggcttgatagtcatgggccttgagtgggtcaaagtgcagtggctcagttcgatcggccatgaggataggtgtcccctcctcctttttgaccttaattaggctatgtgtttaaatcatcactgatctgtgtgcttatgcttagattgtttataaatatcagattaatccatttctcaaatttataataattaaaacttaattaattacacagtactacaaccttatttttatgaaacacttaatctttatattcatctttatctttagaagattcaaataccataatagtatttaccctacttggcatcgcgaattaacgagggtttggtttgtctcgtcggcggcacgtgttggtgggccatggattggtgtgaatccggcccaggtcccctctcgggctaaagaatctcaccactcttctttcccggataggtgcagaagcacacacatggggagtggattcaattagtattgtgctcgcaaaaggaataggaataagcggccataagaccctctgcgaggtatttttccttacgtaatactctaattgcttgccttattttcaacgtgatttcatagctttttcggtgggaatttccctattaaatactaaaggagcgagctctaattagatacttatttcttttttttcccgagcattgaaataccaaattaaaatcaaaataatatgattcaacctcagacccttttaaatgtagcagataacagtggagctcgaaaattgatgtgtattcgagtcataggagctgctagtaatcagcgatatgctcgtattggtgatgttattattgctgtaatcaaagacgcagtgtcctaaatgcctctagaaagatccgaagtaattcgagctataattgtacgtacatgtaaagaattcaaatgcgaagacggtataataatacgctataacgacaataaaacatgcatttggcaggccgtgcatcaaccaaatttatttaattttttaagaaacttttgtatataaagtatttgaaaaaacacaccatttattagaaacctggcctttagcatctcagaacgcatcctaagagtgatgctctttgaattctccaccttgcataagagcaggtacaatagcaggctattagctagctataaacatattttaatgagataaaagatgagaaagaagagcaatgggctacagatctgtagccagctgcagcacggactccaagacacagtgtgtgtatgacaggtgggaccatatattaatagtacagtaaatatctattgtatgaattgattattagattggctatagataaattggagttagcagtgggctatactattaaacttgctctaaggccatcctaaccctccatgtcatctagtttcatagcatttaatatattgccacataagtaaaaatctgatgtggcaagaaagttaatgaggagagagataaaaagataaagaaactatctcttcaagaaccaagaatgaaaacaaggggataggtggataaaaggagagagaagaaaggtgattggatgataattta

SEQ ID NO: 15078 - DNA, 508 bp, Oryza sativa
actggcatatacatcaagtgatgggctcgatcggaatgggaggtgtcgagaaaatatctttgaccttggggatttcgaattgcatccgctccatacagtttttgcgcatagtatagctcatcggcataggacctcattgttacactcatcctaagccccttagtaacgcctaagggtcttatggctagctttacaaaatggtgggctagctgatctaggttcgaagtctcaccccctctaattatttattattataggtcataccctaatattcgtgtttgggagcctccatgcaacaactgttcatgtggctggtgaactaacgttgaagttgaaatacggcttctgactattttgaatatggtttgtccaatttccgtttggttcgtccattagatagttttcgctggcacctccggttttcttatccaggagtgtaaagttttaacgtgtcacatcgggtattatatagggtatcgtatagagtgtttggatactaataaaaaaa

SEQ ID NO: 15079 - DNA, 3649 bp, Oryza sativa
aacattatttatgttaaatcagatatttatttgtgctatggagtatatcgttggccataagttgataaacccactcaatgatgattaaaatgtgttgttgtctgtgagtacttttgtagtgttccaccctacctatataaacgtaattccaactttgaatcctagccatttataatataatgtgatggaatgacataatggagtattttgttacagcgtaaaatgaacaagtggaaggagtctgcgtatcagaaatttgaggaactggagaagttggggtgtcttattcctgatcatgtcatgatcaatggccaacctgttcccgtgtctccaaaaaatgatgccagtcattccatacaagccaacccaacatgctttaatcaccagattgcacttgaaggtcttttatatattcattatgatccatacaaaatcctagtcatttcattttactcaagattcaagtcgttgcgtaattaggtcagggacatcgatttcaacagcagaatggattttcagcagtacacgtatttactccatacaatgttgctggaacttccacacaactaaaagagccgttgcaacagtatccttatgaacaaagtatgcatgaaggtcaatactactccctccgtttcatattgtaagactttctagcattgcccacgttcatatagatgttaatggatctagagatatatatgtgtctagattcattaagatctatatgaatgtggacaatgctagaaagtcttacattgtgaaacggatgaagtatatacctgcttaattttcactgaacaccctccaagttactataactgctcatagtttcaacttgcttcagaatctggtcgggagggtccttctatgcagcataatggaacttcttactctctgactgaggaaaacatcttgaacggtctaggctctggcttagtacaatcaactatcctatctcaaaatactgcagtagtaagtaaaaacgaaattgaaatattaggacatgatattttgtcgtgtccatctctttctaaatgaagattgaaattctttagttggtaatttctcgtttatgacttgaaatgtttctgtatataggtcccaggtgcagatccacggcacagtggatatgccagcacctctacagctgacgctgctggtacttcttgtcctgtaacaggtgtgcagctacactgaaactcttatagttcaacagtacatttgcagtgaactcgatcaactcaaaccacttttctacattatgtatttgctgggtgatgaaatgttgatgttggaatttcctcagatggagttggtccatgggactatccgattttcagtgatctgtatccaaatgtagtaagtactttgcgctgaataagttgaacatgctatgggatttacttcaaagcaatgtgctcaatctgaagcaatgttgtcagtggcttgtttggtgttttttcctttgtttgtcatgacatttgtagatgttccaggaaccgtcaggactaatctatgggcatgtggtggaggcagaccaggcctttctcccagatagccacggtatgtgtacccacggagaacatggcagtagagtatgaatactttcgtaacagaagttttggtgctgttgagtttctatttgtatgcttcttttaaactgctttgacatgttattttcaactaaatatagttccaatttcctaaagtgtgcaaaataatgtcttatattcataataaattgggtgaactcaatatgttattaacaataacagaattgcttcgcccccttttgataccagcaacctgaaacagtatattattcgttacgagaaactgctagaacaggttatacatctagatctaggactgggagggaactattactccagttcatggcactctgaatttgacacgctcttttcagcaatactacgagcatctgctttagctttcctcaaaatgaatagaagttgaattgtgcgattaccaaattgctgatgtacttactggctacttaagaattttttgacacaatactagccacttaagattaggattgaatttaatatcaacctttcgtttcgtgccatgacagtgtgtttctcatttcagaactggcaaatgccgacaaccaatttactggaggtaatgatgatagtgctccatttgactgaaatcaccgcaacaagttattgtctactctcaaccatactaaagtgttcagtacttccagtgtgattataagtgtgtagtagttcgtaaatatagtagggacatattatgtcagctattctttaatttgttccgctcacgttaaatttgctgcctgcacatttggcatagtttgtttgtactactgaatactgagatcaaatattgatattgatgcactacgcctaattcaattcaattaatctagtttgtcccggtcagatgagtttctatctactttatgctggagtacatacgattgaaaatctctctgcagctgcagcgacaacagcacgagaattgcacgaaggaattgttctcaagaatcttaagatggtaaatacacacaagagagaggtacggtatacaagacttagtttttcttaagtacaacagatcttccattcctccatgatcctatcagcttctacacccaaaccacacaaatcaccatgcacgagccctcttcctccactgccaaatcaactgcaaaacaaacaagaacacatgccacattactcttccattttcatgagacaaacaaggtcacaagcacatcatccaccatgtgatggtgcatggccatatctcacctcacctggggcttgagtagccaagcatccatgtggtgatcagtagccgatgtcagcgtcgtcgacgacgaggttgccggtgatgagctcacggtaggcggcgacgggccagatgaaccccctcgggaggagcttgacggcgagctcgacgtcgatgatgatctccctcatggccggcttcttctcgccgctgatggcgatgaggtagctcctgccgacccagccgatccagccggcgatgtagaggaagagcaagcccggggtgatgaactcgccccagtgccgctggtcgccgctgacgatgaggtgcgggaggccgtcggcgccgcagagcaggccgaacttgccgtagttctcgaagcggcgcttcgtcttctcgatggtggcgttgatggcgagcgccggcgcggagtccggcgcgtacttcttgagcgacgactggagcttcttgatggactgcttctcccgcttcgcgaacgccttggactccttgcacggcgtcagcccggcgatgtcggcggcggcggggggcggcgacgtcgccgccgaggagagcagcaccgaggacagcgccagcgccgcggagaacgtcttggccgacgccgccagcgactgcgccatctcgccggcgccgccgttgttgcccgacgcggagcacgacacggagaaccgcgcggccggggacgacggcgcgcgcgccaggcgcggcttggcggcgaaggcggtggatgcggcggcgagggcggccattgctgctgctgctgctatcggcgagagagagtatttgcgatcggagtgggtttgcgggtttgtatcgtgtggggggggggggggggggc

SEQ ID NO: 15080 - DNA, 7635 bp, Oryza sativa
gccttagcgagaacaagccgcgaccctcgttcaacaccaaatgcagagactgacggctcaacttctcgcagctcatcttcaacactaacgcttccttgacctgaaggtccaatcaagggatagagaaatcattccacaagtcaacaaaccggatgagcgacttaaattaattttctcttcgttggtagcctgactgacactcaaaaaggagaagtagagattcaatggagaagggtgagaaatctggattatttttgagcaatcaataacagcaaggagcgagcgagcaatgactagagagggtataacgaagaatttatagtcttgtttgcccgttgcctgtacagagttttttcgtttgggaaatgaaattcatccccggcccaccggtgaaaattcaaaaagaaaaatcaagaataatttatagaagcacgcaaatttcatcagaaaacaaacttatccatccctcgatttaacatatactaatattgttctttatttcagcacagatctgaaacaagctagccaggcacacgattctagcacaaatcaaagagcatgtcagttatggcaagcgacacacagtttgtgatcacagcggcaggcaaagagaaaagcttccaagatctagaagagaagctagggctaacgcaaattcgagaaaggaacgtaataagtagagagagatgagaaagaagggatggatgatcatgagacttaccagccaaccagcgagagagacgccgcggacgccggcggcgatggatggagatcgactcaggcgaagcgtacgggagtcgagggcttgaggcctcaccgaccaaaccaagtatgggctttcacttctcacatggttcacttcgccggcccaagagtgagtgaaccggtgttttggaataggaataagtttactttaggtccctcctcttgacatcgagtttgaaatcgtatccttggaccacgataccagaaattttgacccccaaacttgcaaaactgggatagattaggccctcccgcagcatagatggttgttttctactgacgtggcaagttgatccgatccacttgtgctgactacgcgcttacatggcaaaaacaaaccgggcctcacatatcatcctcactctcctcccatgctcctgttctcggtctctcctcccaaatcaagtgaggcatccacgttgagatagctgagcggcacggcaacggggatggcgaggtgatgttagctatttttttttaatctgaacacatgcaaaccactaattacaatttgggtttagtaatacttattattttgaacaaaaatattgttaaacttttacaactttgactaaaataacatctcagaatgttagattagtcctaaaagtacttcaataaattatatatttattgatgttgttatatatattgtaataaaaaatagttgttgaaatcgttttttaaccgcgtgtcgttgtttaaaataataagttttactaagccggagggagtacgaaattagccagtcaaatcaaattgatattacaaactaatgacggccgtattagccaagcaaactaccaaagcaaatagtgagacgaaacaccatcggtccatcgatctaatatcttgtgctggtttttctctcctaataacatctagtgctccaagactccaactactcatggggaaatggaaaccaacaactaacaatttggatgaaaaatttccagcctgcacatgtagctttctcatcaggtaggcacaatgctccatctttcagcttcaggttggaaacaggaacagaaaaacacatgacctggaactttacggcctatcctctgcctttgcaagttcaaatagatttaccaagtgtgtcacttccatttgaaactagggagagatttttatcctcacaggtaacttggcacatgcatgcagtgtgacattattcagctggctggccgacaaacaactcatgaatatgaactaaataatgataaaccaataaaattgagaagagtggcgccaaggttcggtactcggtttttaatacaccagaatagtcatcaatttcctgtgtgctatctctgtgcataaccctttctttccaaggaaatatcttgttatgctttcagtggacagtacgacagaaaaaaaaacttaatttcatatatagcacactcatcaagcgctacaaaaacatataataaacaatggctacactagagaaaatatttctgtacagtctttcaacgaaccctccctttctttccaacaaaaattcttgtaacactgattgatgtgtgaccaataatactgtttcatatatatagcttactaaagttggaaatacaaataattaactacggttacactggataaaaaaaacatgtttctttccatgcaaaaaagatgataaaattcccaattgtgaaactagacggtgggcaaaatccacatccctatatctgaatttggagcttcgatgagatcatactcttcggtttctccatcctctaccttggatacctcaaaatatttataacgcacaaaaatagcgtagacacaatccttctccagcccacactcattggccgaacgtgaagcaccgaaataacatggagctatcaagaacgtacgaccaccgatgtcctcggctgtgcaccattgatgcttggagaaatccatcttatgaacagtgacatcgcagatgtactcgaggttgtagtcaaacagctggcttaccatgtatagttcgccctctgactccaccaagaatacgctagctgcgccccagaaatccaagggttccgtgattgcgatgaagctgaacgtcggctctggggtgaactccagcacgcggatgctgttgaatctgccattgaagtagaacttgccttggcaagcagcgatcgaggttatcggcgccttctcgtggcccttgccatccacgagtggaagcaagggctgtgttccaatatcatactcatgtctagcccactcctcatcttctcctccgacgtgacagtaccagatgatggtgtcttcgggctcgacgagaagcacgatgcagcctgggatcgtcggtttgccggagagcacgcatgcgcatctgttgtgcacgacttccggcaggtgcggcagctgaatctttccgtcggaatcctgtgggttctgcagaaacgtggtggtgtcgtcgcggatcaggatccatccccgcggcgtcggccaggcgttgctgttggtcacgccggcttgtctgagtcggcgccatgcttcagggcgatgcaaggcagagggacacggcctcccatagtcggcgtggtgttgtcaaacctctattcctctcttcttcgtgggcgtggtgttgtcaagcctctattcctctcttcttcgtgggatctgccaccgtagtggctcccttatataggcgaggagggggaaattgggaagggttgggacgagtccaaatcagatgccaatcggagtgccacagcgtatttcgagtcggtcatggcaacggacaaacccctggatgaaattccacgaactgcgatcgaatcagatagaacatcatagaccgaatcaagcggagaactgaaaccgaatcagatagaactgcgacgaatccgcttaccttaactgcgatgaggggatcagtaccttgttagaggggggctgtgcgtcgcgatcggcgtagggggccgcggactggacggcggagatggcgatcggcgtacggggcggcggatcggcggggacgggaaggtcccgcggggggagagagggaggagaaggccgcggcgtccccgtagtccgccgcgatccccgtccgcccgcgcggcggtggccgcttggacggaggcagtggaggcgcggaggggccgtcgacggctgtcgtgggtgacgggcaaggccggcggattgcgggtggcggatctgatgttctgggcgtttttcttttttatttgagcaaatttcgcaaaataaaaaaaaagcatgcgtaacataaaaaccccacatattttacagcgtgtttcaaggaacctggggtttagggcaaaacgtttaataaaacctacattcatatgcctaaattattcattggctattatacttacgcgtaatacatgtataagaaataatatgttgcattttctgagtagatgtagccactttctcaagagaacaccggtcatgaattatgagtttttttttttttgcttatatgtaatttgtacatgagatgctatttgcatcaacaattttcccattatgaattgtgaggtaggaaggaaatagagcgtatagtatagaaacgttcagcccttaatgcgagtatatgtgtactacaacgaagtataagtattttgaatgaatatgtggttttgtgaaacattttaccttaaaatatgtggttccttgaaacaaatggtaaaaggtggggttttgtgttattatgttttaaaacatgtgacttatgaaatgtatgccttttaaagattttaaaggattgaccattggggagtatgtacgaataattctaagagaggagcgtacagaagatctagcatttgactttgtaggttcaataaagagaaagatggggtaatataggaaggtgcgaaaaattagtggacgattcaccacgaccattacgtttttataaatagtaagtgtagataataggtttcatttagttatctacgtaatatttaaataatcaattatttgattatatatataatcagataatatggaaaaagtctaaatctcccataaactatggccatgtttgtttcaacttaagattattataatctagattattaaatcagattactctaagctggattataataagctgacataaaataaactgtaatttatttgtttctctagattattggaggcatctaaaaatagtgagtctttagccactcaataatctgaaaaaagctcaaaaaaaaaggagattattagattataataatatggcttatagattgtaataatctatcataataattaacttgtttgtttcaactttacttctaataatccaggttataataattctaagctgaataaaacaggttctatgttcaagagttcatatagtccccaaactataaaatcgggtatttagcccctcaaaccttataatccagtcatttcaacccctaagctgtttcacaaggcagttttgcatacgtggcgggctgattggaccgtatttaccacttcgtaacaggagggaaagggagagttcctctcgctctagggttcatattccccatctcgagttcttcccgcacgtcagtagcagcgtcaaattccggacctggggcgaggcgactctagcgcgggaaatcatagcagcggcgctggtgcgcagccacggcgagcgcgacgaccccggcgcccgcgacaggtaggagccgtacgtgcagcatcctgtatgtgtcatctttgccggcgctggggctcatgcgttcccggagcttgtaggctacaggataagttctgtggctgtcggggcaggtgcatgggctgcacggcgacgctcgacgcgccggccgcaagcacggcaaggatggacagggccaagtgatatgaactgtagaacatggtgatagaaaagaattttttcagtgtaaatccatgcatatagattagggaggaatgaaatgtgtaaaagaagctcatctattatccctctactgttgagtgtaatgtggagattgcccaagtgatattgtataatctagtaagcatattattatgcaattcaaacgttgtatccttttgggattatcttattcgcatttttctcatttttttcatgtgattgtatttggacatttttactttataatatgactgtaatcaggagaattgtgcaggaacgaaggccatgttcaagatcaagcttacaggttcagagtacatccaacaaatttgattgtttttcaggtttagagtactaacacaagtggtaggaaactagtaaggaacatagatcttgacaagaatacaggtataaacacaaaaaagcactgctgatcagattgctactccagttggcttgcccttcagtgaaaccttcttggagctccttacaggtgtctttcctagcctgtgaattgttccttcccctgctccttgcaagctatgtgatgcctgcaatgtacacaaatcatattaggattaaatttgcagttagttgaagggagatgtgattgcctgttgttttgtatgaacagtcgatgatgttgctccatcaggttgctttctttttctattagctcctgtgacaagagcatttttcttcttgccactctctttattgagtggacaacccatgctattatgcttagttttatgacaaagcccacacctcataactgtgccaactcttgacattttagttgctttaggtttctcaccaggctcccgcttcctagcttttccttttggcctgccaggcatcttgacataaccaggttgtgaaggcttggggtgatctgatgtaggccacttctctccttccacaggctccatgcaatgatcatatgttgtactcttcaattgaatagcattgagcaataaaaccatctatggcttgtcctgacttataaatagcacttaaggcatgtcatattttgcaagtttactgtgtacctcctccttaggtgggcaagtgtgttcatcacagagagtaccaacttgaaaccaatcacatttgcttctctttgaaccataaatcagccaaggacatctaggagccctgatcttgtccctctcatccttgataaacacgatatgtcgtttggtcactattccgtacttaagtaaagctttcttcatttcctctttccctctaaatgtcatgccaaccgaaaaatggggaatagcagaattagagtcataccttgtccacctactctttctcctcactgtatggtcgttgtgttcaccactatcatcgtcataagaataaccttcactagaatcatatgtaggttcatcaattatctcattcaagctatcatctccatgacctattaactcaatgggcacactgtttgcatcaggatcttgtagaattagcctcattgcttttaactttttgttatacatctcagcaaactttcgtaggtttactacctcctcatcatctggtgagctatttccactttctggttgatagtcactatcaatagtgtcactatcttctcccacacttccttctttgtttgcatcatattgtgtcccttccacgttttccatctcatcagatttcacactgtcagtttcccaatcactttctttagaattataatctgacattgtttcctccacaaaaatttcagccactccaccttcagcaatgcaacttgacatatcaaagcatgccttgtcatctgtcagtaaacgtaatcatgtgcttaattcttttccaggaaacaaccagtgaagctgcatggcatccttgacctcgacatggtctgcaaggtgtcctctaatttcaggcatagaaatcttatcattttctatatataacatcccttcatctccaccaacgtattgcacaatccttctagaattggcgaactccccattataatggaatctgacagg

SEQ ID NO: 15081 - DNA, 7440 bp, Oryza sativa
cattgcaatgggatttcaaaaatatcattaatctgcattatcatcatttcctatgtatatcatcttttaattattgtatgtatttctattactggcatgtggaccctttagccctatataatcactttaattaaaaaaaatagagagttggtaaaaaaaaagtggttgacatgtgtagcctctaaccccacctgtctttttcattcaaaagaaatagagtgtgcggatagtattagaagggaaaagcgcggtgctactaccgcacacagctgcgcaagcaaaagtctcatgaaatgccaattagttattattgattgaatgtttccccttcatttcaattaacctaaaaaaggtaatcttaaaacatagtacatacatagtcagaaatttgtattcagtgacgccaaatgtcaaatgaacaaacttcatgtaaaaatttgctcgtgcaaatactccccgtgcatattaattaaaagtacaaccacacaggttaatgtcatgatcataacaatataaaaacaattggaagctttgttaacataggtgctctttaattaaattgaccaaacttcaaaccataatatgaccatattagtgaataaccaaaatatcactcttgcaactatgcttgcagctgttcattgcattgtacaaaaatagggatgacttaattgtgaaagacagtgcagggatggggaaattggcatgacagaatcgaaaggaaccgttgttgactgcagctcaaggctacatcatcacagttaacaaaagctgaagaatgcatcccagaatatgagcggtccctgtacccaaatatgacacagtgtgtattgttctgtattctctaacctaaatagtgacaatgtatataaacattgtccatgaaatcccatccaaagccatctgataaatattagtttgaatgtacatataatttaaccacacctccactttgttgaagaccctttctgattgaccagtcatccattgtactctccatcatctggcaacaaagccaagcattattatgtaagttcacggccacttgtttccaaaagttattccttcaatggatgatagtgtaccactaaggcattgttcagttaatccctcctacaagggaatcaagggggatttcgaaggggattaattccacatctattaaggtgtggaattaatccccctcaatatcctccaatccctaaataaaaagtttaaatgtggaataccataaagcatagtgcttaaatatgaaataacatggttctaggacaagcatttaaaattttatgtttccagtagaagcagagcaaatgggaaaattctgatttctgtaccctgcaagcctaaatcctcagatcagaatcctaatttaaaactgaatgtgcccatagtggctaacttgctgctccattttgcaagtgatgaaattcgtaaaaccatgaagagtttttttctccctagcaagaatataaattcttatgcattatatctgaagactatcagttccggcaattaacatataatccaaaaatggacaatgtaaacttctatggttgtaggctttccaacatgtcttttttcagtgcgtgtaaagaggaaacgatgcaactacataccttgcgcagaaacgcatgaggggacttcaatgcagcagataatttatcagacttaaccactgactttatttcagtatatcttgcaaaagttcaattccttttttttcaccaacttgtccactgcagaaaaagaagcagaagaaattattacaaatcacaaagtaaaatttaacagtgttacgaatgatcaaaatttcacagaaacgtgtaatggattaactactaaacaaatggttgtgtttaaactaaaacacattttttcttcagaaaactgaactcactgagagaaggaaaaaaatagagatcgttccaatttccaaataaaatataagaagcgttacttcatgcaatgtcagaacacgaataaaaagaacatacactgcatcatgtatcttctcttcctccaggagaaggatggattcactgaaagtggagctgactcctgataaatttccatcctgcaactcagcctatgccatctttacttggaaggcctattaagcaagaagccattacatgaaacagggttgggctaagtggtgtgaaaatctgcatgaaatgacaagagacaatgatataacatttgatttacaaggaaacataagaaacattggtcattcaagcggataacgacattcattaagcataggcatacactaatgatgtcttggggtgaacactaaaaattttcgtgaaacatttcaagataacttagacacactaatgtccctcagatttctaggtctctgtagaacctacctgagtaaaacacctaataaatgttaagatagcacagcgttgtagttaagctatcaaattttcatccaatgcagacagtgtgtactaaaatatttttggaatgtaagcaataaaagagctgtaaaaaaaagcatccgctccaattcaaatcattatatttccaacgccaccagcatgacgtttctaaccttcttgtgccccccatgttccttcctagttggattggagtatattattcctacacttttagaacaatttccccaactcgcgcaccacaatccatttctcctgacaaagaaaagggggaaagaaatgaatgtagcattgacatgcaaccattagtggtgccaccaagtgcatgcacatgaaagccatggagcactggcttgagtccagagacattttcctttacagtgatcaaacctaaatatgagaaccgataaattatgcccaaataagacagaagaatagaatccaaaattcacagtttgtttgtgaattatcatccccctcttagggaaaaaaaaagatggtaccattgacacactcactgctagcaagcacatcaacagccttcagcattactttttctagaatagttcaaagtatacttcaccaatcttttctggaactatgttagaattaaagtagttcaagattttcattagtgactgcttcgaacttttttagaatagattcaattgtgaaggttgcctttgaactatactaaatatgactaccatagtttagtctttgcgagacaggaattatgggtttgacttcctagcgaatggacagtaattactgattatcattgtcaaccaaatgtgtccaattcaacttgtgaagaacaatttgttgcctggtcaaaggccgccgcacctcgacaaactaaatcaggggcacgcttggattgcaagccgtgctcggattgcaagacatggccaggagaatcttggcacgtggagcgtgccaccgtcaatactcattgtctacgcggatacttggggctgaagcaaaattcaccacacacccagccatatagatgaaaaagaagaagcagaaaaggcagcagcgatggagatggagcggaaacgttgagaaacaggagctcactaacctgctctttcctggtcctggaggtctttgttgcggagctcggtggggatgggcttgccctccatgagcacctcacggctgacggaggcggcacttggttctctcgtataggtacgccgtacgccagagcagagcagagcagcgtgtcccaccacagcatcttgcctcgctcgccaacccaggcaaaaaaccccaccctaatacagggggagcttgatccggagggcatggaggcgcgcggcggcagaacgtcgggtcggaagaatggtgcacgcagtcctgcagccacgggccggcctcagatccagaaatatccaggcaccggctcgtggaggaggaggagcggcgttggcgctggtggcggccgggatgaggtctcgacgtcagttcatagggggaaccgggaggcgttgccgtcggctagcttgctaggaggagggggatgcgggtggaagaaattcgtcgtcgccggcggcggcggcggcgagaggcgcggggcgcaggtggggggtgagaggatttggtgtgggagagccggagagaaggatattttgcacacaagtccttgtattttgtacgattactgcgctacccttaataaaaccaaaattttgttttctttgtattctattttgttaaataacaatgagggtcttttaatattacaacttccacagtacatttaatttaaacaagagtatatctctatgtatagccaaaagttgctatattttagaacagatgtattgtacgaaatggtataaatagtgtattaaatattttattgaatggtatataaatatatcctcgctcataatgtgacattctctccaaaacgccgatatcatacactatattgttcttgctcttggttagtacttcctccgttttacaatgtaagactttctagcattgtccatattaatatagatgctaattagattcattagcatatatatgaatatgggcaatactataaagtcttacattgtgaaacggaggaagtacattgctatagggaaccaacaagtaagaaaagcataatccttcttccgatcctctagtgacaaactgataccgccaccgtattctcaatccacctcctccctctaacgccatctccataccgccactgcattctcaacccaccacctccaacacaggaacacacaggaacacaatctcccaatctatggccatgtttgagagagcttctgctagaatctctaggttcaccaacggtccaagtttcttgcccatattctgaaaatatgtaaccataaaatcaaaagatagactagaaataaaaaaaaatctagattgggagaatctcaacctccccaaacaatccacattgttcatccatatattatgataatatgtaattatacaactaaaaagtaaagtagaagtcaaaaaaaaaaccaaattctcacatgccaccccgttatttcacaaatgttcataaacttagggcctatttgggggagctttagattctgaaaaacagctgtttggtagtcagcttctgagaatctggaaaaactctgaaactcagcttctccaacttctggcttcttagttcatttttcataatatgtaactacagattctcagaagttgtggactgtttggggcagcttctagcaaaaagctgcagctgtgacaagctctctcaaatagggccttaacctccgcctaagcctctctccaatgtcaaacctcacgcaccctagatatttaacttaactatttatcatgatgtttaacttttgccatgtcatatacacatagggacctatatcttatctaaagatatggatggtaaatagtgtaatgtaaaatacgatcgactttttttttattatttttttcattgccaccgatcagaggcatttaacctggcaaaccccacccctcttgtcttcttccccgcacaaggcgagtcgacgccgcgctcccctccttccccggcgagaaaaaaaggtgagatcgcgtccatctcgtcccccccacgccgacgcgacgcacgagttgatcgtattccccacatcccattccttgcaggcggcggcattctcctccacccccacgccgcgaaccggagcggtgacatagagggggcaacggctagcggtggcggccatggaggcgatcgcccgtgagcacgagcgcagcggagaaggattgagcttagctgcggagaaaggaggaggcggccatggaacgcgccgagacgaggacttcagtaaaagcaggcataccagctttgttcatcaggtaggaacaatgctctaatctttcggtttcaggttggaaacaggaaataaaaaaacacatgactgtttacctggaattttacggcctatcctctgcttttacaagttcaaatagatttaccaagtgtgtcactttcatttggaactagtgaaagaatttcatcctcagaggcaactgggcaaatgcagtgcgacattattcggctaggtacagtattttgttttcaataaatcgagatggatttttttatcactcgaggggacatcccctcattttgtgcatgatatttgaaagtcatcaaaaaaattataaaaaactgttaagatagatcaatatatgatatatcttttcacaattaaaattcgacttatacaattcgaaacaaaaataacaaatttaatagtgaattgcgcattctattcattgtcaaatttgttgtttttattttaattatataagtttaatttgaacatgcatgcttgtgaagtgatatatcacatgttgctctaacttttttttaatttttttcatgatttttaagcgacgcgaaaaataaggggatatcgcgttaagggattattagagtttccccaataaatccactacttggttctggtcgacagacaacttgtgaaaatgaactgactaatgctaaaccaataaaactgagatgagtgatggcaaggttcactactcaatttttttaatacaccagaatcattaatttcgtgtgtgcataaccttttctttacaacgaaatatcttgttatgcttgcagtagacagtacgcaaaaaaaaaacgaaatgtaaatttcatagatagtgctctcatcaagcgttgcaaaaacatgtactccctccattccaaaatataagtcacaacgactttttaaaggtgtttcataatataaggcgtgcatgcatgcatgacaattaattagcatatcttctctcctaaattattattttttaaatcatacactcacaagatgtttaattctattgggtgcatgtatggatcgattcaaataaagaggtggtaataattgtttcttggtctttgaattaagggtgattgtaccttatattttagaatagagggagtaataactatagcttatcttgaaaagaaaaacatttctatctttcaacggggttgaaagttgaaacggtggcacaatttcccaactttacaagtttttttattctagccgtatataaattttgacttacattttaatatctatcagctctgtttccatagagacgacgtcatttcttactgatttggacaattttcatctctactttattcaacgggcaaaatccacgtccctcctttcgaatctggagcttcgatgagctcgtgctcctcggtttctccatcttccaccttggatacctcgtaatacttatcacgcgcaaaaatagcgtagacacaatccttctccaacccatactcatcagccgaccgtgaagcaccaaaatagcatgaagctgtcaagaacgcacggccaccaatgtcctcggctacgcaccattgctgcttcgagaaatccatcctataaacagtgacatcgtagatggtctccatttcagagtcatacatttggcagaccatgtaaagttcatccaaggactccaccaggtacacgtttgccat

SEQ ID NO: 15082 - DNA, 1490 bp, Oryza sativa
aggtgacactatagaatactcaagcttcacgctggacagtaagtgcttgctcaagcaaattctctaacctcctctctggtaccataacagttgggggaagcaccttttgcaattcctctagcagcttcagccgtgagtttgaagattcaatgccaagcttcgaaaaaccaagtaatacatgctgtggagaagaaattatgcagcctgacagttcatgaactctttttttgttgacaccaagtggtgtaatttcactctgcaaagtccttatagcacccatgacattgtcatttctcaaaagttcaagaaatttttgttccagtatcagaaatatagcagactttacaatgttttcgtccaaaaggccaaccttcttcaaggtaaccactgcactatcccaattcccatcaagtacctgccttctgaaaagattcactgttggggaatgcagagttattcctgattcttcctcaagaactgctccgcttttttcataaccaaggctatacagagcctttgtgattatcctcacaaattcatccctcttaataacacctttagagccaaccataacttctttcccctgggaaggcaaaggtctagccattgtgcttcccaaaggagcggcaggtttcaagcaagaaaaactatctaacaaacttgctggttctactgaggatgctcttgcgcgtttcgagggtggttcatcgtcttcaaaacctcccatgaaatgttaaaatcagcccatatatatttttgacttctagggagatgatgttatgcagctccgagcggaatgcttgcaatgggtggtgtataacgaaaggacgttgctgcagagaaacagcagttgaaaagtgtaagttctagatgatcaaatgcagagaagggtctatctaagtgatcatcctatctacaatttgcagctaatgcccacccaccaggaaagtttgcatagcaagttacaaacaacaaataaaaccagcaaggcatgtaatgcgtgaaatacaattgaagcccggacttgatcggccttagtgagcaaaaaccgcccaagcgtatcaattagcgtagaaactgaacatcctaacatcacattgaatacgcggtacacccatcatcgccgcctaagcaaagattggatgaagcgatcaagagcggcaagcatggatcccagcatccgtagtctgtcaagacatgaactggagcggctgtggtgtggaatccacggccacagaggcggatcttggcagcggcggcggatccctgcggcgctggtcgatgcagacgaccactgaagcaactgtcggcaacgctagtcccagaagatttggggaaatttggccccaacaatccctatcaaaccttaccccccaaacataaaaaaaagattggcaacacgcatgaaattctgattgatcccaaatcccaccgcgcgatcacaaattcctgcagcgcaaagcaccaatccatccagaatcacgcgccct

SEQ ID NO: 15083 - DNA, 3689 bp, Oryza sativa
gcccaacgaactctgcaccgactttggagggcgcgatcgattcgatgcggagaggggcgggcgcacgggaggacgaagggggcgttgggtgcggtcgccggcggcgggaggcggcggcggggggcggagatgatgctttcgttcctcgtcacgcaaacgcaggaggaaggaggaaagagaagggcgcaaggcaaagggaggagggcagtggcttggcttgggtagttcgctagagagagagagagagagatactcctagaagaagagagaaaagaatatagaaaatgaaataaaaaaagaaaagaaaaacttctagggaaccctacttctatccttactctattggaccaggaaggaactattggttagcaaactcgaaatgggccttaaaatggcctgtgttgaatgaagtaaaatcatgtgtctgagaagaagaggattgaggagattggaaagatacgcaaaacgaggtgagccattagctcatgattaattgagtattaactattttaaatttcaaaaatagattaatatgattttttaaagcaactttcatataaattttttttgcaaaaaatgcacgtttagtagtttgaaaagcgtgcgcgcggaaaacgagacacaatctcctctatctccctagaacgaacaaagcctaagacatgtaaaggttgataatgccacgtttgttttttttacagctagcaaaaaatgcttgtgcaatgcaacaggtgaaagctactttaatcttgttattgttatacggtttatttaaggtaaaatttattctggaaattcatttggatatttatttttttagaaaattatgagcttcaattaagaatttaggagtccgattgccttaagttagttcacaagttttttttaaaaagagatttcttatacgactccttccgtatttttaaaagttgttgagtttgaaaatgtaaaaattatataaatagatttttcttgaaaaatactttcatgaaagtatacatatatcacttttcaataaatatttttatagaaacaaggagccaaagttgtgttttggagaccatgtcgctgtccaaaatgacttcctttacgagtacggaggggtacttattaaaggggtagggtgtatgtttataagggtgagtgtgcgcatgttacgagcgtctgcgtttatattgtgtttctaaaatggacaaatgagaaggatgtaacaatgtaaaatacatcttaatactacttatataattcttttatacatgttatgtatatatatatgattaaattattaattatccaaatattgttgacaaccaaatagataaatattatacatgttgtataaatatgagtatatcatgtaaatatgatgggaaaagatcgcacagatacttccctatttaaaaaaaagatcatatagcaaaaaatctccaacgtttaatttggccatttattaggttcgaaacaacttttttttgtgtcatttggccatttatttggttccaaaaaacttaattttgtctgtaattttgccaagcatcccaaaccatatcaaaatcaatgtttgtaaacattttacatttagctttaccttggtgccaatccaaccactccttgttttctgctataaattttggttcgactaaagcttttgttcatgccagtccttgtaatattacttagtgctaacaaccatgggttctaattatattaaccatgctacttttcttttcatgtaaaccagattgaggtgtgcattggcataaccttgtgttcaaaatagaagtatgctcacctctgtcactaaccaagtgtttggtgtcgcaatatggatattatttgcaccacacaaatgtcatgattaaaatcttaagggaaataatgtgagctgtatgatgcgactcatcattcattaaccaaaactgtgaaagggtgcttttccacattgtcgtcctaacaactttaaattgtcaattcttaatttcaaaatctttgttgtgtattagaatacatatttctgtggtgatacatgcatggttaccagttaccacttgacaccagggcagagtatgaggtatcaggtggatatgtgttaatatgtgatggagggaagtggaatgtcatcactttcggacaactccgaaaatttccagaatacagaaactgagatacacttataaaaaatgattttgagcacattcatcacacctcatatgtcaatgcatcatcaatcttaatagtgcggttttcctaatgacccaaagaaatgaaaatatacaatataacctttgatcattgccacaactcatagttttgtcacattcgttgagatatgcattgcgctacaaatcatcacggactaacaatccttcgcattcacttagtaaaacttgttagtcctctctaattgtattgtcattaatcataaaaacaaattaggggcctagatgcactttcagtaacatcctcgttttctattagcacacttcctaaatggctaaactatgtattttttttctaaaaaaagtacttttaatctataagttttcaaattttaaataaatatattttttcaaatttttaataattaatacttaattaatcgtacactaattgcttgcctcgtttcccatgccagaaaaagctcgccccaaaactcacattcgaacttagccttatttgtttaggggtgtccttagattttttatttttttggtaaaaatgtagaggctaaataaataagctattggctttttaatcatgctttggaaatttcatagccgcaaatatactattagctattagcttttatgacaaagtctaagcccaaacaaatagatggctttttctaacaagctttttatgagcacaaatccacacttcagttatataaatcgacaagctatcctttaataactttcctttggcgttgtgtgttggttggagaattcactatgcccatggttttcaaactaaaacaatggtttagttcacatataattaatgtaagacaataaggttgttagaagtacatatatgattaaagataagaatcgaatacaaactagagagataaaatcctagagataatctactctaactttgtcttgtacttcaaatctctatttcctatgtactttatatataccccttaagagtcaatgcaacatacgacagattattagggtttctacatattcaacgtgtttaatctaagaacactaagtagaacacatgtatgacagatatgtgagaatgcgattttgccttttggtggatttgtgaggctaggactctagataccaaaaatacaaaaatgttaccaaaaaatacaaaaatgtatgagccgaaaactatagataccaaaaatgttatcatgtcaccattttgagagaaatatatcttatagaaaagatttaaaatattatgtccaacatttttttacgacatgacattgcgcaaaaaactgcataggacatagtttcgtcgattcaccggcacaaatagcatttccaattcaacaatgttctatttatcacacagagctcccaacatttcctgtatattatggcagaccaactcgaagtgttgaaagcatctaccaggtagtgccaacaattctaggaaaagctctcatcctctccttcctccggcttaacaccggcggtctgttcagggttccaaactcataa

SEQ ID NO: 15084 - DNA, 1666 bp, Oryza sativa
ttcttttcccatggtaactaaacattgaataatagaagcctgattcaataatagaagccagaacacaaaagtttgcaattcagccctcttctcccatgcagagtcgcaggtagcgcctcggataaaagcaatacttaggccctagtcttcagcggcttcaatatacgagaatgctgcaggtttagtgacaaacaaagtcgactttttaccacctcaacaacatactttactctttgatgtggagaagacagggcagcaccagacgtgtgaatccaaggccttccaagctacatactataagcagggggatgagtctattttgtaaccatacattccgcaatggactggatgaaatccctcatatttaatccttagacttgactagaggaatctcactaccaggaatccttaatggattgggtgcacataaatccgcgaggaccattgctatttggattgcagccataagcattgtagcgctagagcctaccgggagaaaagaaagtctcatgggtctctccgactgtgatgagtgacatagagaagaagagaagattttttccattttagcacataagatagcagtagaagacattttttccattcccgcttgactgctttcctaaagcagcctaaatatgatcaataaaatatcacacatgcgccattactatgcctcacgttctagttctaaatgcaaggaacttacatatattagtataagaataggaaagggcttggagtggtagatccactcatcctggctttgaatcctagttcagttgccacaggaaccttagtgctgcgtgtgtgttgtgggaaggtaaacttgactagacctgtgtgtgccatggcttcttagccgatcagtgaactgcgttgccgtctcaaagctccactccacctgggcccctgcacatcccgaaggtggccgaagcccctaacatcacgccctctctgttgccaatccgtgatggatctacaacccaaactttctagccaccgaatttggtacgtcccaaactcaaggatgccagatctcgtcgttgtctgtcttagcctagactcgacttcgatgatctaggcttggctggatttgacgatggtggctacaggtaggtagggagacgctgtcgtcggataggagggtagccaccgagttggagagtcgatctctccctctttcaaatcaggtctggtaatgacactataccataacatacataacttcagtacccagatggtaccataccgacctgggatgagatatcatataatagcaatctctaaggaaaaataattattttacttctttttttttattttagaacaaagtaaaatacttttatttggtaccgcaatgctccgaatagactaaccttagcactctggatggggtaaatgatgatggattttccatcgaaaggacaaatcaagatttcgatttacatccccaaatgaacgggaggtctcccaagtctccatttgttggtaattaccccacgatccacccaaaaccgcgtccacatggatcgcaagcgcccgcgccctccccagccgtcgccgccgccgccggtggcctcctccggcgcctcctcctcctcctcctcggtgctcgacgacggggacctcctccgtgagatccttcttcgactcgcccacccca

SEQ ID NO: 15085 - DNA, 21894 bp, Oryza sativa
gacctccacttccacctcggcacggggatctactgctgccggaacgcccgcctcctcgtgtgccacagggccggcggcgagtccacgctccagctccgccgcccgctccatccggcgagcgacggggcggtcatctccaccttccgcacgccgcctcgccctctcccgcccaaccagcgccacacgcggtatatcctcctccccgaggacggtggcgatggcgatggcgatgccgtggcgtgcaccgtggtgaccctggtgagcagcgagcgggaggtcttcgccaaggtggagaagatcttgcgagctggggtctgggacgtcgcgcaaacctcggcgcccattgagctaccggcgcactggaggagatcattgagccggggttttcttgtcaatggcaagctgtatatgttgggcacaacagggtacattcttggattggaattggtgtccatgagcttgttcttcatcgaggtccccgatgccgtgcgagatgactgccctgaaagctttcagctgagcgttaagctgtcgcaagcggagaaatctgggctttatctgatccatgtggaggggtttaagatccatgtttggcttcacggaacagatggaaacagctctgccgattggaatctagtaaatactatttgtttgcgcgaggtgtttggtcatcttgtgaagcctagttgggagtcaggggattcacgcattagtctgcctgggtctggggacaacgctgagtttgtgttcttggaggtggatggtgaggtcttttgcatggatattatcagcaggacagtggagaaggtgtatgagatggcaatgaaggatgattttctatttgagatataccccttcatgatggtttggccaccaatcttcccagcattgatcaaaacacatgaaccagagtgattcgacaaggtttccctcgagatgatttgcataatcaagtgatgatatatgatgattctgctacttctgtagtgaggtaattgtacaaaataaaattgatgaaaagtttgatatccaagttgatttacctcatgattgcccatactgtttaaaccaaaggtcttcttttcaatgccataatcataagtcgcatgtcttttctaaaaatacgtaatcccagcctatgctactgtttcaatgatgataggcaaaatttgcatcccaccctcaagcactagtggaacaatcgatgtgaagttaaaatcccatttatgtagctagtagggaacaatgcactaatatggttcacctatataaatgtccattcttgagggactttagctagaaatgatagttaatttgtcagattttgatgctttactgtctgttacaatcaccacaacaaaaaatattttggcatcagcatatctaaatcactagagaaactcactcgcatttttgttagtcatcattgtcatgactttgttacaagggaaaaaaaactctcatgcttggtggagatacaataaattaactggagcagggctgctggagaactagataacagcttgtacatatctgtatttcaagacatctcttacctgattattgtgagaagtcaataggataaatgcatatttttggtatacgcacgatgcattgttttatctgaatagattggaaccggtgaactgttatgagaatctctttgttcagaaataaatctggacagtaaacatttccccatggctcaagaaggtggtgggctttagtcaggcggctcagcggctgggtggcgcctaatgtctaattgacgcctaggcggtgcctaggtcatcaactagtcaaatccaagaaattagcaagcatattacataaaagtatactatgtaacactaaaatagcaaccaaacaccacccaaagtagttcagctgcctaatgcaccatctaatgcctaatcatgctacccggtgcctagtgcctaatggtcacctatcacctacttttagaacactgattttgccaccaaaacataccttttttattatcatttttacttttttgtttctgtgtatctgtgcaagttactgtcatttgcactttctgtaacatcaggtgtggttgcacaatttaatgctaggattccaagcatgtttccttggtacaggtctccataggactgcactagaattctgtactattacaacatgaatatctccttaaaaaggaatgacataaacattttttctagatgaggtgatttgcactcagtctatggcaatggcattcatcacctttgaactcttattatttaatagaagtgttccataataagttgagtttcagtttgctcctaaatcttggaagttatcagagtattcagaatgtaatatgcctgaattactaaagaatttaagacattgtgcaaaaccaattcacaaccacatacttaatagtttaaaattttccaagttctaagaggagccctgaggatgcgtgcaccaaggccaaggcacaggcgccacagtgctatgttatttcctaaattccatatactatttgtaaataaagttaagaattggcaacaaagagttcacgtaaagcacatgcaattgtcatgtttatcaatcaatttgtatttatgcttattgcacgaaaaggatccctgaacattcgcactagactcaaattggtccaccaactactaaaatgtccaaagtagtcctcaaagttccaaatttggctcgttttatccattactgatttgacagggcaccatggcactctgagttagtgtggtcactgttttcctgaatcacacatagcaagaagactgaattgctactccaagcaatttaatcacaatcatcaacactgattattccaaaatttctatagatgatcactatccatcgagtaaattgcttggatggcaattggacttctaacagtgctgagcaagaaaactcactgtacagggtcagcactatggtgtcagagcagctcagtatacgggctgaaatgaacctgttaattgatgctctagaggctaacgtttttccgctttcatatttgaggaggcaatttcgatctcatgaaattgagggaccatttggtgattcttatgtgtatgcattgattaactattgagtgttgacacctgcagcttaaatttatcttatatcttgattcagtctggagtaaagtggattctagtcttgttcttggattatggcttttataataccatattactgattacaggatttaaagtaatttttcatttaaaaaggttaccattttgcgatattcaatactaccttgttatgtggcatttcttttttatgtttataatatatggttacatactaacagaattaatattacctaagtatttttaaggttacatgttgacaatataatatttgaaggaaatctaacagtatttggtgccaggctgcccgcaggtttgactctttaaccttctattatttttaaggttcttgattatactgctgcattatttgagctatgaacgttttttgctacgtcttccttggctgcagactcttgctcttatctacatatactataatttgtttctacttgatgattcaatgttcttaactagaaagtgtcttcaagaatcggtgtaatttattttctttgaaacaaaagacttgatgaacttataataccaaagcttttcatttaaccttgataattgccatttgtttcagtacccgagtctccaatgagcttaggttccggttgtccaagagctgtcatgttcgatgtcattgttgccgtcattgagtcgctgatgattggctgctttgcatggctgtcgtgttgattctcggagatcacttctccatcatattcactactcaccagcgatgtgaagctgtggcaggccgttgccaagattgcagggcttcttggtttgaccatggtgctcaacagtgtgcagcctgtggtgtcaggtaaatctaatgtttacattttcagctcaaagattctagtctacaggtggatcttgacacttgacaggaggtgcctctgcccaaaaaaattgaatttgtttgaatttataaattcaaattcagtgaaaatctatccaaaatttaaaattttcagtttgcaaagttacatttcccccctgaaatttctgaatttcagtgccctgattttttttcttttggcattcgaaaattgtgaatcctggtatagtctgcacttacacatagaaaagcagatagcttggatatggaaataaaacagattgcttagtttttttttttgtcacaatttcaatttttatttttctttggatacaaaaatgaaaaacagataactcggatatggaaataaaacagatagctcagttagtcctggaagtgaaacactgtcataatacctttgcttttagttagtcattaaatcaaaatgtctcaggatcctcgtacatagatacttttaggccaaaaaaaattgcaaccgagcactctagtttcgtgacttttatctaggacactgcaaaatcatgtcactgccaccaggtattacattgcaaagcatttatactatggttataaattaaatgtaaattactttgtcatcgaacttttttcagttttgtaagtgaatggtcaataccatactctgttactaatttgtttcgacctgcctagttttcgtgggcacctaaatctaaacctcgctcatcttcattctgccatttgcaggccacacgtgtttcaacctgcgtgcaaaagtggggaggcacagatgaagcaatcaagcttctcttaacgggaaattagtactggaaattttacccttctgttctgtcactctgcaaacctgctacacgtgttttagggctcatatgaaattctgaatgatattttttttcttgccatagaattcgttcgtgttttacaatttactgtcaagtttgcttcaattcccaatatacacacctgggaggacttgtgcctctgatgataatactacgagtaaaatgaggcaatcaacggattgtttgaagtgaaggattggtttgtagcaactacggttaggaaaactcgctagagatagcgcaactatcttaggtgaacactccctttgaaccaatgttgttcaatcctatgtttttttctttggtgggtactgcaatttatgcactactataaaaggtttaacactgaaaattatgtgcagctgctgtttaatttaatttaatttaaatctgaccattgtgaccaatttaattaaggtagtaaacttagtgataagttcaagtgagatatctaggttaactagaaattttttactactggagtagttcttattattctgaacattgcttagatataccaacttttcatgtttgatttatgaatgcaaatgcaatacaaagcatagacaagccaaaacaatttacactgcaaggagcaaagaaaaaaaacaaacttgccactgctcacatcttcacaaaattgtggggataaatactacttactccgtttcacaatgtaagttattttaacatttcccactttcgtattgatgttaatgaatagatgtgaaacggagggagtacccatcttctaaggaaccttaaaatcagtctactctaggctagctatagttcctgtacgtggtgtcctcgttaactagatgcgtccactttcttcccccacgccgcccaaagtgcttaacctgcatcaccttgggcaagacgctcacgtccatcttgtccaacccagtcggcccggagaaatctcgccggtagatttcgcatgctccggcggccgtatgcgccgcgccgtcggcgtcgtcttggaagaagcaacccttgtggtagtacctccgcatgaacctcatctgcttcttgatcgtcatcttcttgggacgatcatcagcgaccgggttctcgtcgatgccgctctcctccctgctcctcttgaccctcgccgcctcccggcgccgccacgactcgtgctcctcggcttggtccacctcgtcgtcggtgtccacgccgtcgatggcggcttcggcttcggccgaagctgtggtggcggcgaggagctcttctttgatgatctcttggagcaggatccgcctcgtctgagccttcctgtcctcgagcctcttcttgtccagctccagctcaagccgccggcgctgccgatgctgttcttcctccctgagccggatggtgtcgcgctgtgacttggggacgaacaggggcgcggccatgtagacgacggccatctgctcgtcgtccgagtccgattccgccgccgtctcgtcggactcagacgccgcctcatcctcctgatgccgctggtgatgatgatgaagaagaagctgctcctcctcatgctgcctcaggagcagcgccctctcccttatcctcgctctgcgctcctcccgggcatcatcgtcatcttcttcttcctcctcgatctgatcgggctcatgccagcagtcaaccgccggcgccgccgagacgatctcgggaggctgccgtacacgacggcggcggcggcgcggcgacctcagcgcctcctcctccacgtgcttgatctcgtcaagcgtcgagacgagacgtgcgtcgtcctcgtcgtgagcgacagcggcgcccgcccacgcccagtccggcgccctcccgggccagtagcgcctgaccttgctcaggccggtgtcgccggcgcgcgccgccatgcgcgcctcgcttactgctcttgtgccgcgcgctagcaagctaatggagtaaggagacgggcagggcagcagctataaataggcgcgcgcctacgtgtaatccgagtcggagatgggctacaaaccgagtacgagttggagtcttgaagatcaaaatggttcaacctatcggaaatgggaaaaatttcgggggtcagcgaaatcacgaaaattttcaaacaaaatttgaattctcaaacaaaattgcagaaattttaccgagaaacaatgaacaaaaacattgagtccatccacagcacggacaggaggatgaaacgcgaggatgcgagagcgtgcggccgtgaggactagcaaatctgaatatgaattcatttccagttacggggctacagagtcacttcgacggttcgatttgttcgtggatgggcctaatataatatatatggctgttgaagtgagagaacgggatcggtcgatccaacggtaaatcatttaccatgtttcaacacttggttttccttgtttgaattagttttttttattggatgacacaggaaaaattgaaagtacaggatgcgcagatgatttcatcgcgtgtccggtgtccctccatgaacacgcaacccaaatttgatatgcaaatatagaaacgattttcgactacaaaaatacattcgctttcacttttgttttcttcttttcacggatccaatttaaccttctgatttatgaattcatcaagtgataaactgaaaaaaattaaccaaaaagatacaaatcagattgggcctatccgaaaagattgggcatgtgtcccatcaggcctactacggcccatcacgagagaagaatctgaagggccggccccccagccttttaggctgattaggtattactcaatccgtttcagattacaaccatctgtttcggattacaaagtcgttttgattttgatctaaatttgagtaaattgtattggtggtacacaaactattttggtgggtgcaattcagtacataaacttgtaaaatgctcgtttcagtatataaacttgtctagtttgtgcgaatgaggaccaaaatatgttggcaatgttaattttacgaagttgacgttgattaggatgtgacgtgcatacgtgtagtgagtatgcataagacattcaatatttataaatttggtctatattgtatccttcatcatggaaatgatgaatttcatatatttctaacatttatatcattgctcgtcttttaatctttttctgctatcactatatcctattctattttttttattgaagaggtacatctctaatagcaaccttctcaaatatatgccctaaatcaataagattatccatatagtgtctttttcgccttcctccgcacgcaatagacaagttcatgcacaaagacgagaattttacaagtttgtgtactagattgcacccacctgacaagtttgtgtaccgacgatgcaatttactttttgttttattaaagctatctctactattataaaaattgaagaggttttactttttggtatgtcatccgtatttgagttgattttttaagttcgtttgcttttggaaatgcagatccaacggttcatacggtttaagattcgtgtatgagttggattttaacttcatttgcttttggaaatattcttttaaaaaaacttacataaaacttgagatgaaagtcggacttctaattgtagctcatgattttcttaaaaaagaatatacaagcaaattcccacattaaatttcatcatagctaaaccgtataacaataataagactaaaatagcattcacccgttgcaacgcacgggtattttttctagtaattaaatatattttgggatgaaaacatttatttttttaatacaaacttaattaaatttaaagcaatttgattttaatcaaaatcaaaacgaataaagggagggagtactaaggccgtgtttagttgcaaaatttttcttcaaactttcaactttttcatcacttcaaaactttcctacacacacaaacttctaactttttcatcacatcgttccaatttcaaccaaacttctactccaattttagtgtgaaataaacacagcctgatctaaacgagcatgtgagtcacaacacagttacacagcagcagaggccagaggctgagggcaagtagcggtttctccttccttcctcccgctctccccgcccgcattaacctccacgagcacacgcactgttcctcccttcccaccaccaccttcaaaacttccactcccaaacccaaacctcctctcctctcctctcgcgctcccagcccaccatggcgcagcagcactcgccgccttcacctcctgccccgccgtcacctccgcccgcgctgccgtgtgatccgatgccgccgccgccgcgccatgacgacaccacgctcacgctgtcgctcgcgccgcccgccgccgctcgcccgctgcaggccatggtggcgcgggccaagtgctcgtcgccgaccggggacgcgccgccgtgcaccgagtgcggcaggcagttcctctcgtggaaggcgctgttcggccacatgcgctgccaccccgagcgccactggcgcgggatcacgccccctggcggtggcggcgcaggcgcggcgtcgtctaccgccgccagccagttcacgctcagggagcgcgaggtcgccgccagcctcctcatgctgtccggcgctcaccccgcccgctccggcgccggcaagggcaagggcaagaagcgccttctcgcccccgccgccgccgctgctcctcatcattccccggcaacctgcgccgaccacaagtgcgccgtctgccaccgcgggttcgccaccggccaggcgctcggcggccacaagcggtgccactggccggatcgttcctgtgccgatcaggcgatatcgatgctcgccgtctccaccgccggcagcagtagtaccactaccacgtcggcatcacctccgccggcgccggcgaccgccgccaccgcgctggacctcaacctgaacctgccgcctccattggcgcgtaagaacctccaagacggcggctcgaacgagacgttggatttgaatctggggtcacatagatagatatatatatatatatatatatatatatatatatatatatatatatatatatatatatatatatatgtgtgtgtgtgtgtgtgtgtgtgtgtgtgtgtgtgtgtgtgtgtgtgtgtgtgtccagtttggtaggttaatttgtgtatgtgatgatgatgtgcaggtgtatattgcttttgctagatttgtgtttgttaaattccattcgaggcataagcggctctctggaatggaaatctctgcaagttcttagctttggttacgtgtgcctggttcagataagagcgtttctaatcgttctgaacacaggtaatttctgtttatcgatctgaaccatgtgatgtacttagcaactgtgtatatgtgtatttctgtaagtgaatgtgtatataactatgtactaattaggttagtaatgtgtgaaaaataataacattgtgcaatgtgttagcaactatgttatatatatgtgtcaaataagaacatgggcaatgctagaaagttttacattatgaagcggagtgagtatgtgcagaggttcatcgttgctttgcgctgttccattcgaggcataagtgcactgtggagtggaattactctctgtatgcttttagagataggtgtgctgattgatcagaagagcgctttctaatctttccaaacggttttctgttcttcctccgtccaaaaaaaaaaacaatttaagtaagaatataacacaatctagtacaacaaatcgtatttctatgagaggaagtagcgaatatatgctaacatgtatgggtgaaaataacatgttacatctattatgcaacaacggtcgttccttgttttttctgtaaaacctgaggtcacgagttgcaccagcaacttgaagtcttgaaccatataaaaccgcaatattaattaatccacaatattactcagataaaataacacaatttgaactgcagcctcagcgtatatagttattaatccagcaagtatggagtggtacatatacatgtttacaaagggaaaatgaacatgcaaaagaaataaaagaaacttattcaatctactgtactgtacaaaaactaaacttcacaatgaaaacctacaattttacttgtatctgggcaactcaagaagacatgtggttaactgaaaactgcgcacagaaagaattattgattcactcttatcatgacgattcaccaacctattcagcaaaaattaggcttcttatactaccattgatttgggaatgcttctctgtagctcatatcttcagtatgtgaaacttctcttattgtcgcatccctagctcgagcattcagaagcctctctgcaattctatctttggaagtaactttcttcttcagcatcgatgccagtgttggtccctttgtcttacctcggcgtccccgtcgagacactgctggcgaagggaggtcatagtctgccgctgagcgcgaggttgaagcaagagccgcttcccgcaaaacatcttgattatgctgacgaattctcgctcgttgggctttttccagagcttttttgtcatccctgtctcttttccggacattctgcactgcctgtctcgccaactgctccactgtaattttaccgaggtcatgacctacatcgctgtcgctaatgtcattatttatgtttgccgttcttgaaggagaggactcataaatacattcaccatcactgcttccatctggcataatcatattttctcttacatcagaactgtcttcattcggatcaataggacttactgctgcatcataatggccatcagtctgcccaactggatttccttctgcatcacaatggccatcactctgatgaattggatttccttcggcatctcgtggaacaataggcccatgaaacgggcatatcttgagatctcttctctggcaaaggcctcctttcttcagaggtgcaaggcatggtagaatctcaactggatcttctctatatattgaactatgaacatttaattctgcaatctttgcagcaggtataacagcatcattatccacccttccccaatggctctcgagctcaagtcccctttggtttacaagtgcatccctgttagaaccccaacgatccaaaacagagctccatggcagcacaggggcttctgcatgcagctttgccctctctggatccagctcttgaggactattgccagcattaggtgccttgccatcatcagtatccgtgccacctactggcttctttccctttctagtgtccttgctgctacttgcaacatctgcactggtacctactctaccagggctaggaacctcaatattcccctcaacccaaaagtcatcatcctcttcctcctgaacacccttccgcctatggacattgtcaagattaagaccaagctcactacaccgatttctcaccgctcgtatttcattcttaacatcaatgaattccttcaaagcagaatctctgaaacgattatctgcgagattgaccctaaccagcacagatatccattcctgaactgtgaccaaatgctttgacacaaggagccgatatgactccctcaacgcgtcgaaaactgcttcattctcctgagtctcaggaacccactccccagccatcaaagaagccatcctaatactccgcatcgccaaagaggcaatctcctgctcctcatcctcatcatttgcataattgttaaatttttcactctcgatgcgaatgatatccaacccattgcggatctcatcaatcgcggagcggatttcagccttaatcgctgccaggtttcggcgcaactgctcgacctttgcagttaagatctcctgcgtgcgagcctcccgcgcggcacgagcctcgacggcggcacggaggccggggaactggacccgggcggactccttgaggtactcgacggcgaggcggagctggcggtagtgcgcgccgaacaggtggtgccagcgctcgagcgcctggacggcggccttgcggagcagggtcgcggaggcagcgggcggcgggagcgggtgggcgcggcggaagccgacggcgagcgggaggaagccgtccagcacgtcggtcagcagggagcggaagagcttcgagcgcatgaagagctcgtcggcgatgatgaacgcgagcagccgcacctgaagattgggcgagttagggtttgggcgaattcggcaagggaatcaaaccagcagggaggagcttactcacgtgggcgtggggcttggacatgagggagaggaggatccggaaggcgtcgcggatggcgccgtcggaggcgcgggcggcggacttgatggcgcggaggagggccgggtcgacggagggggaggtggtggaggtggcgcggtctatgagggacgcgatggaggactccgcagaggaggtcgcgcggctcgaggccggctcgccttccggcggagggcggctggaggaggaggcggcggggcccggcatcgccggcgattgggggcggcaggcagaggaagaggagtaacgatgcgatttgttggggatggctgaattgaagttcgttggctctatgacttgtgggcccaggatgatggaccatgtgatcgtgtcgacgtgtccaggtcggtttgtttgaggctagtttacgctcggccgctcggttttaagagcgagatagtgcaactggctccaagattggcacatcagcttattataggtagcgttaaaaactaccaattttaactaattaaattaaatgattcatataattcctttcgtcacatctgtgattgcgtgctttcgtccgtcattaatcgcgctaatttttcctcgtgcgctctccgattcatccgagtgttcttcaggcaactgagcccaagcaaaaacaaattaatgggctcaacatatgaaggcccacacatacagatcgaggcccaggtggaacgtcgcgtgggccacgcacgtcgcggactccgttttgtccagggcggcctacacacggactttgatgaagccatcagggagagggatctacacacgtctcctctgcttctgcagtctgcttgctgtgtatatagtccctccatttctaaatatctgacgcatttttttctatcatttgattcatttttaaatatatttatatgtatacttatagttttacatattttacaaaagtttttaataagacgaacggtcaaatatgtgctaaaaagtcaacggtgttaaatatttagaaacggagggagtatatcttaactaattaaaatattcgtaattttccgttcatcacaagacggacgaaggtgtcttcgtccgtcggcggtgcgccttcgtagcccccgaatcccaatcgctcttagaatcagaaacatggaaacacttcccaaaatcggcacaaccaaaactcaaccactctttgcaaaaaaaaaatcaaccacactcatcacaaaatacatcacaaaacttcacaaaaatatacatcaaaaagaagaacaacaatatacatcacaaaacttcactcgcctgccgccggatccgccctcggccgttgccaccgccgccggatccatcttcggccgccgccaaccccgctaccgtcgccggagggagaagagttgcggcggagggagccgccgctccttatccgaccacggacgccaccgacaccggatctgccgcaggaggaaggcgggtagggggagggagccgccaccgctggatccgcccgcggccatcgccggcggatatgccacgggagggaggctagagggggtggagggatccgccgccaccaccctcgaatccgctcgcggccactgccaacccgccgccatcaccgccgtatccaccacaggagggaggcgagatggagaggaggaggggcgagggaggcgagacagggcggagggagcggctgccggcgagggaggcgagacgggacagagggagccgccgcctccgccgctcgtgggaaggagggaagagcgcaccgcagccgctcgtgggtgggggggaggagggcgccgccgtcgctgttcggtggcggaggtcaccgctgttgccgtaagttttcgatcaagagagagagagagatagagagagagaaaggagattggaagtggggaggggggaagaattttagggttagggttttgctgcatatatttatattggttcaatctggacagtccattcgatagaacgactccggcttctcccgcatcggaccaccggactattgggcctccgcattattgggcctccaaatagcccacaattaaaatcaatgttttctctctcagtaattttaagcatctttctattttaagaaatagcattaataccattttaattgtttatgactgcttattaatttaattccaactaaattcaataaactaaaaatttggctagatttttctatttatttttcaactaaaaatgcaattatttatttctcatgatatagaatttaaatttagactaaaattaaataatttcaattatttttaattctatatgaactctattcttcttccaatattcctattttttattgttctaattagttttctatatggactttaaactcttctttcaatattttttattttgaattttaattttttttttctaaattgtattcctatatgcactctaggcgcttttggagaatattctagactcctcatccaatattatttatgattggacaacgcgattttttttaaaaaaaatgaaagagtccttgtctacaataagttctccttattttttatattttactccaattaatatgagaatttctagaccataagagctaacgtggatgctcttttttctataaatttactaacttaataacattagttttttcccgttgcaacgcactattgaataataatttattatgagctactatatttctatgtatcatttgagattttttatagcaagcaaacattcaataatttattatgagctactatatttctctatatcatttgagactttttctagcaagaaaaagtaccaaaacagtgtgaaaataactttggttaataccgtagcgaagcacggacattttgctagttcatatagtaagcatatactccctctgttacatttataagacattttgactttaactaaagtcaaattgctttaaattaaattaaatttgtagaaaaaaataacattttcaacctaagacaaattattatgaaaacatattcaattattgatttaatgaaactaatttggtattttaaatattactgtatttgtctataaacttcgtcaaacttaaaatagtttaactttgaacaaagtcaaaatgtcttataatctgaaacggatggagtattcttctaaggccttttacagtgtggtgagctggagcgttatctcgcacaccacgtcggacccgcgcatatgtggtgacgaagcatggtactctgtttagtcgcccaccccctatctgggcaatgagttttctcgtcgaaaggaggacgcgtgacacagggaatcacctcgcgtctgcgctgtggaggtcgtagcttcaatcctctgctccctcgctctgcatctttgttcccgcgctagaatcattgctcccgtccagctctgtctgcatcgatgcgccgtcggatggggaggagggagaaatggtgcggcggaggaaaagcggcgtggggccggagagctcgttggccgcgcctcttgatctgagccgcctggagctcgttggccgcgccgccccttgatccgagccacccggacctcgccgcccacgccggctctcgatttgagccacccggagcgccaagttcgtcgtcgccaagtgtccgtcacggtagggggagggaggcacccacgtccacaaattccaccctgacgaggagagtagggggaggggagttgatgtcatgtgccagttcagggagggagaggaagagagagaggggaaggagcggaggttggtttggtgcaggagagattgatccgggaagatgaagagaaacgtcgtggtggggtcggcctcaggaaaataaattgatggggtccacctaaagctacactacgcgtgcccgcactgtgaagagaggtgcttcgactcctttttccggggttttctcctatgtggacatatgggctcctcacttttgtgggacgcactgctactgccctaaccgtacacagttcccatcgatcttcatgtccaatccatcttctagcttgctacaactccctttctagtttccacctcttatttgatctatctattgttatggagatatgcaggttgcaagcagctagcaaagatggatggacatagagctggtgccatggctagatgactgccagcgagcgaatcgtagcaaaagcgtggagtgcgggcggggtgggacaacaggcagctgcattgagccgcttgctccatggagcatggagaacgtagaactatcgtccctctggtcatcgccctcaagctcatagctcccgtcgccactcgcgtcaccaacgttgttgccgtactcgggctcgcggctttcgtcggcgtcatcgccaacaaagctgtccctatcctcgacctcccggcttccgtcggcattgccgccaacgaactcacttctctgttagctctcaatcgcgtcgccatcgagctttcctcccgctgcatcatttcgcccgtcgctccgccccttttgccgtcgaacatcgaaatcgcccatgtgcttgcttgcgtgttccagtagaagcagtcatggtgctgcatccattgtcttggagcgtgtgtgtagtcagcgacaaattagtcgccggctcacacacactctctttctctctctgctaattctcagccaactcagcatatttggtaggatacatacagtatcgccgctaaaacatcctattatatcggctctaacagcttcaccttctgttagggcacctatagtgtttagttcgactagcacttccatgaaagccgaacaaaagttctctttaaccatcacagtgtaaaaatcgattgtgggacccatgcgaaaaaagaatcacagtctgatagccgtgcgcaacaaatatttttttaactggttgtgttcggcttctctttaaagaacatgttttcctccggacacttaccagccgactttcacagcatggtctgttcgattttttttatgcacggtttgattttaaccatacactggaggttctcctaaaatctcaagtttccctacatagtttaaattatcagttaaattctgagaaaaatatagaaaattaattagaactcagaagttggcagattcccacaagccaatttctcaccgtcagaaaaagctaatactcttacatgtaaagtaaaatagctacaaacttttcataaatattgatgtggatgaatatgatttttataagttctatcatatgtttattgatcgatattgtttcaactttgaccacttataactcttaaaaataatttgattacaataagtggtttaattcttaatgtttattagtatgtaatactttttgatactatgatatctatttaagtattccaattttatttgaaagaagacgaatgatcaaagttaaatatgagaacggaagtattaactaattaattaaaggtttgagatcaactttattagcaactgttttgtaataatttttctaagtatacgtaagccctgctctttaaccttttatctcgtgatgaagtgatcgatgttggttattttaaagaataaaatataggaacagtacatcgacttatgctaggtgtagcctgcattcggcaggaaaaacacaaaagtatgtgtttttttccaaaatatttccatagaaaatgttttaaaaatcatatagatatattttttaagtttaaaataattaatacttaattaatcatatgttagtggtatcttctcatttttctgctttcttctcttctctcaaacacaccgtagcctagtgcaacaaccacaaaatcagggacacatttttatacgtgcgagtgtatctgttggtgtgttctaggtaatagaaagtaatatttggggcgttcactttattgctaaattagatcttatcgaaatttagtaattgcaaatttagttaggtaacaaatttaacaatattttaccattgcaaacttacctaactctactttagaaaaagagattaccacgtcatagatagtgccatgtagtaccatggacacaggcaaattaaatactctatcccaccaattgcttacctcctcaaaacggatggctaatatccttctatgtacggtacatacaaggattctcaacttggcaaaagctagagaatgtgacaagccagtaaagaggaaagccgggttacgatgtgatgctactggctaaaatactccctccctctaaaaagacaaattgtgggtctcgtatcaacgtttgactgtccgtcttatatgaattttttttataattagtattttcattgttgttagatgataaaacatgattaatactttatgcgtgacttatctttttaatttttttcataattttttcaaataagacggacggtcaaacgttgaacacggaaatcagggtttgtctttttttttattttttttaaggagggaggaagtagtttcgagcgaatgagaaaaaaatggagtggacttctctgccacggatgatttcatttgatgtgtgcctcaaaggtgtagtcctataacaaacagattaaagtctagaagaattcatgtgggccatctatgatgtagaaatggaagctttcactattttcagataaagaaactttcaacacaatcacacatgtcgttgctttatgaaagaaaactgtagttagatttatccgtggttatttagagttatactcaaatttagtttgcaggtaaagatctaactgataacttttgattaatttaataagatcaagaattcgaacttagcgttggtcctttttaatcgtgtgcttacaaacaatatactgactattttggagctaaggataagaccccatacaaactcttcttttctcctctaaagccccgtttaatttgtagaaaaaatataggaaacttggatgactttaatattataagaaacaaatctagaaatgcctttgaaacataggatcttatcccttcttttgaaatttctatgaaatagataatcctataaatattttagagaaaagttagcgagagttttaaccccttaaaaatatttcatttgaggctatatctctaatcgaatttatgtgtttttcttactgtctattcaaacgacaattcatgtatatttccttatgttttgcgctgctttgttttgcactcatacatttctatcaaatcttgtattttttttccattcctctatttttttcaatccttcatttcaaaatgagtcataaatctaatcattctataaattatcagggcaatactcctaccaagttcaaaggcaagacgggtgtgattcatttttaatacaccaagtttcatcgtaacccactattatatactccatccgtcccattttaagtgcaaccatgagttttcacgttaaactttgatcgtccgtcttatttaaattttttttataattagtatttgttgttatgagataataaaacatgaatagtactttactcgtgacttatgcttttaattattttttttaaataagacgaacgatcaaagttggacgcggaaaaccatgactacacttaaaatgggacggggggagtacaccctactaataatcaataagggaaatccaaataactgcctactggtctttttaatcttcccctgcaacttaatttcataaacactctttacatgtctatttttttcttctaactcagttttcgctaatttttttcatcacactcagtgatttctcgcatcatatagatcccagtatggtgagtgacgttactccttatgtcttctattgagcatgagatttgatgcaccttttttcatagtatgtgataattgtcgtgtgtttactgctacaacgttggtagaattaaagtatgcaaggaggttgagttacacacctttggtggcaactagcaacatcgttcactactatggaggctcatgggatatgagaaatggctaaaaatagatagaggtggataattaaaagatgaaataaacttgtgactagtcttttgcagcaaattaaattgcaaggagtagattgaaaagaacggcgggttgtagggtacttcgattccctcctaatcaataatctagtactactccccgtaaaaaaataataataatctagtactaccattagcgcactgcccttttcttttctaattaaaatacaattttacctcaatttctgttagcatgttttcaaaccgataaacggtgtgtttcgcataaaaactttctatatagtagttgccgtaaaatatcaaatacatttattttctaagattaaaataactaaaactcaaatatctatacaccagtgactttttcattttacgtatccatcacttaatctttacactgagctagttcaaactaatagttactccctccgtcccacagtataagagattttgaatttgtgcttgcagtgtttgaccaatcgtcttattcaaaaaatttatataaatataaaaaatgaaaaattgtgtgtaaagtactttggataataaagtaagtcacaaaaaagtaaataataatttcaatttttttttaataagataagtggtcaaacactataaacaaaaactcaaaatctcttatattatgggacggagggagtatcattttgtgatttggtcaatggtgatgataaggagcgaggagtatgatcatcacatagcaaagctacaatacgttttccttcttctctctctaggcatctcgttggcgttcgccgaagcagccgcggaaaaggataggtaccgtaccaacccgcccccacaagcaagaaacactccgctactctccagggcggacggcgacctcccccaaaaatccacagatatttcctacgcacccccggcttctcttccc

SEQ ID NO: 15086 - DNA, 6952 bp, Oryza sativa
gggcggctccaacctggggcgacggttccccacgcccaaggagatttgccgtgggctcgataagttcgtcatcggccaggagcgcgccaagaaggtgaactatttatgctgtttctctgtgcgttccactctgagtggagttgtcttaatttggattagggattcagcctcacttggtactgcaaaacagtgttgatagtgtatgggtgggtgtagtttgtgcctaatgggatttcttattctagttttgtaggctagaggtttacgtcgtcgctgcttatagccttacacttatgcgattgtagtgactcttatgtgcttttgtccggtaaatcgaaacaataaacttgtttttgtcttttggcaggtactgtctgtagcagtttataaccactataaaaggatacactgcgagttactctccagcaggttggtgttgtgtaaataccagttttgccagacttgctgcgtcctgcgtatgggtagtttcaggtggtaaattggattcaaactgtaggtctgctggagattgtagcgagactgattcttgcgcgagtgatactgatggagtggagcttgagaaaagcaacatccttgtgatgggtccgacaggctcgggtacatgctccaatcattcaatctattagtgctgtatgctgcaatatttgtaacacataatgaaaaattgtctcaatggagaactcgtgtgcactataaaaatattcttgtctaaatgaatactagtattttttatgatcaatagtaggcatgcatattattaataatgatatggtataaactttaatatattgtagaaacacttccgatcacaccaaattgccaggtgccagcacatgagaccgcatttggaaacttcttaatatagcactagttgatggttggtttttcatttgaatcatcacttctttcttttacagaccatgcaatagtattacatctgtactttatctctctcatgtagaccattttctattcaacgaataagatgatggtagatattatttatttcttatcaaatgaatgttttacttatatgattctaaaatcttttcccaaagtcagggaaaacattgctggcaaaaacccttgcaaggtttgtgaatgtgccatttgttatagctgatgcaacaaccctcactcaggttagatgaattatcttaatttatcaattcattaacttttgcatttttcctcttctcctgatatagcatccaatttttatccattcctggctttactgtaagggggagcaatatcataagatttcccaaaattatggtaccagttggatccatgtatatatgatatgtgctttatactcttttatgtaattattgtattgtacacgttttcattactttcttgggcataaagtgcttagtatactcatagccatacatgtgttctaaagattctttttgctgtaacattactttttattatgggtgctgtgttcttaggtggcatattttaaatagaccaatagagtacttaatcgtagtctggaaaatgcaatgcttttgtttgagagcgtcgtatagcagcttgatttaataagtgctcatgctggtgctcaggagttcaccttttctttaaccatgtttttccaattgtaggctggatatgttggcgaggatgttgaatctatcctgtataagctcctagcggtatggttaatttctgtgtactgacattgtggcctatatagtctttccttttcacttgcatgtattgcaatagttgcttagagaaccttatgatttttcttctaccattagcgcaagtgttaaactgttaagacatataatttatccctcttattctctactgagtgcctaaatatgtgaagaattgaaacaaaactataaaaaatcttgaaagccactataacaatatgatatttcaaagtggagacaacccatattcgacattcgaatttgcctccaagtcacaagctcttatggtacaaaaagggtgaaatgagttaaacaaggtcgccctgaccctggggggaaatgcaaattgtaagatagaaatttggatatgactatttttttaatgttggcagttatggtaattaagaaaagttgtaatgacaccgttgcctgaaaattctaaattttgtgttttattgaccatagaactggatgtactcagataagatatttatgtccttttagttctctaagaaagatttcatgtgtgttgtgacttagctaacagactgtttctatgttaatgtggtcattgttccacatgctcccaactctaggcatacctgcgtgtatgttcacaactgcaactatcaagattgtggtcttaactccagcacatcataaaataacctttgcatagaatttattacatgaattcattttggctttatgatctagagtgaagatgtttttttttttttgggtttaagagatctaagcatctagctactatctattcgggctttcgtgttggacctgggttcaagacttctttaataaggacagatgattctaattggctatttgctaaatgatgtctatatagaggaagcttagattaatcgtaactgctctttctaggagatgaattaagtggttcattaagcttgttacagaaactaggacagtgagtttgaaattcctttctaccagtgctgatgctagcactctataccctcttcattgatagcacttttcctgttcccttttgaatccccaggctgctgattttgatgtagctgctgctcagcaagggattgtctatattgacgaagttgataaaataacaaagaaggtactgatattttagctagggtcaattcatcatatatttattgtttggatttttgaagttgcagtgtcttgcaggctgaaagcatcaaccttagtagagatgtttcaggtgaaggtgttcaacaagcactgctaaaaatgcttgagggaacggtgagcttgtcgttatttgttgttatgctccaatttatactcaaggaacagtccagttaggatgtttgattgatagcttgctgatgccaaatcttatttcagatggattgctaacatagaatatgaatggcatatttttacttaaccctgtgtgcaaaattgtttgttgctacgctttgctagtagtacatgagttggtccaggcttacattttactacctccgtttttatttatttgtcacttgtgaccatgcatacaaaccaaatgtaaatcaacttgttcaaggtaacatgacaaaagggctcctacttgagtgggatgtataatctagaagcttctaaatatatatgccaactaattatcattttagactcacaaagggcaaaatggaaataactacattggtaagtgtgtagtgacaagtattttgaaaccttaaagtgaccaaagtgacatgtaaatggaaactgagggagtagttaatatgccctgtctagctgctaaaatttgttggtggcttcataatgttttgttatcttgaactatgtactgcatgtttttattgataaccttctgccttttgattctccagccatgtatgcatgggtggaacctgcaaaacacattaaattgtccaatccaaaccattgaggcaataacttatttgcctctgatcatgtaaaatctattgcgagcgccagtatcaatatatttaatttaaatggagtaaccagaagtctatttaaggggttttcttgcgcttctttttaaaatttttatcgttatcacttactctagctaagttattttgctagtttatgaaaatgttgaccatacaattccgtagttcaacatggattaagccacaaagatcagcatacttactggtcaataaactgttcttggcctcctcattgtatctgtcatagagttcgtaaagctgctctttccttcaattttgctgataggcatagattaatctctttgaaaatctaagtgttaccatgttagttatttatgggatagcacccttgattattttagtatttttaaaaactgatgacgcataaggtttttaattactgatcttcttacaattgcttttatgctgtcaagataggtcgttagtgttcctgagaaaggggctagaaggcacccaaggggtgacaatatccaggtatcctatgaaccaattttgccatattgctatctatttcatatttgtctgacatcagagaacctctgttttattccttgcatctagtagaagatagtgaattccctgagttgaattatctgttgtctggaaatagaccatttgttttttgataccttgtgtgcttgctctgcaatctgtagaaaagatgctttgtttttattagttttcttcactttactactatgaacatcttttcgagcaacacttttgccctccatgtttaatgcagtgcaatataataatggaaattctcattgccccttttaactatgtcatgtaaacgaaaatatttatttacatacctaaaatagtgtcaaccagttggcttttgcacaactagaaccttcatatgttcttgttaaactatttaatatggttttatgctgttttgttttgcaatgcagattgatacaaaaaacattctcttcatttgtggtggtgcttttgttgatttggagaagactatttcggaaaggtttcaatatcctgcatcatttatgttttacgctgaaagtctttcgagttttcttattatatgtttcacccgaatctttaataggagacatgattcttccattggtttccaagcaccaattcgttcaaatatgcggactgggggtgtgataaatgctgagatcacatcctcgttactcgaatcagtgagtgatcaagtagaagaatgcatatacttggttttgtgacttgtcatgcttagaatcctttgaaatatttagggttcttactttgtcgaaatatatgcaggttgaaagtggtgatctcattgcatatggattgatcccagaatttgttggtagatttcccattcttgttagtctatcttcccttagtgaagaccaacttgttgaggtaacttgcgatgcatgcatgtgctgtgtctctttaattgttctttctgtcaaagggcacatgttgcttcaatttattatttattattgttccaatcacagactgccaatttttattggctatcctgctttcttcaaggtttctgcgtaccttttaagcatttatccaagaagtattttagtagtatgttcagattggttcttggtgtcatgcatattttttttatcaactctaccataattttcgggtaagatgtgccatcatctgccacaaacaaaaattggttcgcatgctgccataattttcagttgatgagacatacttcagttactggccagttagttgactttgttttatggttttaccaaaatacaatcactgtatttttgccttgtgaccgcaaaagttttgcacattgtccatacagcttgattttgaaaaacactggctatatactccattaggcattatctgtctgtgaagtgcgatatataataggtcctacgtacataaattaattgtactttcttaatacatttattcactgcaggttcaagtttacttggcaacattcaagtttatttccttatactttgttaagcattctaggtcctacgtacatgaattaattgatctttcttaacacatttattcactgcaggttcttacaaaaccaaagaatgccctaggcaggcagtatacaaagttgtttgaaatgaatgatgtaagcgagtatttcttacaaattctggaactttgtttagagtcagaatattctgaagtataaccatttaattagttgttttcatatcacatcattgtattataggtcaagttgcattttactgagaaggctttacggcttatttccaaaagagcaatagcgaagaacactggagctcgaggtttaaggtcaatattagaaagtttattgactgaatccatgtacgaggtatatatttgtatcttcccgctagctgaaatttgtcaactgaggttttatagcattttaggaaatcaatttggaacagcatcgtgaacctggaatattgttttttttttgtatgattcagttctagcttttcagggtcactcaaccattgaattcacaaaaaagaatgatactctgcctgtttttggttcaagtccaatcataagcactgtttcattagtcaaaccaatgaaatcatgtctggtttagactctagagacataacccagaaaggaaccaaaaccaatgccccagatatccaaacttgaatttactataggaaatttatacatactaccatattgttttcacaatcaaagatcttcccatgcgctaaaattcttggcttgtcttttcttgtgtttctgaacgttaaaattgagtggtaaaccttcaaactagatggaacatattttactatgcagggagttaattgtagtgatccctcaatacagctacctatatttttgggacaaaaggagtaaatatcttgtattgagttactccccgtttggcatagatccagctccctactccaacttacctagagctggagctgtgccaaacggtatagattctcaatattttggagcggagttggcagagctgctccacaaatttgtactacggggattgagctgggtttttgctgctctacaactccactccacctcaaaagacccactacccttaattattttagagtatttacaccaaaatgccattgaactaccccttcctccccatcttcctcccgttcccccatcttcctcctgttctctgtcctcccccatctgccattgaacgcagcggccgacggtggtgtttgtgtcagcagaggcggtcgaaaacgggaggagcgcgggcggcggaggcggctcggcaggcgcgcgagcatcggtggcgcacgg

SEQ ID NO: 15087 - DNA, 14679 bp, Oryza sativa
  unsure (1)..(14679): unsure at all n locations
cgccagcgacgccaccaaggtgttcgacgaaattccaacaagggcgtggtcgagtggagctagccaatatagccaaacacttttcatatccactttaactcctataggagccagctctcactagagttggagtttagagttgagagttgggagttggagccctaccaaacggggccttacacttttggttgtccgttggttccattacattgtttgagtaggttttttttttcagttttactatgtcaaaagtcctgttgttacttaaaccattgtaatgaacattattttttttacagattccagaaatacgaactggaaaagacaaaatagacgcggttgttgttgacgaagactctgttggatctacaaatcagcatggttctggagccaagattctttgtggagaaggagcattggacctttacttggatgaacataataaagaatcaacggtgagcatcatcatcatttttccatacacgatgttacctcaaaagtctttcttatgtgcacttgaccgtttagcactattatttagatatgggatgcagcatttaatgttgctcctgttatatttcagtggctagacatggggttgcagacattagaggcatgctaattcagcagtttttattggctagtttattttgtgaattcccctgctggcctgttcacctcagaatacctaaagatgacttctagttactggtagaaatatacgttgaaaatgttaaagaaccaatcagtcgttacattccccttgagccttacatgctagtggtgatgaacttattcaagtaatatttaatacatcatgtttatcagttttcttcatcactcctgatttttcagtagagacaacgattgatatgtatatagtatattttttgggagaacaagcaaacagttgcatcacttatcatggtagtgtcgtattgtttaattagtaagaccagcctttgtatttctggttggtctccatcttcacttatttgtacgctcctaaaagatttacgtttcagctacgacggtcggagaaggtggatggagaacctgacattgatacagaagccccttctagagtggccagcatgtagggattcctgacaacagtaattatgtatataacttgttatcggccatgtaactgtagccaattcaaatgtaaagtcatcctcctcatacattcatgtataaggtccatgtcgggggtgcaatttctcttggcgatcaaaaccttccctttctgtgacatttttttaaaaagaaaaggtaaaggggaatagattctcatggccatgatgaagttccaagcctcctgttcatttcctggaaggaacctgtcgagcgatgcattatgattactggcaatatattgtcgggacactgatcaggtgcagttactagtgttattgcatctttggcaggggaggttaagcagcaagcatgtgttcaaagttctcatcattttatgtcgaaaaagtcctgatcatttggaaaaaggaaaatcattgaaagaaactggccgccatacctggtctggtaatgacgacggtaccggtttcttggtctctttgtaaagttgataataaccatatttttttttctaggggtaatctcttgtacagtatggttggtccacgcccgcctgttattctggtaaacgtgtaggcacgctcacccgaccacggctctcgtgggtgagcaatgtgccggtgacagaccagaaaagaagagaagagagaccttcgcttgttcatgttctccgcatatactcgtagaatcctggtatcatctgcactccatctctcggcacgtactccttcattcatatttattcctaatacaaattgatcccttttcattcctaggctgtgtttagttcacatcaaaattttaaaagtttggttgaaattggaatgatacgacaaaaagttgaaagtttgtgtgtgtaaaaaaattgtgctgaaaaagttaggaaggttgaagaattattttggaactaaacaaaaatttgaatgcttacctcagtgcaaagagcagagaagaggtttgaatgtttgattgctactccctctgtcccataatataatggattttgagtttttacttgtaacatttgaccactcgtcttattcaattttttttaaaattattatttattttatttgtaacttactttattatctacagtactttaagcgtaacttttcgttttttatatttgtaaaaaaaaatttaaataagacgagtggtcaaacgtaaaatgggttgaagaaggccggtcctagtacaaattgatcccttttaggacgaatagttcgattgttgaaggaccgtgacagtatatatttccttcttttttactagtagtgccgtactagtactcagagactgtcaaagtagcacgagaatcgaatgctgctgcaggctttgaatgaatgccacatgtaccagaagtagtagcatcgcatttgcagccagcagcaaagcagcatacggagccggccagccttgccaccacgccaacgccaccgcttcccttcctcgtcagtttaaaatttgaacattcgccgcacccccaccttatccgcactccccccgcatcatcaccacgcttttttggtgtttggttggttatataaaatcgaatcccctcccctcgtcgctaaaaaagcgcacaagcaaaagaaaaacgtaattacaagccacccccacccaatcctcccgcaccaccacaccaccattacagccgcaatcaacccgtctcaccaccaaagcacactaccctgcaacccaaacgctaacgcagcaatcccgtgctttccaaatgcaattacaaattcccattcgccggcgctaatcagaatcgtggcggatcaccctacgcctacgacgagggttcgacccgatcgactccccctgccccggcgggctcacgggcggcgggcggggggcttaactgaaagctgaattcgggttcgatctgtggccatggacatggcgagcatagagtgcgtctcctactcagacagcatggatgacgtccactacgatggcgtcggcgtcgtaggtgtctcccacctgccacgccccatcctagtcaagccctcctctgccgccgccgcagtaaacgtggttgtcgtctccgaggccatcgaagggggcccgggggnagtagaagaaggggtcggggtcgtgaccggggcctccgccgtccccccggcgacgagcgtccacgagctgctcgagtgccccgtctgcaccaactccatgtacccgcccatccaccaggtccgccattcttggggttcttgcggtttctttctactactaggatctcctctcaccgcaagggagtcgtcgtcggtggggtggaatcgcgtgatccggtgctgtgagagggctggatcttcgttgcgtgtctgtttgggggttcttgatcctggggcttcttggatactgcctttccctgccacgggaaaacatggcgtgcttgctgcatttcaggggataggatggttgccgcggcgtgttgatttcaacttgcaatgctgtttaaacaacgataatcaattacggactgagaggatccagcaatttctcatttcaggagataaaattattgttctgattattgtctagtgacaccactgctcttcacgtttagttaatgcaatcggtataattgaccccatttaggttacaggtttacggcaaattgaaaccaaatatcaacacctagctagtatctcttctttcgtctttcttttttctttttgggagaggaatcgagtatctcctgttgtgaatatattcttatgtctggaatcagcagcatgtgcggcagaacatttggagatgaggatcggcctatctttgccttgttacgtcacttcgcgaatcccatgagtctttactttgacgccctctttcatggtattagatgcttggtagtggaaaatatcactgggatgcaaggatgatcactacaacaaatgctagtgaagtgttgggttgtatagaacagttcatttctagccttttttagtgcatttctttttgtagtctaggggatgtgttgtatgcatgcttgtatgcccttacacaagtggaaggtaaggcttaagttgggacatggaagatgtcatgtagtttaagatgatcggttattctttttgttacctgttatttcgttttctttatcgttctgttgcaacttattacctttttattaaaatttacttggaagcagctgtattaactgtttgttaagaagtattgcccaatgtatcaaaatcttttcctgcatgcactttggactgtattactgcttgatggactattatggtcatatggtgtcgtatgatgtgtcacatttttaaaacgaagtgatgacctgttaactgacctaaaggttacacttttttatatcagggatatgttgtcacattatagtttgttataataccaaaatttcatatctggagtggcttggagattattataataccaaaatttcatatctggagtggcttggagattattatttttttgtctattgtgaatttgtgttgctagttaggtcactgggagcctgaagaattaccaagcatgctttctgtgatcctgttagaggtgtaggttaagtatctttctactatagaagtctttcctaacatcaaacataaagacgtaccattattaataacctgtgcacggacatgtagttttatcgcaacatttggcacagcgatcagattcaagtgaggaaactgtgtttgatgaatgatctcaatgagtcgtcacaacatatagagcaggcaggggcggatctaccgcccggtgaccccagacatccatctgggctcgtcgatggataatccattaaaattccatgtaattagaaaatttgagatagaatttcggtagtaaatattagctatagtgaagcttgcccaggctgtaaaatatttctgattagctactaagcaggcaattaatgcggacaatgatgttattatgccagaaagagctgaacttttccaaaagcagttacaaaccacaataaaaaccatattttaatccttcttgttaggatttcataatatctcatgaatcaggaagcttttaaacaaaagtccatgttgtaccatttgtatgtgagttttgcgtctgtggtattccatcacaaatacatggacatagtacatgttttctccctctccctctctttttttgtggtattttcactgtatctttcatcttgtgttgatgcagtacattcttgtttgtagacattaactattgctcagtggcccttgctcatagtaatactcctggtagaaatttgtctgagtgaaaatatgtactatctagctattgctagcatgaagcttgaatctttctaggttcagcatttacaagtcagaactgaatataagtgattaataattgactaatattttttgccatattacagtgccaaaatggtcatactctgtgttcaacctgcaaaacccgtgtgcacaaccgctgcccaacctgtcgacaggagcttggtgatattagatgtctagcattggagaaagtggctgaatcgcttgagctaccctgcaaatattactcactaggttgtccagaaatctttccgtactacagcaaactcaagcatgaatcacagtgcaatttcaggccatacaactgcccttatgctggctctgaatgctcagttgtcggggatattcctttcctagttgctcatctgagggatgaccataaagttgacatgcactcagggtgcacattcaaccatcgctatgttaagtcaaaccccagagaggtcgaaaatgctacttggatgttgactgtaagtgtttacctttattgccttctatcacttgcagtctcattaacatatatattggtgtgggtggtacaatttaactgcaagagttttttttatccatgtttaaggtgatatttgatacttatttattatccttttaggtctttcactgctttgggcagtacttctgcttgcatttcgaggccttccaacttggagtggctccggtttacatggccttcctccgttttatgggcgacgaaaatgatgccaggaactatagttatagccttgaggttggcgcgaatggccggaagatgatatgggagggcactccccgcagcataagggacagccaccggaaggttagggacagccatgacggcctcataattcagcggaacatggctctgttcttctcaggcggagagaggaaagagttgaaattgcgggtcaccggccgaatctggaaggaacagcagaatcctgactcgggagcctgcattccaaacctattcagctgaactgaaataacaagagagaaggattcggattcggattcggtttaggtgtatattgggtgatgcgtgtggtgcacctgtgcccgcttctgtaatttgtttgtgttgcttccacttttcttccacgtagccgttgtggcctgccctaaattagttagggctgacgtgtgaggaccatgaaaaaaaaatacggcttgagctttgtgggttctgattgatcacatgataagaaatttctcgatttgtttcttttgcccttgtgccccattttgagatgggaggccattatgctctttcttgcttgtaatttgcaaccattgatcagagcattttctgggtttgtatgttttcatctatgcttgattgggtattcgggtgttaagtatccatccatgacgaaatggtgaaactgtaaaatgttaaaaattcaattacttaatgtcgtttataagataatatgcacatgttcctttctcagaaaaaaaaatgaaagggaattgcaaacccatcatgttcagaaagctctagatatatactcttagtgagacgagaaagtgactaaatacacctaattaccatgcagcaaatatatgttactcttgaacaattaaaagagataacatttaacatttaattacggtattctgcaccctcctggatcttgtatgatgttgatacccttgtgtactctgcgatgatgctgaatgttagccttcactaatctgaagtcttcagaaatttaatttacagctagagtaatctcatcaactgctgttactgaattcaaaagttccaggcgtccagcattgcataatgtacatcacatctaggcctatgaagctaccattgtgctgcgttgcttccaaatatgcaactctttctaactgtattttttcaagggtacgaaaagaaatcatcatcatcatcatcaacaacaactcaaacagttcggggaaaggaattgtctcagaaatagtaaacagattcttataatactgtcccaaaaagatttatgctctgacagcacaattctatcagaatgtagtgaatatcagaaagttaattctatcagaatgtagttcatgaccttaatgtgtttatcccagcgatttcaatcagagcgagaaaccaggatcacacaatgcataatcttccagtttcagctaagccaagataatcccatccaaaaaataactgagcactacgaagcatgaacaaaaagccttagttcaatccagtgtgagtgaaaggcgtgcttcatctccttcgcctccgaagcttccactgctccaggacgtgctgcaaggcctcctgcatgctggccttcctgtcctccttgttgttccacagctctgacaccacgtagctgccgctggcattgtactcgttgatctccagcagcgccgtggtcacggccttgtagacctcgtcaccgagctgctccttcaagcccactagcttctcatcatcttcattgatgatttgctacagaaaagaaaacggatatcgttgtcatgtcagtgatggaagtgtagatcatatatttgtcgggagatcgaatgcgaaaaactgtgccagaagatttcattctgttgagcatacctcagtctttcctcctctggtaacaatcttgaacggatgccaattggcatccttcagattttcttgccactcggagcaaaattcagcagcttttatttcagcttcaccgtcagcagtaccataccttttcttgcaagctgcaaggaagggtttctcatccagctcgcccattctcttgagtccgatggtgctacgagggcctaacaattctgataagccctacaaaacatacgcacaaactcaggtctcagccacaatcatagtataataagattgaatctgaaatgagtccaaataaacacaaatgaaaatatcttcagactctgtcaagcagtagaaaggaaagatcagcatatcatcacattacagaaatcagcgctttcttggcatcttgcagttcatcatttgtcttcctttctttgataatgaannnnnnnnnnnnnnnnnnnnnnnnnnnnatctcctcaatcttctcatttagttcctcagtcagctcgtcagtacgtttcttcacatcaacaccctctccctccatgtgttggaccaccagcagtcttcctctaagttgttgtatttccagttccagcttttgcttttcatccaattgcttttctaactgcaggattttgttcagagcaatctccttctctttctgtgagatttttacaagccagagtaaattccagagcatgagaaattaaaagaatcttgcataagattaataattggaaacaagagtgcagaccttgtgtttctcaacaagctttagcacatttttatcagacttctgttgctcgattctagccatgtggatggagtcgttttgctcagagttctgtaggggaaatcagtaagacaaacagtcagataagatattctaacaaagatcatcgtaaccagactgtaaatgcggagctaacaggaagtgtaatatagatacatgacaagtatacagaaatcctgtcacccctagaaagattgtcatagctgttcctgaagatagaactctgaagaggaaatgcaaatgctaaacagtaacataaagcaaagagagcaaagctgtggttacattcatacctttttcatctcactctccaattttcttctttctatgtcagtttgagcaacaaacttgcttagttgcttggatctcctctcgatggcattctctttatcatccaactgtttcctcagctgatcagtctcttcaaatattttctgtgaatgttcacgagcagcagattgcatatttcgcatttctgtaacagcaataaaatgaaacaacacaatagatattattattctggcaaattggcaataaaagtagacaacaacatagcaatcatatgcccatggcatgagaattattcatatgaacagtttgtagtatgtaccttcattgtaacttttgtgcagcaagtcagtttcttccattgcccttttaacagagagattcatttgattgcatctgcattccagttccaccaaatacttgctcttagctgtaatctggtgtgacaagttagctatgagagtctcagtcttgcgagacaggtcattttccagaccagacacggtcttcagatcaccatttgctgacaaaaacctaccaactgggtcactagatttgtagtcctcttcttttgccatccatccacagatgtacttctcttgtccaagtgctgcccaatcctttttacccagacgttgtgatttgaagtagttgtggaatgccaaggcgttcgtgaacccaatccaatctttgctgaaaccgacaactgcataaccagtatacctaccctcggagcagagcacagcagtaaactgcaagggattgaaattagctagctgctgcatcagactagctccatcctcctttgttttctcagctggaacatttgcaaggatgcccatccatggccaaacatacgcttcctgatcttgcaatggccttggaggattacttggtccaatggcctgtcgtgatggcaatgagcctgctgcatcagcatagtcgttcttgagaagattggccaaggccatgtggtttgccttcacctttggagcgcgattggatgcgccaaccccaatggcatgctgaagtagctcgttgtaacggtagtcctgcttcttcttccccagacagaatgggcatctgaacttttcattgcctagactcaccaccggcttcccagacttgaggtccatgtagcacttgtcagcatagtcatcaatatctgcatcacttagctctgactcgtcggaggtgaaatccatggcagacctgagtgacacggaaatattcaggtgagaacattgcattgagctcgaaaacagcactggatgcacctttgttacaaccacagttaaaaaaaaatcaagcaaggatgtagtaagtgtgcatatggcattgttcagaacatcagaggaccacacagaacaacagggcaatggtcattcatgattagaataggaattacgattgcatttcaatttgcatttgcatgacacaacattagacagtgttacagattctctaacactaaatgtgcttcagtagaagaattgaaataagtcagcagcaaaataattatgaaacaagcaacacaaaatcctacagttttgaaataactcactgatgtgtgttcattttgcaatctacttcttttttttagcaagaagggcagatcccctcccatttccattaaagaaaccagcacagaacatttcaggaaccactacactcagaacaagtacaggaaaagtatataacctgagaagacctgataggcaatgccatccccatttgcacccctgaactagcctaagcaacaatccagtaaagttccagcaaacaaacctactgccaatgaacagaggtgatgcaatctattgcaattgcatcagaaacagccctatagaagcggacgtctaaatatttgcgcggtccaagtattaatgtatattcaagaaaccttttaggcaccctcactaactatcaaagatcagttcagtcgggcttagtcgcaccgcagcccatgataacttcccccatgggaataataactatttgccactcttccgagtagttttaaaggatttgccattaaactcacatgtcatagacacataaggacccacatgtcaaatacagcgagtgataaattcttaattgacacatcttaaaagttgcaaataattaaatgtccctctcccatggacaaccagtgctctcaagcaactgagatgtttatgcctttcccttcccccttcttttttcctttttaatccatcttctcaatctcaattctcaaatcgaccaaaaatccggcgccgcctccctccgttgctcaagcggttgctctcccctctcccctctctctctctctctctctcgtgggccagtgaaaggctcctaacgggccatgggcctgactagtgagtgactacacagcccagcaagcatcaaagcatcaaggcagcatctctctctcgtcggcagagcgggcgacggcggccggagatggtgaagaccgccggcgccgccatgccgagagctctgcttctgcttggcttggatgcaggtgcagaaatgtgttatgagcaggcaaagaagcgagatgaacctacaacaacaacaagaaaaggagcacgcagacgtacgcagacttggcatttccgtatggatgggtgagagattccatggagatcgaccaaccaaaccaagtggaaatcattcaatcaatcgaagcaaaatggagaaaaagcaaggaagcgagcagaggaacacatggtatatataaagcaactagaaacccatatcctcctagtacttggatgtgtgtttccatctactatggagtacgcacgtagagatcgatcgatcaaaacccaccctatagctatatcatacgcgtgcaacgcagaaacaaattcacccagaaagaaaaaaacgacgacgacgagggaggagattatccaccaccatccgcgcgaaagcaaaaacgaagcaagattctcctgcaagatccaagaaaccaacaacaacaacaacaagaggatacacacacagagagagatggagagcaacgacctgaagcgcctccttccaaccaaaaccagatcgatgagcacgtcgtctctctctccctctctaagctttgctttcttccacctcctctctcttataggaaggagaggagaggagaggaggaattaataatgtggaggccacacctgctgctgctgctgctctgaacctgcaccacgcgcgtcgtgggaggcgccgcctccatcctggccgtccacctccctgaatcgacggcggttaggttaggggtgatgggtgggccccacggtggagggagaatgagaatgacgagaatggcatgcagatgtggtggccttccgactgtcctacgccttctgtgccttcccgttcaggaaaggagaggagagcttttgactgcactctcctttcttttttactgctctgctctgtgcaggcctgccaaatctgccatggatggatggatggatggatgctttttgtttggttttgcacggatccggcgttgccgtgttgcacaggatgctttgcttcctcctcctgcatcctgaatgagcatgaacgtgcagatcaagtcgagagattcgagccaaacatggcagtgagaattgaaatggttcacgttttcgtttttcagatatgcgaacatgaatatgaatactagtatccggttgtgtatctcagagttctctactaataaaaaaaaatagaaccccttcattccagttctttctcaaccactgtatttctctcatgtaaaaaagccacatgtcttagttaagaaaaaacctcctacctaaaagaaccggtgtttccacgtaaaaattgacacattgcatattgaaaagaaaaaaaaaatcaaatcctgtcaagccatattgaaaagaaaaatcgcttaatttgtaacatatggacgcacacatagatcgaatatgaaccaattattcgtttacgaataattttgaaaagcatgaaaacctctctagttgtggtcccaaaacaatggatagatgtaactaactcttttatcataaaaagaaatattctcattagttttagcaaccatattactaggacataggcacatgcaaagagccacaaatataggcactttaacaccagcttgcggacatataacatgttaagtaacagatgaacagttcaagcagcaaacgacatgcactctttcttggcaaggactatgtgattaatttggtccaagatttcagaaattttatataggcatatgatgtaaaagcagatactataaaaaaaatctacgatggaaaaaagaaaaaaatcaacttaaatcttaagttttaaaatacaaaatttgatgcatgtatatataaacgtaagtgaaacgagggaaagtgcctgtaacctagtggttacaagagcctcagtagcacctgaggtcctgggttcgactccccataggagcgaattttccaggatttaacggcgttatgctttcagtggtaggcgacgtacccgtcgacagcgaggtgcctgtggtgacttgccggcccagtcttcgaagatgctcataggggtagggtttgcgcgttatgctttcagtggtaggcgacgtacccgtcgacagcgaggtgcctgtggtgacttgccggcccagtcttcgaagatgctcataggggtagggtttgcgtgttgtgagtgactgcgttgtactgcgtaattttaaaaaaaaacgtaagtgaaacgagatggcgctgatatatttgaaggcctagaaacgcccatggcctaatgaagtgacttctaatcaggggattgtgtttttattctttctgcttcatttctctctctctagcttccgggaaattgctcgttttcttctttctctattttcgcttgctgcaggagaggtgctcatttttttcttttattttcgcttcttgtaaaaggaaaacgtgggccgaccaacgcaacaccaaggcaaaaggagctgtgcactctgagtgtgtatcaggcaggctgagtccatgggcagcaaggatggctgccatcttgtctgtttaacacaaaaacggaaggtaagtacacatcagtgacggaccggctgacacgcaaaccaggcgcacctcattttcggaaaaaaaaaagcatcgttatcggcagaaggcatctcccatcgtctctttccctggcaccgactactcatgtgtgtgctaaggtgaagtggataaatattactccctccgtctaaaaaaaggcaaactatggatttccgtgtccaattttaactgtccgttttatatgaattttttttataattcatattttcattgttgctagataataaaacatgattaatattttatgcgtgacttgtctttttaatttttttcataattttttcaaataagacggatggtcaaacgttgggcacggaaaccagggtttgtctttttttaaaacggagggagtaggcatctagtttgattcggtaaaatttgctgcatgatataaaatatcatggtctttgctacgtgacattatctaaagaaagtatgttagttcgtggataccatagaaatatggtaattagtcgtatactcaacgtattattttattatatttgatggaaacaaaaagagaaaattcataagaaa

SEQ ID NO: 15088 - DNA, 8079 bp, Oryza sativa
aaccactcccactaccttttcctcatcaccccagcggccaccgctatagtcctcctgctcgttatactcctgctgcttgtcgcgctgcacttcctgagctaccactgcacgctcatgttctcaccgccgccggaccctgcctgcttcgccaatacttccgtcgcgccactggtggattccacctgtgtagctttgcccgcagtgccgcctcgccggtctacctcaccgcctttccccaacatgtcgctcgtcgttgagagattcctcgattggcccagacggttcgccagcacccgcgtggaggcgcccgctctgatcgacaccaagaacctcaccgcgcatctcatgtagatctcggcaataaccatcatgtcctgcgagggaagtaaggcagaggtccatgatagctccaccgccgatgcctattgtcggaagaagaccaggagaagggagaagaagatgagaagggagaagaagatgagggcaaaacaaacattttacatagtttttctctcatcaattgggtggatattgtatttttatgcgctcggtgtcctatggcaaattaccacgctttcgaagtgtcattaggaaaaaatcacattcttacgacgtctaccagcaaagataataagtttttaagtgtcatgtagcaaattttgcattttgattcaacaatatgtagtttacatgtttccactatatatatggtttgcaatatatattttgccagattatgaacttatgtgagacgtgtgtggtaccagtagtgtaattattgatgttctacttgttttcaaggatgagatatgtacctctagaatatatatttatggagttatgcgctttttgaggaccggagtctagttaattatatacatagtcaatgtttcatttagaatcttgaggctttctagttttacctttaggacatcgcaagagtaacattataggggaaaacactattaatgtggtaattagctaatgaacattgtgcctattattttactgtatttgtgctaacaacgtgtgagagggcctattttttgacatagggtgaccaagttggccctaagtgtatcacacattttgacaatttgaccctttaaaaaaactatttttacaaatgaaccgccgccaaacttattttaaaaataacatttttttcagcgccacatcatctggcgctgaacttgacaccttagcgccacgtctactggcgctgaatgccgtgccatcgcggatgggaggctaagtcagcgtgccaacgcacattcagcgccacactatttggcgctgagatgtctaagttcagcgccacatgatttggcgctgaaaaaagggttatttttgaaataagttttggcggaggttcatttgtaaaaatagttttttcaaagggtcaaattgtaaaaattgtgtaagcgtatccggctcaaattgagatggtctggctcaaacatgtctgtcgaggagtgatcctctctagcgggagatcgtgagatccccctttttgagttcagccggggaaaagggttcgcctctcgagatcgtgtatccaccctcagggtttccagatcgcgtatgggcgccaagattatacaggttcgggccgctatagagcgtaatatcctactcctgtgtgtgggatttatgattgagtgttacaagggttccccaactctggagagtgctattggtctgctccctctaaagctcaggcctgctgggagtcgtccccctttttcagcgggcaaggtcctccttttatagttcaaggggataccacatgcgccgctcctacctactcttttatgggagagggacccactttaccttgaccggaccacgatccgtgccttcgcccggaagctaagcggcagttcgtcctttagtgggatccggcgccgccccccgcctgccacgggggacagccctataatttcctcttaaatgagtgaagacttgtggcggtcctcgcgtggagggaaccccagatgacgccccgatgggacgggacatacctacctccactccgccgaatacagaggcgacgtgggggcacggccgcccgtccaatcggacgtggccggcaacaggccggtcacagactggtcacacccgattgacgtgggtcagtctagtggcaccgcacgttcgcccttaccgcattaaacgcggtgagggacagttggggcgccgcgcattgatggtcgttcagcctgggtctcctccccgcttgctccccccgccacatggcagttgggcgagggcctcggggcaaggcagcgcgagggcccgaggggcatgacgtggcaccccgaggccccccggccgcctctgcgactcgcgaggtgtaggggtagggctaggctgtagagccacgcggctggatgtgaaggtaacttcccctcactttgcatacccccgggcccatatctccgatagtagcccccggcaccgcgtcggacattggccccctgagggcagtctgacgtggcgcctcacgacttcccgtgccgaggttgtgggcccggcggggaacccagatggttgccgctgagcggccaggctggcgcattagccataatggcgatttgaccgccattaaccgcgctgatgatgggggcgcctagggcgcgaaaatcagggggtcgacctggccatgcccagaatcgtcacccatgccgcctcgactcccctacctgccaggcatgcgatgggaccgacggcgggcccgcctaatcgcgcccgtgaacatcgcacgccccgcgccgagtgtgccgctgacaggcgcactaaacgcggggcgtgggttcaatgggcgatgtgatgagtggacgcgagaaacgatgaggcaaccgcaggtgtaggaatcgaggaggcaaccgcgagggcgtgaaacgaggaggcgagcgcggtcgaggcggggataaaaggatagggaggcggagatttcgtccccttcctctcgccgactgctcgcccgcacactcgctcctcaagccctaacgcttctctcgctccacgctattccgtacaccaaactcctcgccgtttccccgccggtcatcatggcccaagacgctagtgacgttgtgctcccggtgtcgcgcatcacggcagagaggcaccttagcctcatccgcaagatcatgccggaggacgccgccatgatggtgggggagtcacggccgcggccgcggtacccagagcgatccgtgcacctcctgtccttcgccatggtggggttgatcctgccattctccaggttcttccataaggttttggatttctacgaaattcatgccttgcatctcacacccaacgccgtgatgacactggccatcttcgcgcacttgtgcgagatgttcgtcggggtgcggccgacgatgcggctgttccagtccttcttcgtcccacagctgctgcaaggcgcggtggtgggaggatgctacttccagccctggccaggaacagcggggcagtacattgagagccacctccacaacaagtgggaggattggaagaaggattggttctacaccgcgctgccggatcatccgcgacttcggctcctcgccggccctcccgaacgatccgccgcgtggttagcggtttcggaactaggcgaggagtacgacgctgtgcggtatcgcctcaggggcctgcgaagccagggcctaatgggggcgatggtgttcggcgactacttccgccgtcgcatcgcgcctctccaggagcggtcccacggcgcgtgggagtacattgggcacaacgatcccattcgcacccacgtgggtgagcgttgggactggggcaaggaggaagcgaagacggtgatccggcgggtggtgagcaaacgctgattccggacgggatcctcgccctctgcagcgaccgcgaccgggagagtatcctggttgtgatgtcggccatcggtgctggcaggggtcggtcccgccggggcggcgccggtggtggcggcgatggcgcgggtagctgcggcgcgaccgcaggtctctggcgggggcggcggctccagggcgcccagtccgagccgtggacccgggggggggggcctggccagcaacccgaacgggaagcgaaaggtgtccgaatctcggccgccttctcccctgcgcagagggggcgccgagcgaacggcggaccgaccaccaacgggccacaaacgccccgccacgtccgaggctggatggaagaagaagcggcttcgaaagatagggcaaacggagccgtgccgggggagtttcatcgggcccttgaagtagaccttcaaatgcccccctcgcaggtacgatcgctagcacccgactaggtgctctctatccaccttggcctcttgcttttcccccttcttttctttcttaacgtgatcagggttctccggtagcgggattccttcccagagggtcgcggcgtctgatccctcgcaggggtcaaaattcgagcgaccggatgaccgggacccggccgactcggtgctatggggccttcgcagtaccctggcggggcccacgggccacacgctgggtctggctccgagtccgccacagccgaggtgcagccagccacaggtgatggcagcggcggtggcgcccccccggggggcgatcccgagggcgcgacccacgaggagcgccactcgggagtggaggccaaagcaggtcgtggcccagaggccgaggctgggggcgggcccgaacccgaggccgaggccgagtcagcccgagggctcgaggcgggggggacgggggcaaccgttcccctctgcatctggggcaccctcggggctggccacgtagaagggggccgagagcagcccccagtcccgcgggggtttcaatagcactccgtcatcccgggggcggaccgcgactttttcttctccgactcctgcgagcatggagccactcctgcaggtgctcgctgccgccgactccaccgtccgggaggggctcaatgcccaagttcaagccctggcggacgagcgggcggccctggaggcggagtgggcgcagctcgcggcggaccgcgcgtgggttgacgaggggcgccgcgctgtggacgacatggtggaggtggggcacaaaatgcatcaagcccaactggcggagatccaggcgcgcgaagagacgctggactcagtcatgcgggagatggaggaggagcggcaggcggcgctcatcgcttcgagcgtcctggatgaggtgctgggcgacatccgcctgcagtacgaggcccacgccgaggatctggtgaagagggttgaagacgcccgtggagtcctcgacgcggctgccgcccaagagaggcgggcatcggaggtcgatgccttgttgcgggctcggtcggcggtgctcgaggccgagcgtaaggccttggacgagcgtgcccgctccgcgcaggagttcgaggccacgatccatcgacggatcgaggtcctcgaccgcaaccagcgcgaacaggacgggcgcagctaggaacaggcgcagcgagcccgggggtggagaagcatgctcgggtgctgaaggagcgtacccgggcactggaggagtgggcgcccatgctagaccagcgcgagaccactttggccgcccacgagagaacggcggccgaggcggagtcctccctccacctccgtgaggaggccgctgccgagcgcaaccggaccaccctcgccgcagaggcttttggtggctcgttgcgcggaggagctgcggcttcgagaggaggcgtgccgggaacggaacgccgtgcttgccgtacgcgaggctgaggtgaaccgccgcgaggtggcggcacgccggctgggcgagcaactcgcgaagcgcgaggaggccgttgcgggcgcgaagctcggcatctggaaagcgcccgcgctgagcgcgcggcgatggcggcgagggcttccgagctggaggccgcgagaaagagctggtggcaggcgggcagcccagcggcgcggagttggtaagccaactcaccgcggctcaaagcactctcgccgacctggggcgcctggtgcaggaccaagccggggagatcgtggccctccgcctcaccaacgagattagacctggccaactctccgacgccgtcgaacagctggagcgcgcgggatgccgggtaggcatctccgtgcgccaggacaggaagctcccgcctacacagccggcacttgcgttccggctggacgggatggcggcagatttggagaggctggaggaggaggtcggcgaggccgtgaagtcatcgtcggcttctttggcgcgggctacggtggagctggtcctcacgagtcaccaagctcgcgaccccgacttcctcccgtggcacgcgctcgaggactgccccccggggaccaaggcgagggctcaggagcgagtccgggaggcggccgacgcaatcgtctccaacttcgaggggtcggccccttggttcaacctcgtacttgccttgaacgaggagagcgggagaaaggtcgatggtggtgatgacggcggcgaggactgggacgaggtggtcagcggcgccggactcgggggcccgagcactccgtgactatctccgcttttcttcttttattttgttatgtgctcgcggtgaacgcttcaaactttaggccatcgtgccatcctgtttgtaaataaagcttccccttcgctcctttatgttcttgctttctcctttgaatgtctgcggcaaggaaagaagaaaaaccaaagctaacgtattcaattgactttctagtgattaagttgccgctcttacccactttataccccccctcgggctcgttccggtgaaaagggaaattcgcgctcgatccgcgggacctaagtggcgaggggcaaggccgtcgccccgagggagctacccagcgggtctggccagaccgaggctacgacgaccgggggtcggggatggccgtgtgtaggcccttctgagcccccagggttcgccgcggcccgtgtttaggctccctttcggcggttttcaggtcacccaacgccacgtaggttctggagtaagcgcaaatcgtcctttgaaccaggacgagccataggaaagagtaagaaaaggcgtgcaacggcctccgcttaagcggaaaaatttattgatggggaggggaaaagatacaacatatttaacagtggtagcccccggccaagccagcacaagccaaaggatgcgcgggggttggcccgagctctaggaaagcaaaagacgcgcaactctatggatagaaacggcggaggtgttcgatattccaggggttaggcaactccgtgccgtcctccgtggttagccgaacggagcccggccggggaacgccgatcactttgtatggccattcccacatcggtgagagcttgctcagccccaagcgcgactgtaagcggtgcaggacgaggtcgtcgacttgcagtgatcgggcttggacatggcgctgatggtagcgccgcaggctttgctggtagggcgccgctcgcagggctgcacgccttctccgctcttccaaatagtcgagatcgtcgcggcgaagatcatcctggttggcctcatcgtacagcgcgacacgatgcgaacccaaggaaagctcggaaggtaggaccgcctcggcaccatacactaggaaaaagggcatttatcccgtggcgcgactcggagttgtccgattcgcccatagtaccgcgggcagttcctcgagccacgaatccccgtgcttctttaggacgttgtatgtcttggtcttgaggcctttgaggattttggcgttggctcgcttgacttggccgttgctcttggggtgggtgggcgaggcgaagcacagcttgatgcccatgtcgtcgcaatagtcgccaaacagctctctagtgaactgggtgccgttatccgtaatgatacggttgggcactccgaatcgggatgtgatgcccctgagaacttgagggcggaatgcttgtcgatcttgacaactgggtaagcctcgggaaacttggtgaacttgtcgatggcgacgtacaggtgctgatacccgcctcgggccgcttt

SEQ ID NO: 15089 - DNA, 12553 bp, Oryza sativa
tagtgggtttgcttggcgtggaactggcacgccttgcatcgcttgacccattcttgggcatcttgcaaggcgatcggccagtaaaaaccttgtcggaaggctttaccaaccaatgtgcgtgaggccgaatgggccccgcactcaccctgatgaacgtcggcaatgagctcgacgcattgctcccgagaaatatacttcaagagtatcccgttggcgccgcgtcggtagagtcccttctacgagcacataccgcttagagatacgcgcgagcttttcagcttctgcgcgatcctcaggaagagtattatcgtcgagatatgcctggatgtcagtcatccaaacaacctgactaggagggtcgggaccgacccccttgggccccgaggcccatgggtcgtcggggattggggcagagaccgtggcgccgggtccctcgggggggggggggggtccaaccgcaacgacggttgtgcgagcctttcctcgaaggtccccggggagagtggggctcgtgctgatgcgatgtgtgacaactcgtcagcgactgcgttgtcgcgtcgggttacgtgccggagcttgagcccgtcgaagtggcattccatacgtcgcacttcgcggacgtaagcgtccatttgcgggtcggtgcactggtactccttggagacttgatttatgaccagctgggaatcgcctaggaccaggaggcggcggatgcccattccggccgccgccctcaatcccgctaggagtcctttgtattccgccatattgttcgtggctcggaaatcgagccgaacgacgtactggaggacgtccccgcttggcgaggtaagcgtgactccggcccctgcaccttgaaggttgagggagccgtcgaagtgcataacccagtgcccggcgcgaatgttggcgtttgggtctcctccatctccgaggagggggggggcattggatgcaacagggtcgtccaccggggtccactccgtgatgaaatcagccagaacctggctttttatcgcgtgccgtggttcgaagtgaaggtcgaactcagcgagctcgatggcccacttttcgacccgaccagtaccttctcggttgtgcaagatttggctgagagggtaagacatcacgacggaaacccgatgcgcttggaagtagtggcgcagtttccttgaggccattaagactgcgtaaagcatcttctgggcctgtggatatcgtgttttcgcgtttcggagtgcctcgctgacgaagtagacgggccgctgcacctttcggtggggccggtccttgttgttaggagcagccggtccggggtgcccgtgcttaggggcctcgggggtatctcgggccatgtcaggattataggcgtcggggccacccgccagagcctcccttcctcccccgggggcctcggggccctcccggggtttggggggcttcgggcaacgagccgtcgggagacgagggtccatcgccagtcatgggggcccctggtcccttgccatagccgggctcgtgacgcgggtcaccttcgccacgctccactacaagggtggcactcaccgcgtggggggtcgcagccaagtagagtagcaacggttcctctggccctagggccaccaggataggtggggggaagtgaggtaagctttcaactgattgagagcttgctcctcctcctccgtccacacaaatggcctagggcgtttgaggagcttgaataggggcaacgccctctctcccagcgttgatatgaatcgacttagggcgaccatgcatctcgtgacgcactgcacatccctaagtttgctggggggacgcatcctctctatcgtgcgtatttactcgggattagcttctatgcctcaggaggagactagaaaaccgaggagtttgcccgtcggcacaccgaacacacacttttcggggttcagtttcatgcgcgttgacctaaggctgtcgaaagtctcagccaagtcctataataacatctcctggtggcgcgtctttaccaccaggtcatcgacatacgcctctacattgcgccctatttgattactcaaagtaatgcgagtcatgcgctgaaaagtaggacatgcgttcttgagatgaaaaggcatagttgtataacaaaatgtgcctacaggagtaatgaaagcattttttttcctcatcttccctagccatacggatctggtgatacctagagtaggcatccataaaagacaaaaggtcgcaccctgaagtggagtcgactatttgatctatgcgtggtaaagggaagggatccttagggcatgccttgttaaggtccgtgtagtcgatgcacatccggagcttgccgttggccttcgggacaaccaccaggtttgccagccactctaggtggatgacctctcggatgaagccggcctccatgagccgcgtcagctcctctcggatgaaggcttgccgctccggggtttggcgccgtaccttctgccggatgggtcgcgcgtccagccgcacggcgaggtggtgctcgatcacctccctggggaccccgggcatatccgacggcttccacgcgaagacgtcggagtttgcccgcaggaaggagacgagcgcgctttcctatttggcgtccaaggtaccgccaattttggctgtcttggacggatcatcgccaaggggaatctccttgactggcacctcgtcggccgaggtgaggcgcttcttggaggcgcaggacgcggaggcctccgggacctgcggctccatggctgccgccaggttgtcggcgcgctactccgcgcaggcgagagcgaccctgacatcgccgaagacggtgatggggccgctggggcccggcatcttcatctggagttaggcgtagtgggtggcggccatgaacttcaccaaagcaggtctgcccaagaccgcgttgtagggcagattgaggtccgccacatcgaagtcgatccgcttggtgcggaagttagtggagtcgccgaaggttaccgggagctcaacgtgacccagaggccacgtgtgccccgaggttatgccgatgatcggcagtgacggctggagcttcatcccttgggccttgagcgtgtcaaaggcagccggggagatgatgctgaggctagccctcctgtcgaccaggacacgcttcatcttgatgttgtggatggtcggggagaccacgagggccaacttccctccccgagcgagcactgtcggatggtcgctctggtcgaaggtgagcttcacctccaaccagcgcgcctttcgtgttgcctcgtgagtcgggactgcagccagaagctcacgtctcatggccttgaagccacggcgggaggtgtgagcgcaagcacccccgtcgagggtggcgacggtcccctgaggtatctggaattccagatccttgctgtcatcatcgtcatcggcgggggccttcttcttggcctcccctcgccggtcattggcagggctcgcgggggctttgccctcccgttgaccctgccgcttctcctcatcggctttccgaaaccctcggccaagttcttgaccaagcggcagtcggcaaggctgtgccgataagtgttgtgcaccgagcaccacttgtctgccgaccgaccctcgccggatgtagcggtggagctcggcctgtcgccggtggctttttccttgcgcggggcccgtgagggcccatcggccgcaaggacgtggccctcgtcatcagagcggaccggcttccttttccccctcctatctcgccgcttagagtggggagcggactcgggggcagccgcagccgccgcgccggtgccgggggagttccaggcccacacctcctccttccgagccaccttgtctgctagttcgaagagctcggtgatggtcttgggctccttggaggcaattttctccagcatgcggttgtgccgcacgccgttccgaaacgcataaacgaccgcgtgggccggaatgcacgtaatagtgttgcggacctggcagaagcgctgtatatacgagcagagggactcatcgtccttccgctgcacagcatgcaggtccgcctcctctcctgggtgggggtacgtgacctggaagtttgtaatgaactgctggcacaggtcctcccaggagtggatggagtcagggggctgggtcatcagctagccgcgcgcttgacccttaagagccatggggaaataattcgccatgacccggtcgtccccccccccccgatgctgccacgatgattgtggtatagatatggaggaactcggagggattgatgctgccattatacttctccgtgaggttggggcgaaacttcgggggccaccggacattcccaagactcgcaacgaaggccctacaactagtccctccaggggtgaacgtggggggcggaccgcctcgcgaggaggaatgcggcactccgaacaaggaggcgccttctcccatgcgggcagcacggcgctcgtcccggcgtcgcttaagcatcctgctccccgtagaggccatcgtgatgcctccgacttcctgaggcccctgacgacgttggggccgtggaccgcctcgaggccgtggccgaccgacgggccctcctccttgctgacgaggagagggtggtgggggtacgcgacgtactagtggtggtgggccggccacctgcggccagctgccgctaggcagtggtgaccaggttggccacgtcgtccaaccatcgctggacgggggtctctggctccgagttcacgggaggatgccgtagaagggctcctgccgcctgaagcgcgcctcggggcgagccaccgtcaccgtatgtcaggcgacgtcgcgctccgatgcgccatggcttccccccgcccggaggcggggagagggccgagccacccgaccgggtgggatcctccctccgcgaggggtcgcggcggggcggagtccgagagttgcggcggtggtgacgggggccgcggctcccgctagcatcctcactcccggagggagtgggggtgtgcaccaccacttcctcctccaagacctcgaccatgatcgtcgaaggcggaggaaaacttggggcagaagaaaataacttctctttgaagcacgcgaattccccctacctggcgcgccagctgtcgaggaatgatcctctctagcgggagatcgtgagatcctcctttttgagttcagccgggggaaagggttcacctctcgagatcgtgtatccgccctcagggtttctagatcgcgtatgggtgccaagattatacaggttcgggccgctatagagcgtaataccctactcttgtgtgtgggatttatgattgagtgttacaagggttccccaactctggagagtgctattggtctgctccctctaaagctcaggcctgctgggagttgtccccctttttcagcgggcaaggtcctccttttatagttcaaggggataccacatgcgccgctcctacctactcttttatgggagagggacccactttaccttgaccggaccacgatccgtgccttcgcccggaagctaagcggcagttcgtcctttagtgggacccggcgccgccccccgcctgccacgggggacagccctatcattccctcttaaatgagtgaagacttgtggcagtcctcctcgcgtggagggaaccccggatgacgccccaatgggacgggacatacctacctccactccgccggatacagaggcgacgtgggggcacggccacccgtccaatcggacgtggccgacaacaggccggtcacagactggtcacacccgattgacgtgggtcagtcaggcggcaccgcacgtccgcccttaccgcattaaacgcggtgagggacagttggggcgccgcgcattgatggccgttcagcctgggtctcctccccgcttgctccccccaccacatggtagttgggcgagggcctcggggaggggcagcgcgagggcctgaggggcatgacgtggcaccccgaggccccccggccgcctctgtgactcgcgaggtgcgggggtagggccaggctgtagagccacgcggctggatgtgaaggtaacttcccctcactttgcataccctcgggcccatatctccgacaatgtcctaagccaaaccaatctcgacaactgacgctggccaggcaaatctagccttctaccccattgcaagtacatcaagaaaagaactcaactcaacgaaatcaacaaaccatgcatcccaatcgaatcaaaacaaagaaaaatcgagcctaccctttggacacccattttagattcaccagcttcgtaacagattccacgccctgctctgacaacagtgtagccattgctgcaagccaattccactcctagcacgagatcacccttgcatccctattcctagtgggtcagggatgatgaacgggtcatggtggcaatgtcaaaatagagcatatatatggttggggtggcgacatagggctctaaagggttgacggatccagttagtctaaatatacaataggggtaacttgatcgcgccgtgtcaaaaagtgggccctctcatgtgtcatcagcccgaacacactgaaataatgggagtggtgtccactaggtaattatcacatttagagagtgtaactttactttttacggtgtactatagttaaaaccatgaacttatgtagtaatttgtcttgtttttttttaaaaaatggttgacaggattatgcacatgctatttacagaatttcgaaaattagaagaaacaatagaatgcccacaatttgctggtaagcgttgttaatttggttggacccatatgatgctgtcccgtatagactcctattgactttgtacaagtgtacaactaaccttttattatgtacaaataaccatacgcgtctagatcagtgtcagcttgctagcctaaggtcagttatacattttggtgatacggatcgaaatttgctttgctataaaagtagggataattgcttatttgaccctatctcgaaacgtaactatcaatttgaccctatttttctaggtttgtttatttgatcctttttcaaaaatgaagatcagagttgaccttattccgtgaagtccaactaacggtgttaacttacgggccagatgtcctttttcccttgctcatttgactatgtttatatcaaagttttttaatttgaatctttttaaaacatttataacaaatttgacatagctttgatagatttgagagctccaacagcaaattcatatcctacaaaccactaatattcatgtccctacaacagctccaacaaaccacgaattcatatcatagaaatcatggagtgaggagggagggagaggggcggcacacatgagcagcaaccaccgccgtgccactgccactgctcccaccacgaccaacatcgctcctccttcctctgcacgacaacagcgcccctctgccgtctgcgcagccaccaccgctccttcctctctctctctccgccggcgccatcccaccctccctcctcactccgtgtgcttgcgtcatcgctgttgtccatgaagcaaccaccgccgcgcgccgatacttcctctctctccgcgtcggcgccgcccctccctccctcatcactctgcgcgcttgcgccgccgccactgtccacgcagtagccaccgctactcctcctcgcatcaccgtgcgtcggtgccacccctctgttgatgcaaaaaaaaacccaagtccagtctatgattaaccaaatttagtcgttaacaccctccctcccgcctcaatccgtgcgcctgcaccgccatcgccggccgtgcagtagccaccgccgctccttcctctctctctccgtgtcggcgccacctctccctcctcctcgctctgcatgcctgcaccgccgctgccgtccgcgcaacaacctctgacgctgcccctcctcgcatagtcgccgccgcttctccttcctctgcgctaatgagttgtgttaggatattgttacgtataatcaagggtattttggttagttcgcgatagcaaatttattttctttatttccctaaccgaaaccctagcgcaccagtgaaaacaggtttagacggtggcttcaattttgaaaaactgggtcaaataagcaaaccttaaaaaaaaggtcaaattggtagttgtgcttcaaaacatggtcaaacaaagcaattgccccataaaagtaacatgctttaccattacaacgtctatttccctatgcatttgggtatcctggtctatatatccaaatgaacccatcgttaaatgaaagaggcataataacataagaaaaaattaaaataatttacagccaataatgcgcttgcttgacatctcactgaaaccatacagtccatacttcatccttgtgcatctgtcaattaacatcatcatcagagctaccgtacgagcttacaaaatcttgggccgggccaatatcaaattaactcttctcccattcgggaaagcaaaaatgtccaactcaactccttcaaaatatttgcatatctaaccgtaaaaccgggtatatcgacccatcctactattaaaccatgtaaaatgactcactggctgtttggagagtggttttcgctatgtggcgtccacgtggtagctcagtcatcacatgaattaaaaataaatgtgggtcgaacatttaaatgatatggaaaagaaacaagtactcatttgaccctattcaccaggctctaccaatctgatctcaccttttcaactatacttatttgatcccatttttaaaaattgaagattaaggctaaccttattttgtgaaggaagataaccgtgctagctaagcggcaaattgttatttttgcccttgctcatttggtcttcttatataaaagccctttttttttataaattacacccatagtacaacaacttggcgggtgggtgcgatatagtgtaagaactcgagaattaaacgttcgagtgcaataatttgacaaatgggtgtgttttagtacaagaacttaataatttaatattttgatacataaacttagctaagcatataagcatatgctaggtgagtttttctcatgatatcaatatgccattaaatagcaatcctatggatattaccttataatattgaattcaatctttaagaattatactgcatatctaattacctttaagaattttgttttcttcaccttcccaaatctcaaccaaaatatattaatttctacctccagtttaattgacttttagttattagttattaggataatataaatatgcttatatacaaatccacgctagtatgttgtcaaaataagtacttaaaaataaaatatgtataaaaaagtgctctaaataattaagttaccgcataacttcttaacttattgtatcaaaatcgtacatatcttgcaagttgttgcatttatgcgatcacttataaagttcttgaactaaattgcacctatctgccaagttgttccactagaacgctcatttctcaagttcttgtatgaaattgcacccacctgccaagttgatgcatcgtggatgcaatttactctaagatctttttgacatatttataataaatttaacatagctattcaaaccgtgcaaaaatgactcactcaattgttttgaggatggttttttgctagcgtggcgtccagatggtagctctgtcatcacatgaactaaaaatagatgtggggcctacatgtaagtgattaaaaaaaagataattgctcattttaccctattctgaaggctaactacccatctataatctcactttttcaactttacttgtttgaccccatttttcaagtttgaagatcaaggttgaccctataccatgaagacaagataactgtgctagctatggggcaaattgttattttttcctcgctcatttgaccatgttatataaaaagtcttttgtttattcagacctttttgacatatttatactaaatttggcatagctttcacagatttgagacaagtgaagtacacaaaggtttgagatcattaggacacaatgatataagtggagtacttggactttgcaggtggacactattatgaaattaggatggaccctttattttgtgggtgagcattgcaacggacccaaaaattcatcaacttgtgcttcgatgtcctacttgaaaagtgggggtcaaatgagcaaaattgaaaaactagggttaaattgcttcggtacagagtggcatgagcaattgtccctaaggaaaacataaaaaattatgggcccacatgttcgaaccgactcttcttctcctctatctttcatctttctttcgcagaaacaagcgcaagaatccagaaaaatagtgcagacttgcttgtcgccatctccccacaaggaggccaagtggcggcaatggcggaggaagctgaggaggccaccatcatcacctgggttatgaatggcatggggtggagcagcgtgcaggctgaactttttctgcatgtcggtgttgtcatcggggaagaaggttgtcgagctgagaaggaagtcaacagggttgcggcgcgaagctgccggtggccgcggagtatgacatcatggaggagatgggccgtggagctggatgttgggcgctgctgttgctctctctcctccgccgagcactcaccttgctgagcagaccgccaccgctctcacctccagtgacaagagacgacaaagaaaagaggctagtcctccccaccgtcatcatcttccacctccccacaggggatcccatcctcctcgtggctctccagggatcgttgaccgccaccgcctctcttccctcaggcacgctggtgagctttgacctcgtgtaggtcccttcaaggaggggcatgttgtggtggaggtaagtgagcgccatggggagatatgataggatggtgtgggccgggagtgccatggctagggtgagactggtgacgcttgtgccggacctaagctccttgccaccatcctctctgcctccccggctgattttcctcacgtggggccatcgcctctcttgtctatgaggaagtagctgccgcctttagctcttttttttgtcgggcactgccttggtcccaccagttgtcaccgtcggcccgaccactgcgagaaaggagaggtggacaaaatgccacattaacaaaaacatctgccaatactgctaagactttgtactggttttaatagttggaggggttgatatacccgattttagggttgagggatacaaatcagatctaacctttatctgagggagttaaattggaccttttccttttctagagtatcctactcggcccggcctggtccgaactccaaagcaaaccagcctccatccctcacgtcatccctcctcgcgcctcgtcatcgtcgtcttccgaaggatgctacgcatcggacgttcgatattttgcaaatatccgatgtctgctagttatggaggtcttactttatgcatgcacctacacctgcctctatacatgtcagtgtgggtctattattctctctttagcagagtatagcaagtacctcccactcatgtacatgcatacaggatttttctcctaaaatatttatccgatcaataatctgattatgctattgtgtttgttgcaattaaatcttcacaacaagatctaacatcattatattttgataaaattatatatgttttttcatcacttggataaatgtttcagcccacttaataagatgtttcataggggtgcaacattataaaattactaactgcaacacccataatcaatgcatgaaacattgagtcgtaacgagtgaaacatcataaaaaaacatatgtggtatacaatatgtaaataattaattctattgaaacattttttatcacatataaaacaccaagatgtaattattgaaccatgataaaatacttattgaaacatctaaataacatgatgtacaacatttgcaaacgaagtacagaaacatcatacaatacttactgaaacatcttaataacgccatatgcagcataaaatttaaaaaaatcatcgtaatttaatcatatgagatgttgttgtaaagatttaattgtaactaataaaacggtgtaattggattttagattcactattggagaatcgctttttagtctcagttgggaaccctcctatagtgactaaagatgttcattttagtcccggttgaaataaccgggactaaaaatagatttttagtgccggtttgtaacaccaaccgagactaagttaccaaccgatacaaaagttattttttttcttttttttttaccgcaaatatctccaaatcaaataaaataataaatcacagattttgttcacacatcccaaatcattcacagcaacaaaccaatatctcaacatcccaaatcatccacaacaacaaatcatacatcattctcaaatcacagataaaatcagcaaacaattattcacattattcacacaacgagaaggaaaaaagaaaaagaaattgatga

SEQ ID NO: 15090 - DNA, 890 bp, Oryza sativa
cgatctcccgtgcgctgtgagacgcgcgtgcggagatcgatgaggaaggaggagctggactacgtgctgatcccgctggggatggcgctcatggtggggtaccacgcatggctgctcctccgcatccgccgccgcccggcgaccaccgtcatcggcgtcaacgccatcaaccgccgcatctgggtccgccacatcatggaggttcgtccgtacacttgatctggttttggtggcgagcgagatgagaatgagatcgccggagtgacggggttcgggtggatacaggaggcgtcggggaagcacgcggtgctggcggtgcagacgatccggaacaacatcatggcgtcgacgctgctggcgtccacggccatcacgctcagctccctcatcgccatcctcatgtcctccgccggcggcggcggcggcgatgggctcctcccgggcgcgccgctggtggtgggcgccgcgggcgagacggcgctgtcggtgaaattcttcgccatcctggtgtgcttcctggtggcgttcctcctgaacgtgcagtccatccggtactacagccacaccagcaccctcgtgaacgtgccggtgcgcctgatccagcgccgccgccgcccgggcctcgccgtcgactacgtcaccgcgacgctcaaccgcggcagctacttctggtcgctcggcgcgcgcgccttctacttctcctgcccggtcttcctctggctcttcgggcccatccccatgttcgccgcctgcgccgccatggtctgcgcgctctacttcctcgacgtttgcgactcctgggaggaggaacaccaagaccacgacgagcaggatggaagcgggagtgatgagagatcaggagaagcgaaggtctgagcctatgtgtgtta

SEQ ID NO: 15091 - DNA, 3299 bp, Oryza sativa
ttaattatagatttaataaaagtatgctggtgttgtaaatattactacatttttctatagagttagttaaacttaaagtagttgattttgaccaaagtcaaaacgtattataacctgaaactgaaacagagggagtaatttgaaatggataaccaactcaattttccgcaaaaaataataaaaagttctcttgtatatccacagacactgcacataatcagtcctgtgaaataaccctccctaggatgagcaaaatgcaagaaacaacatatgcaacgatatatcgctgtaacaggcaagcaaatcttacgaatttgtgagtatcaaaatataagtaatctctccatcccagaaaaatataagaatcttcgattagacaagacacttcataaaactacaaatttgaataatctacatgttcagaaatgtcttatccgattctaaactattaaattttagacattttagaccgagggagtactaaataattaaagaaccgcagcatagtaataataatctaggtgtgcaataattaaagtactactagataactagaacagaaccgagtcacattctaccgtaatttacctaatatatcctaatccacaggtataaacagatcagaaaagatgctcatcttgaccccataagtttatcctcgtcgttttcacgctctctccctatttacacaagtagatgcacctgttatcaacatagagatgcataattctctcgatatgtggttgaacgacaaatatgttcactttatttatataatgttagaggaattttataattattaagatgtaccaaaatttagtacaaatttggaaggtcaaatttggtaccttccagtaccggagggagaggtacaaaattttacattgggggctgttcaaattgatgtcatttttaaccatactatttttttttgcaaaactatcaaaaaaaaaatattcacgtttagttttgccaaactttggtaaatacataagaaatcctgttaatgcctaaattttgctattgccaaagtttcataaggtttattttggctacaatctaaacatcccctagaaaatagggaaaagtccattttacaccctccaactctttgttttgtctaaaatacactcccaaactctaaaaccggatatttcacaccctccaactttcaataccgttcactttacaccctcgagtggtttttcagctggttttcgcctatgtggcattgacgtggaagtctagggtggaaataaaaaaaataggaccaaatgtcagtccatagccacggaggcaaccacctcttcttcttcttccctcatctcctcttccctttctctctctatccttcttcctcccagagctatggcagtggcattcttgagctcgtggagtaggagatcggtggtggagactctttgaggcgacggagctcaaacacatccctagcctttccttccgcgccgactgccggcgagcccgagctcaaggtccacctctcctgcagcctccaggagcagctatcttctccatgaaatccaactcgctggtggtgctagagctgcttggggacgtagagttcggcggaggcgatggggcttggggatcaggaactcaagctcgatgaggcggcggcggccggcggatgcagatatggccttgagcttgacctcgtcctcgatcaagcagtggcggcgttccataggaggactcctccccacgcgtgtggctccggcgaggtccgcctcttccgcgcagggcagcaaggtccaccgctgttgccactctcctcgctggcgactgcgtgcagagcctttcgctggcgactgcctccgcgaccatggcagcgccgccgccctcgcagctccacgctgacgccgcagccaccgccctcgcagctccacgccccgccctcacaaccacacgccgacgccacagcctatgccctcgcagctgcacgccgatgccgcagcctctgccctcatagctccacgccgacgccgcaaccgccgcccttcgcagctccacgtcccgccctcgcagctccatgccgatgccgcagccgccgccctcgcaggtccacgccgccgccgccaacgcgaacagggcagggagggagagagagtgaatatgggcttggcccatattatgttgtggactgacgtggcaagggctgatgtggcatccgacgtgtcaaaaaccaccgtaaaaacagcccgggggattaagcgtccggtattgaaagtttgagggtgtattatattcggttttatagtttggggtgtattttggataagcataagagtttgagggtgtaaaatggacttttccctagaaaatatatgatgtctcccaatatcttcttaataactataaaatcactcataattttaaatatataatatgtatatggcatgtttatcaccagcacgtctagaagacctgatggagcaaggaacttacaacaactaatcaagaaaacagtagatcaaaattaagaagaaaaagtgctttcttgatcaaaatcaataaaacaggagttctgggctagctagttgctaccaaccatgatcagccccactgtcttcttcattgtcaaatcttcgtgctgaagccaagggtggagctcggaggacgtaggagatatgctaccggcgtgaaggctgacatcagtatacaaaggtcaaagggggcaagcgctctggatttttcacaatttggtcctttcaaaaaatcatttcgcaaatagatacctgaaaatacttatcccaaaaatggtcctttttgagcgccagagtcgctggcgccgtcctcctaccaccgtggcaggtcggcgctgaggtggcagggggagcgtgccaatgtggctgccccccccggcccccgcattttttttatttttcttttattattttgatattttttcatggttaggaatataccagaaccaaccatagaaaaaatgaactcaaatggacgaaatacgtgacttgtagaatttttcctctctagtgtagatgagagagatgtgcaacttttttatttttattttattgatatttttttcatacttaggaacccacaagaaccaaccgtagaaaagtttaactcaaatggacgaaatatgtgacctgtaaaattttccaaagctctaccgaaaagcttctcgtcttgaaaacacaatcttgaaagctgaatttggaggttttaatctcgctgaactcagcaaagccagggagaattggatgtaactttttctgtagatgtccgtggatatattatttgcctgattctaa

SEQ ID NO: 15092 - DNA, 8883 bp, Oryza sativa
  unsure (1)..(8883): unsure at all n locations
ccccctgccacctcagcgccgccccaccacggtggcaggaggttggcgccatctactctggtgccctgaaaagaaccatttatgggataagtttttccaggagtttatttgtaaaataagtttttcaaaagtactaaattgtaaaaattctagggcaggcgccaacattagcgtggaggatgggggaagggagtagaggggaggagccacaatcgcgccggcatgaagaggttgggagaagggaggaagcggcaccgccccgccggcgtggaagtggagatggagaaaatggagcgtcatgtgtgatgatgtcagggatcgatgcttttaataattcggtgaagcaggtgtgttcggcactttcccctctcgtttgccgcgcgcatgcttttcaaattgctaaacggtacgttttttctaaaatgtttctatatgaaagttgcttaaaaaatcatattaattcatttttgaaaaaaatagctaatacttaattaatcacgtgctaatgtaccgctccgttttccacgcacactgttcctggttgggaacctccagtagcaaacacaccctaagggcatggccaacgcagggtacccctcaaatgccacgtgggatggggcaacactctcaaaaagctaatttcctactgtgctagtttctccaggtggtagcctcatatttttatttcagtccttggtgtttttcattttagttctcacaatttttcaatttatatagatgtttaaattttatactaaacaccctaaaatctagaaattaatataaaatctctcctcctccctcttctccccagtccccaccaacaccctccccatttcacgcctctatagctctcctctcctctcctctcccctccccggcagcgatcgaagcggcggcggctgacccatcgacgcagtggcggccggtctcgacgcgccggcgtgggggggggggggatcgatgcgaccgttctctctagtccaccccctctccatcttcttccccgcgcgggagcagcaacggcgcgtggcgacggcttgaggtgaagcatctccccaacgcggttcctctcctgtttcttgcccaaaagcaccgaaaagctgacgaaattatccggccctctgcaggggtcgcggcgctctaccgggatacggtcctgtccgagctggcacaaatatactccttggaaggggtgagatcacgctccacgttggagcgttgggcatggcctaagtttcccactaaagctggtcttttcagtttgggcctgctcaaattaatttatgagacaggccggccaacaagcccaatgggcgactacgcccatccctactatcttcccccactaacgtgcagcctgtttatttggcgattgttactgctacatccgtttcaggttataaaactttctagcattgtccatattcatattgattttaatgaatttagacatacgtatgaatatgggtaatgatagaaagtcttataatatgaaacggaggaagtacttggttctttgtaattgtgactttgtgcatctccctagcttctaggtgcaatgaatgatcagtaaattgttccattatgagtagtagaaaagcctatttgattgtcaatcccttaaaagtacagtaagtcttacacgttaacaagatttggtgagtccaaactccgaagaatttattaattaatgatttatttatttattattatgagctagataaagattaaagattttccttttatttcatctttgctataatattttcctacttccgtttcattttattagttgctttgactttttctctagtaaaatatttttagatttaaccaaatttattaaaaaagatagtaacatttataacatcgaattagtttcattaaatataacattcaatatattttaataatatttttttgtgttaaaaaatattactatatttttctataaacataatcaaacttaaaaagttcaactaagaaaaaaagtcaaactgacttagtttagaagagtgtaggtaaggttggctgattaactgcttcgcaagatttttttttctttttatcttttctatatctaattcttcttctttttaattttctttgtttgaagagtctgttactattgtggcagtgttggttcattcatccgggagtgcgtctcaaattattctatccacccaaatcacagtgtgaatgccacacatgacatgatgggaggttggtaacaaacttgtggaaaccaggagtctagggaaaaaaaaaaacaaaatcttctcactgaaacaaaaacgtcgattatatatagttgggtttattcttcttatcgatcaacttattgtgacacattccttagcatggaattcatacatatatataccaaattaccaatccagaggcatacaaaaaagatgatgaaaattaaggaaagcacacatacacacccaggaaaacctgatcaactactcgtcaatggacttgcaacacgaaaagatctttattataaaatcatttcatctttatcaatcgcttgaagttaaccggcgcagtgaaccgggcagggccatcgtaaaatgcagaggcggctagcttagcagcccgctcagtcgtgtaagaaagatcccaaaaccagtactgcttgcggttttggcagggtggttcatgttcaggtgtgcaggggggaatacagcatgtgctgttgatgttcacaaaccctgcacatacaagatataaccacaataaatacattagataaacaaggacaagtagcatttccatggtttgtgttacagtccatctcatgatcctctatcccaaccacaaaaaaagtgttcaataatttcgattgacttaccgtaagcccgagggttcatgaaggtggcatttgagaatgcgtagaagtcggcgatggagtaggagagaccactcagctgagagctgagattggaaaagaggggcttgaggccatcgttgaattccctagcgagactgttcatggagtcattgcagtcgacattgttttccaagttcttcctcatccatggctgacaccctaagggctggatgttgatgatcccaaacttccttgcacccaggccatacaactgcatgattatggccttgtaggaggaaagtgtatatggaatgttgaatggtgatggctttctggaatatcttaatactctccatatatttacagacagatccatggtaccaatgcttatcaggaataaagatttggccaacagcttgctcaacttctggtggcctaggttagcctccatctggcttaccgtgtcattgaagttcttcacttggtacacgaatggaatcgttgcttcatcgttctgcatattcacaatatagcatcaattaaggttatttccagggaaaacccagtattttatctgttaaataaccatcaaatgtttattaacactttgatctttcatcttgctagcagatctgatcactcatattcttagcatgcgtatatatagtataaccaagaaattcatcagtttgtggtagctacttttcatcatagatttcaatatcctatataaaatgttgagttactacaaagtcaaaataagctcttgatctaccgactaaataatattgggtataattttcctgatagcaaagagtaacgaacaaattgaacgaagacatgtataattgtagattgcccatgaaatggcccagcgaactatcagaagttgacagtcagagatgatattatattgatataaaattttccttatgtcactgtcagaaattttttgaaaattacaatgccgacaagatatctagtcacatgttactctcttctttcatttgcaatttccaatcattaattaaccatcatgaaagatcatgcttctgataattagtgatatagatatgcaacaattcaaatatgtttatatgaccaacttggatatataatcaccatttcttgatgccattgccatggcagcattcacaattaatattatggttgaatttgcatttaagcatatattctggagttaccatgatgatctgaatgccagcacctgctgaagcatagttcactccggtgaaattggtctccatttttatcgaactgttaagcgatagataagctggagggctcattttgaatcccatatcctttgctgcatgcatagcacacaccaattaaagttgcatgcatataccaaaaattaacttgggtatttttctcaaataaaagaatacttgataatatgcactacctttctcaaatatagaatcatatatatcaatgtaacaaagaaataccatttgcaaaccaaacattatgaaatgctgaatcgtcgttagtatttctttatattcatcattttttttttacaaactacaataacattactacctttatttgctaatgtcttctgaaagtcaatagtagtatagagcaacgaccacactaccaattagcattaattcattaattatttgtagtcgtgttgggtatattgtgggcgatttattctaactgcttgaaaacacttaaaaaatctttcggctaaagcaaaaaaaaaagactgtataataaccatcaaacatccatctaattcacaaataactatatgaaaaactatgacacagaaaatacaatttaatggtgacataactgtaaaagataataagggcaatatgatcgatcaagtcgcttaattaccaatgaagtcagccatgttgtatccattactgaaccttccagtgggctcagagccagggaagtcgatgccatagtaggggtagtcagcctggggggcgtcagacggcaagtagttgttgttgccaacgtccagcatgccgtccccgaacacgaagatcgccggtacagccgtcttatggccttcagcagagccaagcacttgaaaggatgctattatcacaaggcttagaactatgatcctgaagtgccccatcatcatcaccaaacaagccaattaaaactcaggaacactactgcatatgttatttatacagcattcatgtagaatgtatatatatgattgaactgacgattgataggaagtaaaagtgcagttagctagctagctatttatatgcacaaattaagtgtcaactatgttatcaaagtccatggtcttaattaaactgatggtatgaaagtcaaagtcaagtattgagatatgacgcttattcagtaattcctatcacatggctcatgcttcgtagttaaaagtcggcaacctcaaaccttttaaaagctaagtcatatagctctactctcaatctcttggcctacgtagattttttttttgatcttgcctaaatagaatttttagctgtacgactaatagtacttgtctagttgcagttgatttattcagggtaagcgcatgggctaattaaattaaaggtgatcaatacatccactgtgagctgagtctttctagctgaaagaagcaaggcatttacagttttggaggaagtcagcaaggtatggctggagagtagtgctgggagagcaaatgcatacacaatagcagactatgaagtttctatatgtagcctaccttcaattggatgtgttctatatatgtccctgaacatctatatagtagttgagatttataattttcattcaacgaatgcctaagattcttaagccagtaggagcatgcttgggagttgggtaacccaactataccagtgaaataatagccccccattactgaacatccacggctagatcagtggagtaaggtgcattactgatccaaaaaatgggtattgtcgtattgagcattgcatcagacattgaatttcagattgaaacatcaatttggaactacaaaaattgataaatcgattataaattcgtagcattgatcatcaaaatctcggaatagaatatcaaattgaggtggaagtagcagcctctttacaagaattcaagagcacataaggcaactatgtcaacaagagctcgataatttgtgcagacaatctgatgaacaaagcttgaaatccctagattttaataaaacgtaacacgtcggcttagctgtccatgaatcacacttgagcacacaagaaaaacaaatcgcaagatgcttcaacctaccaccagcaaccgagggtgtttgcagaaatactgatgatgcatcatctcctcgagctgcttggaaagaaagcgacgcgacggccgccggagatgtggggaacgagaggtggaggcggagaggccggcgcaggaagaaggagagcgagggaagcgcggccctccccccggcggtggcggccggccgatgacatcccatccccccgccacggtggtggcgtggcggcgcagaccgaaggggagggcggcgcggtggtggtgaagacggtgtagagagagagaaaggaggaagctcgacgacggcggcacacttgctttccggcagaatgggccgaaatacagggacaaaagggcttatttaccggcttacggcccaatccaacagtaagccggcgcagcctcgggccctcggcctcgcgcagagaaagccaacataaagagagagaagatcagatcagaagacgcgatcgaggagcgacattgccgcgtcgccgcccaaaaccctaaccccctcctcgtctcctcctcacgcgagtcgcgatgtcgcgccatcgccgtcccgccgacacaagcccgcaggccgcagccgcagccgcagccgccgcttcttgcagtgcagcttgccgctttccagattgctttgctgccatcgagtactgccgaggagaacgatcagtaaattcaggaatcaggactcggagtggtatgttttgtgttcaggtgagtgagtcaatttcctaaatctcaaattcccaattgccataagtacatgtgaaaaattgattcagttgcagttgttccctaggattgaatgttaggttaattatttaagggagtacctatgcatcttttaaaagatttttacgatcgtatcagacagatttttaatctttagattaaaatccaatagacacagtaaaaggcaaaaagcaactaagaaacaccatagtagacactaaattaccatatctttaagaaaaagaccaaatccaatacaaatttcaaaacttacatgcgaagattcaaaaattacactgtaacttacaaaagttacaatgtaagtttcataaattacattataacttacaagaaaagaaaatgtactgtaaatttaagtgagaaaatcgagtgagagataagaaaaaatctttcgagtgagatatagcaaaatcgattatttaattaattcaattgatgttgctcctagagttggacgaatcgacgaaggccctgactgcactattgtgctgcacacatgtacattataaaaaagaaaaggttaaatggtttgataactttatgcattgagaagaaattattggatgaaattgatattggtaccattatcaatgacttcgcagctagaaatgtcagaagaaattttcgaggtaaatgttcaatgtttcctatataaatattattgatgaatgcaatttaaatatttatgaccataattcaatatatatatctattgattattattatatcgtatgataagggcctttatatctagtttcacaccggggctctgaaaagtcaggactagccctgcctactctaggaaggccttgtcatctcccctgattcctttctctttatcacggaggcaactgatgtatgcatccatcatatgaatttgaggttagttcagttacattacaaatatagttataaaaggaaagtaggtttgttaaataggcgaacttatatcgtcattcaagtattctggttctgttagtactttcattgatttccgattaaccttcactccttcaatatgcaccatcactttgntatcctttgttttattaatgaaggtaatgaaatggtcttcttttttagtcaactcttcaaaggtcgtacaaattattaatatggaaacatacaatctataatagatctatacaaaagtacaatgtttattacctttagaattttttatcggtgtctgcctattcgctttcttttcttttgaccacgtaaggcgttctttggtgggcttttgtgtattttttttagtaagatcatccttatcgatgtatactacaaaagggtaagtcaaatcagtaacacacaaacataaaatagaagtaataaaatttaggatgatgtagagagttcacacattcagatattttctttggtgtttggttgttttgtttcctcttcttttcaccctgtaattagtctgtctggcatgatagcttctttttccattcgcgcttgaaaaggaggaaaattagtaccattcacatgagcatatgtaaggatgaaatagcatagtactgtgttatttttgttggtgtttgggttctgattttgtccttctttttaccccttgattcgtagatgaagttagtctgatttgttggtttgtatgttcttcatgtagaacctataagcctcttgttgctttgattgcactcgttactgtccttatgttaggtcatgttcacgttagtattatgataagttgtagtaacgttagcgagagaattttaattcactttacctccgtttcacaagtcgtgttaatgtttggatttatataggcctcttcgtgatgatttgatacaggctctctgggatcactttgttcttgttccacatcctacaatagtcaacttttttttatttttctaaaataaaccgttccgctatattctataagcgattgaccgaaaaaccatggttttttaaaatcgacccgctccggacggtcccagattccatatatagatttttttttc

SEQ ID NO: 15093 - DNA, 413 bp, Oryza sativa
atggggtttatctaaaatatgcgtgatataactagaaagacctttcaaataccacacatgagtcacgggacatgcgagtttgatgtattctatttgatatcttcatatccgagaatcaacccagactcccataggagttgcaaacgaatgtgctggttcaccaatcattgacgactcgagaattgctaaactgatttcctgggaaacgaagtcataggcatgtaggttcagagtcaggccgactacgccaatagcactcatccataaaacggtgaccggtacaaatagcataaataaatgttttttatgacttccacttctcgatcccagcccggaaaagtgcccgacccgaatgaaggaaagggatggatggaagaaagaatggatatacaatagctgcgtcagcagccgca

SEQ ID NO: 15094 - DNA, 70 bp, Oryza sativa
atatggtgttgaagaaggtggtggtctagcaacctgggcgttggcctcggcagcaaagctgcgaaggggc

SEQ ID NO: 15095 - DNA, 629 bp, Oryza sativa
gtgaagcagactctgaattttaactaagttgctaaattcaatttgatctcaggctacaaatcgcaaaaactctcattgactttcagcattcaaatcataaaaactctaattgatttcagcaattcgagtttttaattgttcaatcaatctttggatcttgatggtgctgatcatggaggcacagctagcagaccatggttgtaactaacacatatgcttgactgtactgattaatcaatgagagttttttggttgaactaatgaaatttctactgtagtcgagagaaatgacagctaaaagaacaaagtgaaatgaagaacgggctgctgctcaccgagtcgaggaggatgttagatgccttgaagttgctagatgaccagcgggtgagtgtagtggaggaagtcaagccccttcgccgtgccgcgggcgggctgaatcatccttatccatggcatgggaccatcgagacctgcagaccattacagcgcagatcagcttccccaagtctttttagaattgacacagaggtggcggcaacgaactggtggctagggtgaagcaatcatcaatttctgttggtgaaccttactgtttgtgtagtgctttagctgaaaccatctgaaggtgg

SEQ ID NO: 15096 - DNA, 323 bp, Oryza sativa
gtgggaaaaatttgaatttctaaaaatattggatttttggtctaaatgaaaaagatttattaaatcttttttgaaaaaaaaaaaaaaaaaaaagaaggagggagggaaattagacttcccttcggcggctaaggtgcggcccgagcgaaaggggcggctcggccgggcttaatgggcccgccggcccaagaaggccgcccatggcgcgcgcgcgggcggcgaggagagagagagccggtgggccgggtccatcccacgtggtcccgggtgggacccgcttgtcggtgactcggctcaccgtgagcgaagtgcacgcgggtcgt

SEQ ID NO: 15097 - DNA, 593 bp, Oryza sativa
aaaagggggacctgacctggtgcttttccttggggttgacgggggcgaggacgacggctctgtcgcggacggtgaggcagtagttctcgttggcgcggcagaagatcttgaagatctggttcgggtccgacggcgccgccggtgcctggttgtggtggtgcccgaacccaaacatcttcgacccttaattcgatcggtgcaactcgcgactcgcgagagaaatgtttttgtgctgcgactgcgagcgatgatgcgaggaggagcgagaggtgccacgttttatagaaggccaaggccggccactctcaccctcacccactgatcgatcggctcggctcgatgacgcgctctcctgtgccaactcccacgttcgctgacagctgggcccaccggtggtcctcgactggctcaaacgcgtgacatgcgtgcgtgtatgttttgcattctagccgtttgatttgaatatttgatatgatatgatatatctttggtgtttaatgtactctcagattcggttccatgaacttgacttggatgctagtaccagtaattcattgtgctgagatttgcattactaaatgtgcgagtaaatg

SEQ ID NO: 15098 - DNA, 205 bp, Oryza sativa
cgacttgggaactaggccgaaaccctaaaactcatggtagccggcttgctcctggaagaactcctcgtcagccggatccgcttcatcttcttcaacaactgggggggattatttatatagagcaagggtgagtacgggagtacttcagcaagccatgggaaataagtgttaatgcaggcttcaaggaaaggctgttgtttttgca

SEQ ID NO: 15099 - DNA, 688 bp, Oryza sativa
cccacatccacaccacccaccctgccaccccggccttttggttgttgcgttcccgtcacccccttttttcttgccttcgcgtgttgaccaagcagcgcccccctccccctccgcccaacaagaatcgcctcagcaccatcgcgttgtgctcgcgcctcctcctcgcaccacaccgccattgtatagcctacctccgactcccctccagtcctctactcagacctcctttcttgctcatgctggcagtggcgcctcgactccaacgatggcgacatacagctggcctcccctcaacctctctgtccactcctgcacgtaccggcggctactcctcgactccaacaaagacgatacatcaagccgtcatccccttccctctagcagttttcttgatttgggcacaaggtggagatggcggcggagcaggagggcacatgcaatagtcggtggttggttgaggggctatcgacgaagattgcaacctggcctccccagcccccatccactctgatttttttattttggataattttcttgtgattttcttaatttatctcctgattattttaatcatgatcaagatcgagaccaaattgggtggtcttgataaatttctactactgcccagtctcttttcaataaccgaactaaccgaaaaaagacaggatatcaagatatcaagatcaaa

SEQ ID NO: 15100 - DNA, 340 bp, Oryza sativa
tgcaactgcttgtggataaagtctcccatcggctccccccctggaaggccgtctaaccactctggcgggtcgctcggttctagtctagtcggttctccgtttctatggcgatcggcttgccaagctgggttatcaaagccattgacaagaagcgtcgcgccttcttgtggatgggtacagactcggccaatgggggacagtgccgggtgtcctggacgagggtttgtcgtcctagggatctcggtggactgggcattccggatctcaaggtggctggctttgccttgagagttcgctggctctggcttcagcgctcgggacacccctactggtctgatct

SEQ ID NO: 15101 - DNA, 273 bp, Oryza sativa
tgccaagcatggtccggacaggtgtggcctcggcccggcgaaagggctcgaggagtcggagctcatggcgttggccataaacagggacctgaacttcacctacacaccaaaccaagaccttgtcccaattgcagacgccctcctgaaggaagctgctgcacctgaggtccatggctgccattgcccgcaacggcgacgcagctgttcattcagggatctgagaattcgctgttgtcatctggaagatagccggtggttcgacggcaagattgg

SEQ ID NO: 15102 - DNA, 3450 bp, Oryza sativa
ttatctgtcaaacctccccacgattcaggtgtcgctaatgaactccccgcaagccgcccatggcaggcgagcgccgaaagccgctggtggtaggggacggccgccgcatccactcctattcaccgagatccacgggaggtatgggaccgcggccgcatccgctcctatttgccgagatccgtgggaggtacgagagctcggccgcatacgcccctatctgccgcaaacctagggtgctacgcgaccaccgccgcatgtgctcctatcagccgcaagccgacaaggagtgatgcatttttttcttttttatgttaatttcagaaaaaaaaaatccatatatggaatccgggaccgtccggaccgggtcgattttaaaaaaccatggttttccggtcaatcgctcataaaatatagcggaacggtttattttggataaataaaaaaaagttgactatggcaagatgttgaacaagaacaaagtgatctcagagagcctgtatcaaatcatcacgaagaggcctatataaatccaaacgttgacacgacttgtgaaacgaaggtaaggcaaattaaaattctctcgctaatgttactacaacttatcataatactaacgtgaacatgacctaacaggaggacagtaacgagtgcaatcaaagcagcaagaggcttataggtcctacaggaagaatatacaaaccaacaaatcggactgacttcatctacgaatcaaggggtaaaaaggacataatcagaacccaaacaccaacaaaaataacaccaggtactatgctatttcatccttacatatgctcatgattggtactaattttcctcattttcaagcgcgaacggaaaaagaagctatcatgccagacacagacgaattacagggtgaaaagaagagaaaacaaagcaaccaaacactgaagaaaatatctgaatgtatgaactctctacatcatcctaaattttattacttcttttctatgtttgtgtattactgatttgacttacccttttgtagtgtacatcgataaggaggatcttatcaaaaaaacacaaaagcccaccaaagaacgccttacgaggtcaaaagaaaagaaaaacgaacagccagacaccgataaaaaattctaaaggtaatatctaaacattgtacttttctataaatctattatatagattctatgtttacatattaaaaatttgtacgacatttgaagagttgactaaaaaagaagaccctttcattacctacattaataagacaaaggataacaaagtgatggtgcatattgaagaagtgaaggttaatcggaaatcaatgaaagtactaattgaaccagaatacttgaatgatgatgtaagttcgcctatttaacaaacctactttccttttataactatatttttaatgtaactgaactaacctcaaattcaggtcatggatgcatacatccaatgtctccgagataaagagaaaggaatcaggggagatcgcaaggccttcctagagcaggccataaaaacaggtctactcaatgtagagggagcgcatgttgaatctaacaaccctcgtgataaacgatggattagagatatggcatgcgactaactaccatttgacatggtaatacttatttaagctatgtatgtaatggctattacaatttatgaatgtatcttactgttgaacatctgcagattttcctcccaactaatattacagaaacacactggtacctagccattcttaatgccaagcgacgtgaggtgcaaatactagattcgcttgccaagccaatcaatgaacatcgacccgaactagggcgtgtggtaagtgatacacttccacttgcacaattcaaattggttttgccatgttttaaccatactgatgttgcacaaaacttcctacctgctagctatcgagagaggattacacgggacaaagaatgaacacccacagttaaaacatgattggcttgattttgttattaccaaatgggaatacaacaaagtcaaaaaattgctaaagcaaggagacaagtgggtgacccgtaaactcttccacatgatattcacatttttcaattatggtaacttgttaacctaatgactcaattcttgtagcgtctcgtgtggcctatacacccttaagttcatggagcattggagtggatcttatctcccagaaaatcaaatacaggcaactacaataaactctattcatattttgcaccaatgcttcccattatgaaaaccatttaaaatgcactccctttacattagagaaaattcctatatactcctgaaaatttactcaatcccttcaatacccctgaatttgacctcattccttatatacccatgagttttcattttaatcttctctatacccatctccattagttgaccattagttgaccgttaaatattttacaacgactatattacccatcctatacatatgtggtacctactcaataaattttcatatgaaaaaaattaacttatacaaaatacaagcaatataatcatttaatgcccaacttaaaaaataaaacttattattttttattttttaaaaaatatgattaaatccatacattagtttcaccagaaaattaagagcaaaaactaaattttatttaggtttaaatttttgggaagatatacgaaattcatcaaatttgatctgaaatttatttaaaaattttaaatttgttttctaatttgtgacaaactaattacatcccctttattttttcacaacgaatcttttttcactaaatatttgttgaaaagtaattttcaaattttatgcagaactttttttacaataaatcttttttattttaatgaaataatgttttatttttaaaaattcataacaaatatttagtaaattattccttattggttttcacaactcaaataatttacacaaaacgtttctagcttttaacaatataccaatgacaataaagtaatttctacaataactaacggtcaaactaatggtcaactaatggaatgggtacgtaagggatccaaataaaaattcaggggtatataagagatcaaacaaatttcaggggcgtagaagggattgggtgaaattacaggggcatgtagggaattggacctttacattatgcagaaggatatgaaaatatttcgacaggacttagcaggaattttgatcaagtccgaaccgaacaagattaaagactgtccactactacaaaccacgatataattaccttactatgctctcttccacttattacagattttagatactccttgagtatttcattggtcccaaacgttgttgcattttgagttaattttcatagttcagattttgctacgttggggtcacagacagtaaagcacacacataaggctcatgaaatggaaagccccatcaaatccgatagc

SEQ ID NO: 15103 - DNA, 7509 bp, Oryza sativa
aggggacggagacggcgagggagaaggatcggcgatagaggcggtgagggagatggacggcgacggaggcagggatggaggggaacggacgacggaggagagggatggaggggaatggcgtcgattaggataggatagggagagggtgaacagttagataatgacaaattacataataccctacgcgaattattatctctggacaaatatacccctccacatttctactctcattaaatctggtgggagtataactatatctcaacactacgattaaatacgatcaacggttcagattaattttactacaagtataaagcaccggaacgagactcttcccaactatattgtatttctgtgtataactcccaacagatggtttggtttatgtagaaaaggtacatacatatttatggctcggtagagcacggatcgaaggacggaatgtttgactacttacaaatcttgtccaaataaccgcatatgctgaagcatagttgatgccgctgaaacccgcatctacttcgatcaggctattattaagcgacagaaaagctggagggctcatctccaaccccatagcctttgctgcaaccacacaaaaaaaaatcatattaccatgcatgtcttgacacaattaactgatagtttgatacgagatgatatttgtgtcgagggaacatccgtcgttttgtgcctgttgtttaaaacgtcatatttttcttaaaaaaattgacaagatagattaatatgggaatgtatcactttataaacatataattcagcatatataattagagaaaacaacaaatttagcagtgaactgtatgttctatttagagtcaaatttatttttttctacatatataaattgaatttgaatagtgatatatatcaccgatttatttttttaaaacacggtacaaacgcatgcgatatatatcacaatagtgatatatatcaccgatttatttgatatatatcacaacgtgcgcgctcacctctataaatacacacacaaaccctacccttataagtacctccgatatattttgttaatatttcttttgatgattttcatgaatctattctgttaatattttttttgatgatttttaaagcaatacttaaaaatgaagagatgcagatggcggacacagaaaaaaaacaagtgttgggtgtacccacatatgccaattaaaagaaaatatatgtctttatgcatacaaacacaaataagcctcagacgcttatacggagtacataacaaaaattgtcagatagaagatataactgcaactatttatgtaatgaaagatataaattaaagaatttgtcaaaatatagctagaatctgaattctttggtgctcactaaaaataaacactaggcactgctcttgttcacatacctttgcccactcaacttaatttaagaacagaaatcacaaaatagtttcagttttcagtaatttagtttgagggaaactgggactaagagatgaaagtgcaaatatgaataagtggaggatatatagcaattgtgcgcttctgcttgttgagtaaagacagttgcacagcttctcccgcttggcaatacatcatccttctggtcgtcaccggcgctacccctaaaactctgtcggcactcagcagttcaccacgcgcgctcgcacaggcactattacttgttgctactcctggctttaatccttaaaatataaggtaatttgaagagagatgtggcaaatcctagcattataaatctggacagccgcttatatattttaggatggagaaagtacaactttgtttaacgcttacaaccaggtctgacctgctgttctggcatgtgcctaataagctattatatactccctaaacccagccgcttatatattttaggatggagaaagtgcaactttgtttaacgcttacaaccaggtctgacctgctgttctgacatgtgcctaatatgctattatatactccctccgtcataaaaaaacgaatctaataccggatgtgacatattataaaaaacgaatctaataccggatgtgacatactatggtactctctccttacaaaagtctaagtcatttctttttgcaccaagaccaaaaacaattaattcattcacccgagacaaaaccaatgagcatgtaaccgataaacactaaggagctgtttggttgggctgttttcggcccgtatcagataccagcgtgaattgattcccttacatctgtttgttttagatggaccgtaatcggttagcccgcaaacgaatcccagcccaatacaaagttgattacgctccagatcgggcgttacgcgttaccgatacggaggcggagcggagcgaacgtgacctagccttgagcgccgccaccttgcagcgcaccgtcgctggcgccgctccccctgcccggcgtgcgtcgtcgacaccgctgccccctgccccgacgccgctgcccctcccctcgcacgctccatgaccgcccggagattgcccgcctcgacaaggccgacaacccactgctctgctaccttcagtccctcctccatctccctcgagttccacatccctgacgactggatctgcgagaaggacgaggctgttgagcatcaagaaggcatggcagagatcttgaggcacacgaagaaggcaccagccaccaaggaggttcttctgtcgtttccgccgtcgccggtgagaaccctcccctcactgataccaccactctttatgatgatatacttgtgatgctgatgattgatgatctttttcttttcattaacaaatcatgaagtagtttatactagtgaatcatttgtattcttgattggttgcatgtattcctgcctcagttctgtttgctttataagtttacatgagttttgtagaatctgtttttcccgattgcaggaaaaatctggaatagtagttgatggttctttcatatttgttttcgagtgtaggtaagttccgaaattttgtcggaccaactcattttactctctagattttgagaattttgattttcattactgccaggtgatatattattttgcagagtgtgagattggaaaaaaaaaggtttgtcgtgcattgccttttcgacagaattgtcatcttgcacatatataatcaatttacttatgtttcgcagcatggactgttccaaaccaatctactcgctgaatctgagtctactaatctagtagtttcactcatgtcaattgttcatccatatatttcctcagtactttatttagacagatcacaatgtatcctcttgttgtttagttcattgaacttctgaagttctcactcccagcatgggtcttatatttactcttgagtattcggaagctacatctacaagatcttgttcagagatcttccaggatgatgctaggctgatattagatacaaattcaagaaactagctgctttcaaatatttgcatgtcaaaatggatccgatatttactcttgagtattccgaaccaaacaccaccctagcttgagatcgttggatcgagattgaactgttggagttccactgctctcatcgtgatccttccacaaggattcaagtgccaattattgcttatctcatgactgctgcgaaaattagtctcgcggtgcagctatttacttgttggttaactgcctatatatctggtatgtgcataactgtcccatgggcaatttatttctttacttgttatattccaaaaactttgttagcaaatattttttttgcagctgctgttgacattgttcaacaaatatttgctctactttctgattagcatttaattttctcttgtccaggaagttgacttcagatggccctgctttccattttcttttaaaattcactttgcagaagcaaatggagggtaaatttgcaggtgagctaacttatatttcatgaaaagtgtatgattggaaaccatagaaactattccacttgttaccaattgcataagtggaacacatatttttgggtttcgtgctctcctttaaactcacagtggcatcttttatttcttttaatgtagaagtaacattataaattggattccttgcatctttgtttgagcatgagaacatatttacatgcatgtgtgcttcttaactttggagtcaatgccctttttagaatgaagcgaggacctgcccgattattcactttcagtagtttctagatgcatgttgtccaattatatcacttgaattctaaagccacatgaccttttcttgaattattcctgtacatgccctagctagagtgctaccactatccataatttctacttgagattattaaactgatgttcacattttcaagactgtatacacttcccaatgtgtgatagtatcaaacagttgcatgttataaaattgtgaatatttttacatagctttgatgtgctacacgtgtttgagaacactgctgctatgtagcttgtaatgtgccttagctttgagctacgtcacgttctaagcgctccctgcttcggaagcagccgttacccgttaccatgttccatccaaacaatgtaatgcaaacatgagacgttacagcggccaaccaaacaaaacctgtaaagtgatacattttcttcccttactgctgtagctgatcccatttacgtttgcatttcctgacctcaaccaaacaccacctaaaatggcttcttggtacctatcaataatttaatttagcacataatgattacaaataggactaaaatggctttttggaaaaattaaaaaataaaataagtcttagacttttggaaggagggagtactacgaatctagagatactacgaatctaaagacatgtatatccagattcatatactgctagctagaatgtgtcacattcggtactaggttagttttttatgggttagaggaaatagtggacttaggccatagtgctagggagtagctagctgatcctatttttttttcaaatttcttgggtacgccagtgcacacctggcacacctcctgaagaaacgtcatctcgaaagatgaatggactttcctaatttgatacaatgaataatcactagtacaacaacaattttttccatacagcccaaaagtgattttcgcgtacggaactctggcccatctgctttgaagggtctgcataattcactatttttccacgcgtgcgggcaaaatcggatttttgcgtgcgggtacttatatggtttccacgcaaaaaacaaaaattaaaaaaaattgcaaaaaataaccctagccaccgccagatctgggtggcccccgctgccaaatttgagcggggctcatctgcccgctgcgtgatctgtcgctgccgcccgccactcgctatcggcgcacgcccgccgcccgatgcctgtcgcgaggccgacgaaggcggatctgctcgccgcccgcggatccggccgttgagggccctacagcggcggatcaggctatcgcggaccctacggtggcggatcaggccatcgcaggctcggtggaggtggatccgccagccaccgagccgcccactatcgccgatcgctccctccgcctgctgcctgcctcgtgccgctcaccgcctgtctcgtccagtgaggtgagagaggagatgaggtgagagagtggagaggaaataatgaggagagaaggtgagagagaggagtggataaggatgaaaaattttgaagtgtcgagagggaaatgaggatgtaactcagactttagacagatccttaagaagcccgtctacaaaaatatattttcgcatgcagccccttaagaggtctgcctgcaaaaataggcttatttttacgtgcggacccttaagaggtccgcctataaaaatcgattttttatatggtcctcctaaggagccctatacggaaaatagaggttgatttttgtagatgcgaaattaccgtctgcaacgtatgtctcatccagaaaaaaaaaaccatttctgtaggagtgaatacctcgagtagttagtacatatagctagctaggccacatgcatatagtgaaaataagtgaatttagggctggtttgattttaccaatatttggtaatttcaatagtgtttagtgtctatttggtttggagcaaaattttggcatgccaaagaaaatagggcatttcaatagttaacttaggctattttggcttcaatgcaaacacaactttaccttaacaaaattaaccatactaaaatttaccaaactttagctttaaaaaaattggtaaatctaatttaggctacaaaacaaaccagcccttaattaccaatgaaatcggccatggtgtagccgttgctgaccctgccggtggcattgccaccggggaagtcgatgccgtaaaaggggtgatcggcgcggatcgggtctccggcctcggacgacggcaagtattggttgttgccgacgtccagcgcgccgtcgccgaacaggaagatcgccgggaccgacgaccgccgtgtatcgttgcagccgccggcgacgacggcaccaccaagaagcatcacttggaaggttaacgctgccatcgcaaggaaagtgcccatttcatccgatccactgcccaactagcaattgtttataatttctgcagtagcgaagtgttggagctgcctgcccctatagctagctagctacttataagcacaaggtttcaagtgcttcatggatcaagtattcgtgttgatccggctagtttatcctatctattgtggtctcaagagataattaagtcaagtgttgatcgacgccagatgcatataatgattcctcatcacgcatatatatatgcataatgcatccatgatccatgcttgcatggctgatcgatgtacattgcttccaagataaaaagaatatctcctaaaaacttgaatgctaattaagtcgacggcggtcagctcagatctctatccgatccctctctctctctatatacaaaatctcatgcctatagtgtgtatgtctgccaatgaaaggatcgattgatgatatggtcaagatcaattggttatatgtttgattagttatcaaccagccgatgccgatcgattcaagcaatccaggactgcatgctacctgtgcggctacaatcactaataggagaacgatttttctatgcggtcgaatctgattttcgcatgcgggtggtcggcccgcatgcaaccaagggtctgcgtgaatcgcgattttcacgtgtgggtgcttatatcgcccacacggtaaaataaaaatcggaaaaaaaatttcaaaaaaaaccctagaatcggcagcggcgccgttgctcccggccgctggctcctcctcgtcggcggcggcgcccggctcgtcgttgtcggggcccaccttccggcagccttctgtcagcgccggcactcccgggcttcacgcctaccaccggcgacgccccttcccttcgtcggatctggggagggaaggaatgggaggagagggg

SEQ ID NO: 15104 - DNA, 19528 bp, Oryza sativa
  unsure (1)..(19528): unsure at all n locations
cgattttcccagatgcgacgagttaccgtctgcacgcaatctgaaggtccctgtccaggaaaatcgtttctgtggcagtgaatattgtgtagctgtaagattgttacacgtgcgatcactggatgtatggccatacgatggcatattggcatatatcataatattgcatgtttaacatattcacccattcagttattcagcacaaaagaacctgtggttgttgcctgcagtcggtgatcaagctaagtcgatgatgttcttttgtgctggataggttagcttaattgcgttcatgacacacgagatgcaatattatctggacgatgacaagtagcatcggaacacagagaaagacgagccgtgatggacgaatgtcgcaccgtactttttcaaaaaccctcacattctctaggttgtaggatcacaattacaatggattctagggacctattttcccaactacctgtgcaagccagcaagcaagaattccagcagcctgatgatcaagttaacacagcacatcagctattgtgcacgctataataaaatgcaccattagcagatttatgtttttttggtttccaacaagctagtttaattgggatatatcatagcaacagggttgtaatgtgttactccctccgtcccataatataagagattttaggtggatatgacacattctgtctctgtctatatagattcattgtactaggatgcgtcacatccacctaaaatcccttatattataggacagagggagtatcatttatcatagcatcgagggagtaatgcatatgtcttcactgatcacttttcgagctaaactaccaaaaaccggactagctctgacggtcgtcattgattttactaacgtgcacggggaaattcaattttccatgacgcacttatctcaaggtcagaaaattaatttccttgatgtggatacaccactcgtcacaataattatatttgattattctgacatggacaaggctgtcggtggaaataatggattcacggtggcagttgcagctaatttcggtcgtttgaaccaaatggtgggagtgccaaaaaaaattggtcgcttcacaacacacgcaatttcgctgacatgaatggaccatcagtaaatttgcatgctaataaaagatggagagaaaattattaaatggagacgtagtgtacgtcgatggtaaacagaaatgtgcaattttcacggagaggcgatcatggggcgtccttggaggggccctggtgatcttgaaggcttgatcttttcccttggcgatggctgatctctccttttcagatggcaaattaatatagagtacagaaaattgaggtggaagtagcagcctctttacaagaattcaagagcagaatgggcacataaggcaactatgtcaacaagagctcgataatttgtgcagacaatctgatgaacaaagcttgaaatccctagattttaataaaacgtaacacgtcggcttagctgtccatgaatcacacttgagcacacaagaaaaacaaatcgcaagatgcttcaacctaccaccagcaaccgagggtgtttgcagaaatactgatgatgcatcatcgatctcctcgagctgcttgccagggagagtggtcacgtacggtccggagagaagcgccggccgcggagagggtcctcgacaagtgcgtggctgctgcctgccggaatctcactcacgcgcgctgcctggaaaaagagcgacgcgacggccgacggagatggtgggggacgaggtggaggcggagagctacatacgcggccggcgcaggaagaagaagagcgagggaagcgcggccctccccaggctggttggtggctcccccggcggtggcggccgccggccggtccatgacatccccccgccccggtggtggcgaagaactgaagacggcggagagagagaggaggaagctcgacggcggcaactttctttccagcagaatgggccgaaacacagcgacaaagggcttatttagcggcttacggccgtccacaagaaaataaaaaggaaaaagtacacctaaggtccctcaacttgtcatcgagttacaaaatcatccttaaactgcaaaaccggatacaacacatcccccaacttacaaaaccagtgcaaactaggttcctaagtggttttcactccagttttgtctgacgtgacagctgactaagggtggatcctagatgtcagcctctacttcccctcccctctcataattataatactaaattagtttcatcaaatcaataattaaatatattttcataataaatttgtcttgggttaaaaatgttactattttttttctataaacttgattaaatttaaagcagtttaattttgaccaaagttaaaacgtcttataacctaaaacagagggagtatttacttaaattttttagtaagacgaataatcaaacatgatgtaaaaaagttaacatagtcatatattaaaaacaaaggtagtaagtattattattgttgttgttgctattaatgagctaagtattttagggaaaaaattactactaatgggctaggttcttggaataaaatttcttacttgaaatatacgacttagtagaactaatacagagcatgtagcgctctatttgagctaagtagcatgtattgtaacaactaaaaaaaataccaacttttaaaaatcaacttattttacttttatttcttccaacgctaggcttagttggttgccgtgttttgatcttcagaaaattccatatgtgcccacaagtttttcctcaatcccttctatacctttaaatttttaaattttgcatcatctcatgtacagttgtaccactgaatttttctttttatcccctctttacccattatgttagatttttataaaatgaatatatttccctctcttatacttacgtgcaacttattttaaaaacatcaatgttaatgtgattttttatttataataaaaatcaaacggggtagaattatttaatagcaaatttaaaagaaaaactaaaatgtgatctcgatcatctctgatcagtgtattcccatcaaatttgctattaaatatgtgaaaaattaggagatctcgatcatctccagtgtattcccatcaaccgcttgaagttaagcggcgtggtgaactggcgttctccgtcgtaaaatgcagctgctgccagcttagcggccttctccgtggtgtgccccacgtcccagaaccagtactccctccggttcccacacggcgctccgaactgctcattgcagggccctttgcagcacgcagcatcagtgttcgtaaaccctgtgtacatacgatgacaaactaacattaggaatgcatcatcattaaaaagaaatgcaagaagtaaattgtgacggttcacgaataatctgacagattttgtcaagtaattaaataccattagccgacgggttcatgaaggtggcattggagaagccgtagaaatcggcgacagagtagcggaggccggggagggaggagctcagcccggccatgagagaccccaatccgtcgttgaactccctcgcgagggcgttcatccggtcgtcgcaaccgccgacggggctgtggctgtgcggctgctccgtcaccgccggcgcgcacccgatcggcggggcgttgacgacgccgaacctcctcgcgcccagggcgtgcagtggccggacgacgagctcgccgtaggaggcgacgaggtgcgggatgtcggtctcgttgtcgggcggcggcggcgacggcgacggcgagtcgagtatgttggcgatgcggtagaggtcggaggtgcccgcggagatgaggaagagggacttggagagaagctcggttagctcgtgctcggtcacggtgccgttcagctcctccacggtgttggagaagtatcgcacttgtctcggcagtgatactgattctgcgtcgtcctgtatggtgtttgggaaaatcaggcgactgataaatagtaaaatggtaaatatttatgaaattaacatgagattcgactcgttttacctccatggaaatatttcccaactgtattgtttatgtaagaaaaggtcgtatatgtaagaaaatgtttggtttatgtaagaaaatgtatatatggcttaggctatgttcaggaggaggaggagtcctctttggcacgcaaaataaagcacatattattacataattaattagtattaactaatttattttttaaaaatagataaatatgaatttttaaaacaactctcatatataacttttttttaagaaaaacatacctttagcaatttgaaaaaagtgtgcacacggaaaacgaggaaggtgagttaggaaagttggaaaaagaactgagccagtagaacacggatcgaaggacggaatgtttgactacttacaaatctttccaaataaccgcatatgctgaagcatagttgatgccgctgaaacccgcatccacttcgatcaggctattattaagcgacagaaaagctggagggctcatctctaaccccatagcctttgctccaaccacacacaaaacaatatcatattaccatgcatctcttgacacaattagtttatagtttgataggagatgatgtttgtgtcgagggaacgccccatcgttttgtgcatgttgtttaaaacgtcattttttttaaaaaaaataggtaagcttgatcaatatacgatatatcataaacatataactttaaattcagcctatataattagagacaacaaatttagcagtgaatttttatgttctgttcagagtcaaatttgctattttgtttctacatatataaattgaatttgaacaatgatatatcaacaatctatttatttttaagaaacacagtacaaatacaggcgctcacaacgtgcacacactcacgtctatgaacacacatgcgaatcctaccactatgagcacctccgatctattttattaatatttattttggtgattatcacgaatctattctgttaatatttttttgatgatttttaggctataagtaaaaatgaagagacgcaattgtggacacaggaaaaactagtgttgggtgtgcccgcacatgtcaattaaaagaaaatatataagtctttatgcatacaaatacaaataagcctcagacgcttatacataattaacaaaaattgtcagatagaagatataactgcaactatgtaatgaaagatataaattaaagaatttgtcaaagtatagctagaatctgaattctttggtgatcactaaaaataaacactaggcactgctcttgttcacatatgtttgctcactcaacttaatttaagaacagaaatcacaaaatagttttagttttcagtaattcagtttgagggaaactgggaccgagaggaaattgcaaatatgaataagtggatgatatatagcaattgtgcgctttgtgcttgttgagcaaggccctgttctattcttcaactccaaactctaacttactcatttttcatatatagcacgtttttcaaactgttaaatggtgtgtttttaaaaaaaaatctatataaaagttattataaaagcaaataaatttatttcttaaatttataatagttaatacttaattaattaattaatcagcttctcccgcttgtgaatacatcatccttctggccatcatcggcgctaccccaaaacccgtgtcggcactcaacagttcagcacgcgcgctcacacatgtactgctacttgttgctactccaggcttccgttccaaaatataaaagattttgggtagatatgataaatcctaatactgtgaatatagacagagaagctgtctagattcatattactatgatttgtcacacatctacccaaaatcccttatattttgagatagagagagtacaactctgtttaacacttaacacttacaacaggcctgacatgctgttctggcatgtgcctaatctgctatattggctgtgtttagttcctcctctaaattttttttgacgtatacatacgcacatttgaagtattaaacgtaaactaataacgaaacaaattagagattccgcctgtaaattgcgagacgaatttattaagcctaattaatccatcattagcaaatatttactgtagcaccacattgtcaaatcatggcgtaattaggctcaaaagattcgtcttgcaatttacatgtaaactatacatttttttcacatttaatgctccatacatgtgtctaaatatttgatgtgacggaatttttaaaagtttgaagagaactaaacagaaccattatctactggacttaggccatagtgctaaggagtaggtgatccaaattttttttttcaaatttcttgggtatgccagtgcacactacacccttgggtccgctccctgaagagatgtcatatctagagatgaacagactttcccaatttgatactccctccgttccattttaattacaaccatgagtttccgtgtctaactttaatcgtctgtcttatttagttttttaaaaaaaaattaaaaaacataagtcatacatagattactgttcatgttttgtcatctaataatagtaaaaatattaatcataaaaaaatcaaataagacagacgatcaaagttaaacattagaaactcctgaccgtgcttaaaatggaacgaagggattataatgaataataccactggtagttagtacgtatagctagttagctaggccacatgcatatagagaaaaaggaaatgaatttaattaccaatgaagtcggccatggtgtagccgttgctgaccctgccggtggcattgccgccggggaagtcgatgccgtaaaaggggtgatcggcgcggatcgggtctccggcctcggacgacggcaagtattggttgttgccgacgtccagcgcgccgtcgccgaacaggaagatcgccgggaccgacgaccgccgtgtatcgttgcagccgccggcgacgacggcaccaccaagaagcatcacttggaaggttaacgctgccatcgcaaggaaagtgcccattgcatccgatccactagccattttttacacttttctgcagtagcaaggtgttggagctgcccctatagctagctagctacttataagcacacaaggtttcaagtgcttcatgcatgcttgatcggctactttatcctagctatatattgtggcctcaagagataattaagtcaagtgttgagatgccagatgcatataatgcttcctcatcacgcatatatgcataatgcatccatgatccatgcatgcttgcatggcagatcgatgtacattgcttccaagataaaaagaatatctcctaaaaacttgaatgctaattaagtcgacggcggtcaactcagatctctatctctctctctctatatataaaatctcatgcctatagtgtgtatatgcatgcttatatatccagtgaaaggttcgattgatgatatggtcaaggtcaattggttatgtttgattagttgtcaatcagccgatgccgatagattcaagcaatccaggactgcatgctacgtgtgcggctacaatatgttgaaattataagcgcataatgatttaatttattccataaataaatcatgacattgcagatgtaaactagattgaacgcatcattagatctacacatgtaaactaagcagtaaaacatgagcagatcaaatatgcgcaacatgtcgaacacgtaccgaggtggcggaaagaccggttgctcggcaggaactactcgcggttgcggacgtcaacgaaggcgcgcagcacacgagcagagaggaaggcaagccgtcacggacgaacagggagcagtcgcgcgaagcatttcccaaaaaccttattgccgccttctcccggtgcaggacgtcgaaggcagaggttccggagacctgctctcccgatcaccggtgcatgccggcgagcgggatggagtagtctacgagtgacggcgcagtacagagtaggaggcaaaccctagattgatttcgcgtgtgttgcgtgaaggcggcggctcggtttatatagaaataggtcgcttgatcggggcgcccgcgtaaccaaaccggataagtcgcgcgtaacttatccggactccacgccgttttcacgcaccggatttttcggaatgtttcaaaacaaaacaaatccgaatttcctgcagcaaaacaaaactgcaaaaggagactacatctgcgcaagggtgaggagccaattttgcggaccatttgacgtgtacgtcgtgcacgcgcgccgcctgccttgccaagccaggcgaggtgagcgagcgcgcgtgtttcccctcttctctccaccacacatgcttcaagtggctaggagggcatcctcccttttaaggaggtccccctctcatagaaaaagcaaggtggtactaaacttcacatgcatgccatcccatgaggtgggcttttgtgattttcaaaagaattaatcttcgaatgggccttagcccatctattaattccaacaatcccccaccaaatctcaaaatcccactgagatttgccttttccaatgtactgtttatataccagcggttcgatggagaccgattaaggttaaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctagatctttagtaagattcctagaagattcacccaaaatctctatagactgcgaccaacagtcaagcttacaaaggtgagttctttcaagaatgctctgcaggacatcatcttcgctaattaaagccaacagaactcattaaggcatagccaacctgccttgcagctcacgagagtacatgcatcttcacttagagagggtatagattggtactctcctctagtttactaatggtttgttcttcccaggttctaattcacgggatctccgatcacatagactgggttaccaccatagtataactcacatgggtctcaaacctatctcctacgatgcattgtctatcacatttcgtgatagtcccttcgtgaagggatctgccaggtttctagctgtttggatgtaatccaacgttataactccggagtttctcaatttcctgacagacttcaatcgtcttttcacatgtctagacgatttcttattatccttagaactattcactttgacaattaccgtttgattgtcatagttcataaggacagccggcaccggtttttcaacaataggaagatccattaatagatcacgcagtcattctgcctcaacagtagcagtatccagtaccgtcagctctgcttccatggttgacctcgtcaaaatggtctgtttgcaagacctccacgaaacagcaccaccacccagtgtgaagacatatccactagtggcttttatctcatccacatcagagatccacttagaatcactatatccctccagtaccgcaggatacctagaatagtgaagccccaattccatagtatctttcagatagcgcattactcgctcaagcgcacgccagtaatcatctcctggattagaggtaaaccggctcaacttgctcacaacaaaggagatatcaggcctagttgcactagctaggtacatcagcgagccaatgatttgggagtattccagttgattcctagcaattctcttgttcttgcgaagcaacaattgtcgacctccgattttggaaatcggaaatctcctatgtttatcagtaccaatccctggatcagtagttggtacacacatacatagccgaatcacaacatatcatgaatgaattcaggctaaaagagttaaatgcttacattagggcctggcaggccaacaactatcagagaaacaacagcggaagacaaaataatacaggggcccggttgacataccacaagcagtcgactgggaaacgagacctagaatggaattaaactccgatcatcttgttaggtacgcaagcgcactaacaagggcttctcttcaacactctgctaaaagatatatatagagcaacaatgagtacaaaagtactcagcaagccaccacacaaaatgtagtaatgtacaggataatacaaggagtggctatggttactttgcgtaaagctgagttttcaaatatcatttcacaaacctaagacctagcataaactgatcaagttttaactccattgttcattaaacagcgacggttctatccaccatccattgtgttcccaaggatagcttcccgccactggccatcatggttttctggggtctaccccttctcgcctctcgagaagttgatccactagtacaaaatcatgatgcatatcccatcccaatcagattaagaaattagagtctagccaagtgtaatacatgtcccggtgctcaataaccgcgagcacggctattcgaatagatttgttttactcacactgcagtggatgtacactttacccgtactccgcaactgcccaacacatgagcctcgtcccaacacatgagacgcgtcacggcaaagcctttcaataacctcacattggcagtacccgctccatgaacttaagtcctcatgcactctaggcgtcataagtttctagcagtgagaggagttctggcgctcccgaggaagaaaactcacgcaagtctaacatcgcatcctgtagttgaacccaatctatgctgtcctcttttgggtatctccttgtagtcttgtagtcttgacaagtcagtctctggccatccgtatcgggtatccgccatctggccatccgtatcgggtatccgccaacagactgcttgttcatccacacacctaagtgaaaccactatgcaggggtactgcctccgctcggctatctactccgctaggtctatacccattcgagaagtacggttgtattggggtcgtttcatgcttagcttcatggctctgtccttaactgaccagggatggcactagcctttaccggacaccacccaaatcatccagccgccccagtcgaaaacatttgtttagttttaattttctttcacaaatcatctcatcaatgccatggcaatgtggcactcatgtctctacatgccgtatctcaactaccctccccaaggtagttgcccaagcataaagcatttgataaatatgagaatgcatgaatctaaattagcattactcagcatttgtcacaagtgactatggactcatacgtaattatgggtacaagggaataatgagataagcaataatcaaaggcatggcataataacaagtaggatattcatcattgcatgcaattttatttgtaaacaaaacaatttcgcaattgggatcaacatgctcaaggggtggggtgatgacttgcatgctcaggatagttcttattcttgatataatcttgatcaaccttcacctcctggaagctgcatacgttgcctcacgactaaccgatatacaaattctataatacgcgagaaaaaccaatattcaatcaaatatgcacaagcaaaatatagttgttggggtcgattcgtgtttgcaaacggataatctcttaatcattcctattgtcatggcggcttgtttaggatctaatcatcataatataaatgggatacacatttcattaaatcagagttgatctatcgagttatggtaggagtatgaccacatatgcttctaattagtttacatgggttttacagtgataaagcatggtaaagagaattatcctcacacctagtttactgtacaataatcaattttatttattagcatatttttaagttgatcataatctaatcatttgatattaattatgtaacaattataaatatattttactaaacagtgagttacataccattggaaagcttatgaatttagataaatttaggttcaagtttcactcgaatcggagctaaaatgaataagttatactagtttaaagattcaatttcgaattaatccgagaaattgtgaaaagttactgttcctaatagatttgttcttaatccgaaatcctatccacaactacattgactgtcatgtgggaccccgggtttattccttttccaccggattaatttttgctaggggaaatataggagtgggcccggcctgtcagtggctcgaatggaggtcgtcttcaacctccagccgggcagaggcagccgtgccatgcgcgctgggcacagccgggatggcgcgaggccggcacggcggcggctgcggaaagtacggagaggctccggcgacctcccaccaccgtcagcgacgcgcggcggagtgagggcgagtggcgcagcatggctgagctcgggcagctaggtgctagggcgatagggagggtttccgaccaaactggtgagggcgtgagcgtctacggcgtatggggattcgatttcatcagctagatggagaggggagctcccggatggcttgtccacggcgagctcgccggcagtgcaatggcggccaggccggtacggccacgggtgctatttggcgaaattggagccgatgctagctattagagagttagaggatgctatggggtcgagggattacgctaggatggagagacggcgaagggcggcgacgcgtggtgcggtgcagacaaagcagaggtggctagcggtcggcgatgcccgaaagtgttcgacgcgtggttcccggtgtccagcggtcctcagctccctcaatggcgacggcggcagcacggctcttcctccactccctccaacctccagctccggccggggagcctcgcaatgctgatctctagcggtggtgagagagtgatcgcaaggtgctcgatgaaatgtattcgggaagaaagctgagaggaatggggatttttgttgggggcttagcttaggatgtaaggaaaccatggggataagatcgccggcacatggcctggatgagctagagctctaatggcaatcggataaggaatatgaggtggacgacgcggataagggtttatctccttctccattaaggttctgtggcttaatcatcgcatctataacctatgtactgcaggtctaggcgctagctggaggaagggcattgttttgtccagcgggcgcggtagggatgcgcagttttaaccgatggacgcagagcggcatggtgacgatggcgatgctccgtgtttcttggagggaaacgggagagcggttggaggccgggattcacggcggaagagcggcttggcgtggctcgagtttggcgtggtgcggcacatggaaacggtgcgacgcgggtgcggcgcggtgcatgggaggggtggatgcggcacatggcacaacgcgagcgcgggagtggcgcaagtgcggaggcatggcgcggcgcggcgtcgggtggtagcgagatcgatgcgatgcacgcggcacacgggagcagtgctgcaagggttgggaacgggatggatgcgttcctgatctgctgggctgggcctatgtcgaacaggtgtcgggcaatgaacagtggcggctaggaaaagagagaaaaggaagaaaagcgaaaggaaggaaagggaggggctaatctgcaaaagtgaatgggattggaatttgaattgagatgtaatatatatattttggttttgggaattcaaatatgtatttgaatatttacttatttccaaatgaatttgcattatattgggttactctataattaacttaaataattgctggctgtgatatagaattaatatatttccatagaatacattataagggtggtggtatatttactcaatttatttacatgaccaaatattttatatgagtgaatctattccatgagagactcaatgaacattataaatattaatataaatattccagtggaacgctcctttatatagggtcatcgtagtggcgattatttcatggttgcttagatgtcctgacacttgtcaacatggttcaagtatttaacattcaatttgtagtctgcattatagaaattaataattgacttgtactttattcggcttgctatcatgtgcacaaatatttataggattaataataattatcttattctaattactacttagttgtacagctttagcttaatcttcaatcgtgaaaattaatagtttggcaagcaatagcaaccataacatctagcatgatgcaaaagttctaaaaagtttaaaattttagtgatttttattgtcagaaattttcagggtgttacaacaatctactccttccgtccaaaaaaaggcaaaccctgggtttccgtgtctaactttaactgtccgtcttatatgaaatttttttataattcatatttttattgttgttagatgataaaacatgattaatactttgtgcgtgacttgtctttttaatttttttcataattttttcaaataagacgaacggtcaaacgttgggcacggaaaccagggtttgtctttttttgggacggagggagtaggatcataaggtgttggagaaggcttactatcaatgtagccaaagcgattcaagatcttctccacataatgggactgcaagaatgtaatcacattctcacctctaattagcttaatgtttaagataacatcagctactcccaaatccttcatatcaaaattttgagacaataatgatttaacctcatttatcacctcaaggtttgtcccaaatatcagtatgtcatcaacatacaagcacagaataactccctcacccccaccatagcgatagtacacacatttatctgcctcattgactgcaaagcctgaagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatctagctctccattaagaaaagctgtcttaacgtccatttgatgaacgagaagaccatgtgtggctgctagggaaagtagcacatgaactgtggtcaatctagcaacaggtgagtaagtgtcaatgaaatcttcgccttctttctgattatagcccttagcaacaagccgagccttgtacttttcaatagtaccgtcaggcctaagcttcttcttgaacacccacttgcaccccacaggtttacacccatagggtcgatttgtcacctcccaagtcccgttagcgataatggaatccatttcactacggacagtctccttccagtagtctgcatcaggagatgcatatgcttctgaaattgacttaggagtgtcatccacgaggtacacagtgaaatcatcaccaaaggacttagccgtcctttgtctcttactccttcgaggagcttcactgacatcctcctcaatgacatgtttatgtgtatgttcagtttgttctggttgtgtgattgaacggggaattacttcagagggttggctcgaactactatgtgtatccttcattgggaaaaagctctcaaagaaggtagcatcacgagactccataattgtaccaacatgcatgtcaggtacctcagatttaactattaaaaatctataggtaatgctgtaatgagcatatcccagaaagacacagtccacagtcttaggtcccaatttgcgcttcttcgttattggtatattgactttcgccaagcaccctcatgtgcttggtgaaagtgatggttttctcccaatccatatctcatatggtgttttgtccttatttctgttaggaactctatttaacaaatgattcgaggtcaacaatgcctcccccaccatgccttaggtagtcccgtggtgtccaacatgtcattcaccaagtcagtcagtgtgcggttattcctttcagcaatcccattagactcgggagaatagggaggcgtcctcttatgtatgatgtcatgttcctcacagaataagtcaaactcgtttgagaaaaactctccaccacgatcaaacctaagcctttttatctttttgtcaagttgattttcaacttctgccttataaattttcaaatagtctagagcctcgtctttcgttttcaacaagtacacatagcaaaatatagtagcatcatcaatcaacgtcatgaaatatcattttccacacttcgtcaacaccccattcatttcacaaagatctgaatgtaggagttctagtggtgccaagtttctctcctcgacagccttgtgaggcttgcgaggttgcttcgattgcacacaactatggcacttagaacctttgacagtgaagaacttaggaattaaacacatgctggaaagccgagacatcaagtcaaaattaatatgacataaacatgagtgccaaacattagcctcatcatccacactgccacaaatatggttcacagacttattgcagaaatcagaaagggaaaagcggaacagtcctccgcactcataacctttaccaataaaatatccatgtttagacacgactactttattacactcaaaaaccaacttaaattcgtctctagtctgacgggagccactaacaagattcctatcgatagaagggacatgctgcacgttcttcagctgcacgatctttcccgaagtaaacttcagatctaccgtgccaacaccatgaaaagaagcatgtgacccattccccattaggacgatggaaccccgtgcgacctgataagaagaaaacaataagatgtcagcacaaacatgtacattggccctagtatcaacccaccaattagtagactgattaactaaaaaaacagtaggtaaattactatacccgcctccatctccagtgttgccaatggtcacattagcagacttagaagtctgccctgcaggtgccttcatccccttgcgttgtggacacttcctagccagatgaccaggttggccacacataaagcaagtcctctcatcctgattaggattgttgttgttcttcttcttcttcttaaagttggtggtctgttgagctttgtatttccccttgctcttgttctgagccttatgcacaacattggcactggactgcccactatcacccttagacgcagcatctttttcccgagctttcccctcaacattaagagacgctatcaacccctcaacggagtattcctatctcttgtgtttgagtgcagtaccgaaacttctccaagatggaggtagtttcgcaataatgcacccagccacaaatttatcgggtaagacacacttaaggagttcgagttccttagccatggtttgtatctcatgagcctgttcgactatagaacggttgtcagtcatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgatcagcaataagaattccttcaggtttgccagtactcacccagaagcatttcatagctgtcagccacagagtgaccctgatttgccatctcttaaagtgcacaccggagaatttatctggcctcagtgcatcggcaaaaccagccatagtaaaatcacagcgcctataataaggtttttggattgttgaaattataagcacataatgatttaatttattccataaataaatcatgacattgcagatgtaaactagattgaacgcatcattagatctacacatgtaaactaagcagtaaaacatgaacagatcaaatatgcacaatatgtcgaacacgtaccgaggtggcggaaagaccggttgctcggcaggaactactcacggttgcgggcgtcgatgaaggtgcgcagcacacgagcggagaggaaggcgagccgtcgcggacgaacagggagcagtcgcgtgaagcgtttcccaaaaaccttattaccgccttctcccggtgcaggacgtcgaaggcagaggttccggagacctactctcccgatcgccggtgcacgccggcgagcgggatggagtagtctatgagcgacggcgcagtacagagtaagaggcaaaccctagattgatttcgcgtgtgttgcgtgaaggcggatcagggcgcccgcgtaaccgaaccggataagtcacgcgtaacttatccggactccacgccgttttcacgcaccggatttttcggaatccgaatttcccgcagcaaaacaaaactgcaaaaggaggctgcatctgcgcaagggtgaggatgccaattttgtggacaattcaacacgtatgtcgtgcacgcgcgccgcctgccaggccagcgagcgcgtgtgtatttcccttcttctctccaccacacatgcttcaagtggctaggagggtatcctcccttttaaggagatccccctctcctagaataagcaaggtggtactaaactccacatgcatgccatccgatgaggtgggcttttgtgatttttcaaagaattaatcttcgaatgggccttagcccatctattaattccaacacaataatgtactccctccttcccataattaagggattttagagggatgtcatatttcctaatctatgaatatagagataagcctatccagaatcatagtactggaaagtgttgcatccctccaaaatctaatatatttaataattaatattgcatgtttaacatattcacccatttagctattcaacatagaggaagatgagccgtgatggacgaatgtcgcaccgtgctttttcaaaaaccttattcacattctctaggttgtaggatcacaattacaacggattctagggacctattttcccaactaccagtgcaagccagcaagcgagaattccagcagcttgattaattatcaagtcaacacagcacatcacctatcgtgcgcgctctaataaaatgcaccattagcagatttatgttttttggtttcccacaagctagtttaattgggatatatcatagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15105 - DNA, 614 bp, Oryza sativa
acagctattgcttatattaccataaatgcaattgtattttgtatacaattatattgatcaatttccgttataatatggactcgtcgtgattactaacatagatatttctcttcccccccccctgaataatgtcgtaattttgaggcctcgaagcaaaaatgatggctacttttggccttctcttcagaatactataatagatgccttacttgcatatgggcaaaaattcttggcaactaagcatgcaatctctcgtggatcatcttatttggtaagagttggttagcataaggagcttgctatagttcaaatggcctaaaagaattgattaatttgtttcaaaggaaggcatggctggatttcagtggtggcataaattctccatgttgatctgggtgattgcaaggatgattaacggcatgactattgtttttgttgcaagcgacggatcctttttatagcacatcatttgcatacatcagtttcccatgactacagtacagcaacgaagtttggtaatcccaacagtgttacagcatatggttctcagacctagtagctgctttgtgggtgcaagtgtcagacttcatgtttgagatcagtccaagctgagt

SEQ ID NO: 15106 - DNA, 273 bp, Oryza sativa
ctgagaattaactccatttggttgaattggaaggtggatttggagcttttggtggtaatcaagggtctggcttctcggcatttgctgggagtggctctgctggatctggaggacccccagcgaatcttttgacacagatgagaaaataacagagttgtttccaggatcctagttcttcattcctttcggctgcagtggcccttatgcatgcaccaaaaattggtcttcgtgcattagctgtagctattgtggaactcccagcacctggtaagt

SEQ ID NO: 15107 - DNA, 568 bp, Oryza sativa
tgttaaagcctgcttgccatccattaacatttctttagttgaaatccggaatttctatctagcgctgtttttgaaattaatgtttctaaaaatagtgtgcgtagtccgatgacctgaaaaattcgtgcgcatatgcacagcatatatgcaagttgaatcaagccccaactgtatgtgtttatatatgtgtcgcccagcgagaggagctcttattgccaggtaattaattaacttgtacaagatacaagcacaccacacgataatcatacggtacggacgagcataagttactcttagctacgtatataggtgggtagctagcagagaataattattctgcaccagattcgttgatatcaacttgagccttgatagagagctggatcgatgtatcgatcagctcagtagtagggctggatcttccagcgctggttgtcgccctcgcaccacttccagagcacgatgttggtgccgtcgcggacgccgccgtggtacttgtcgccgtggaaggcgtcgaagttgaggtagatgttgttcaccatgcggatgcacctgaacccggtcccca

SEQ ID NO: 15108 - DNA, 711 bp, Oryza sativa
tgccgcatgtccttgtaccagtgctgcatgccatggtccggattagagagaagctagtaattaagagatgagcaccgagccacatagcatagcagaagaagaaaatattatggtggtggtgcctgcagtcgtcgcgggggttggttggcgcgaggacgacggcgtcgtggcggacggtaaggcagtacccctcgtcggcgcggcaaaagatcttgaacgtcggctcgtgctggggaccagtcgccggaggctggtattggccgtggccgtgcccatggtggctgaacatgctagctagcttccaagggccggcgtctggttgtctcgctggtattcgatcgttgcaaatggcacctcccgggttatatagaacaaattaagctggaggccggccggcgagacgttcgttcgttgagaccgaggccgcgtacgtggtgccgatcgatgagaccacacccaccgtgtcgtgtcatgtcatcttctggagtacatagggcctgtttagttcgcgaaaagaaattttttagtgttacatccgatgtttgaccgaataacggaagggttttttggatacgaatgaaaaaactaatttcataactcgcctggaaaccgcgagacgaatcttttgagcctaataacccgtcattaacttatgtgggttactgtagcacttatggctaatcatggactaattagacttaaaagatttgt

SEQ ID NO: 15109 - DNA, 1014 bp, Oryza sativa
aagttacgtggcattgaggcattgacacgacatttctctcaaaccagtgcgtcattgtcgccacaatacgcatcgcgctatagtataattagtttagtcggaacatataaaaattgatcataatgtcgtcattttgttaatcaacttgcccatatattatttatgctccctaacaaaatttgtcaaatatatattgatatgacttgagtgaacctgaatgggccggcacatatatggcacaggtcaataaaaggaagttggccaccggtacgctcgtgtcatctttgataagattgttcggaattttatttcccttaattatatttgttagtactacacattttgtcctggggctggaattttctacctgatgactctagtactccacatctgagtgatgttattttatccgtggcacacactgatgcagttaataactaataaagtagtataggctaggattgatgttagttggtgaccggcctataaatgagtgtcgcgttttcaggcaggattattgtatagttgtggtttgcaattctgcgtgctacactgacagaaattagcagtagtaggagtagtatactagtatatattactattatatacttacatcagattgtataaagtgtatgaaactgtgacagtctgaaagagtagtaatctgccgggaatatgggtatcatgagattcccaaagtatgtagtcgtaaaagcagcaggtaggtacgtggattggagaatggtgcggtcgtgcgcgcgtcctggaaagcaatataatgcccgtaatatcgtggatttgtgcgtgcgtttgaccgtcacttgttcggtttggccggttggggttgggccgggggggtgtcccactggcaaccaaattgaaccccattgctagatttgtttcaatctttgacccatactcatactggagtatctactagtatctgtggatccgaaaagcaagacccatatggaagaatttttggtcagatcgctagctagcagctggaccttt

SEQ ID NO: 15110 - DNA, 1171 bp, Oryza sativa
  unsure (1)..(1171): unsure at all n locations
ctgatgcagatgctgctagctgcttattctgatgagacgcggaccagaatgctctgagctcctcagcaaatcccctctccctgccgaaaaccaccgtcttgtggtcgcaggcttccatgagtcggagctcggcgccgggaagcttggccttgaggtggcggccgcactccgccggaaccacctgatcgtcgccgccgtggatcacctgcaccgggacgccggccgcctcgacggcctccaggttcctgtcctgcagcatggccccaccgcagatgacgttgtgcatcgtgtgccacgccgagtggtgcgtgtgcttcgtcagatcacccagcagaaagtccacatccctgcagcatgcaacaacatttttttttgtttaaaatcaatcttagttaaaaggagctttgttttctgaactctgaattaatcctagtatgtgattacctctttcctgtgatgagcctgaagaggcgctcccagagcaggtgatttttgcagaccaagaagcagacagtcctnccaatgtgctcgtaccatgacatcactgcggatccgaactgcaatggcggccacagcttcttctccgccagtctcttcagtgccacttggctcgccttctcttcgcatgctccgaagtacggctacaaccaaagtcaacggatcgatatttccttaattaaattcagagctctcactgattcttcttcagatatatatgtactgtacttaccggtgcaatcagtgtgattgatctgactcgttctgggtgcttggcagccaatgcgagggcgatgatgcagcccatggagtggctgacaagatggaaggagctcaggttgagtggatcgatgaggctccgctcgatcatctcgacgtgatctttcagtctgtacatgcagtttgccggcttgggagacttgccgaagccgaggagatcgaccgccaacattctgcagttgttgaggatggatgattcgcggaacactgttgcccagaacgacgatgacgaggtgaagccgtggatgaagatggcgtcttcttctccactctgctgcgtcgttgtcactgctccatctgcaaaagctaagctcgcgaacgttaatgtcgccgacacggcaaagcgaaaggattgtaacagaaataacggaagcggttgagaccgtttggcggc

SEQ ID NO: 15111 - DNA, 576 bp, Oryza sativa
attattttgtgtgtaatcgatatgtgggtcccacagtttttaaaattattttttatccgattgccacgtaagcgccacctgggaccagacctagtcataccaagcatgtaagcgccaggtcatctcaaaccgggcacaatactaccaacggacctcgtctgcacagttttggtaagttgggggatgcgatgtatctggttttgtagacggagagatgaaaatcagactgggcgacgaattaagagacctaaagtgaacttattcctctcatcctccatccccgctgcttccggcggctgccgccattccatctcccacttccccgtccattgccatcaatcctcacgccaagctagctatagctacgatggaacgcccttccactccggactccggttgggtcatcctcagcaccatcgcggtcgcggcccgccggcacagcaataatggtagcaccgccattaatggccacaccaggaacggaaacaccatccatcgagggtatgtatccctctagatctttcgcccacccaccaccaaatccctccatcgtcttcgtgcacagctcagacatga

SEQ ID NO: 15112 - DNA, 1290 bp, Oryza sativa
cgaataatgctagacacctatagtttaaacatatttcaaaatgtacctgaagatgactcttaagatggtaaagggttaatcccagaatttcccatgagcctcatgattgttttcggcggcccctctgaagaagtttcaagtgtagccattgtaagatatgcaaattaccattcctctgctgcttcaaagcatgaatgattaattaagttttgaatactcactgtccggccctcccagctgatttactgcttccacaaaacgctcatgcaactctgatgtccattttaaccgaggtttagcgtcggtcgagaggacaagccctgatgatgaatctgctccgccttgcaggagaaattgcttctccggaggcaaacccggccttgaagacaggtgctggctatcactctgaacctgttgctgatgatacatcatctgccatcaaagatgtcatgttcctaatttgcagatatcatcttgtgtgagcataagcatatgatacgaaaggcctctcttccttgcatggttcaaagaaactaacacagtagtacatacagacctgttcagttccagtcatgcactgaaatgtctgtctgcttgtagtaggctgcacatttatcagtagtgataagatcctctgcagcctttttcagtgcctctatttgtagtaaccaaagacttgattggattatgtgtgtatggtcttctgggagtgagacaaccttggcttcttcagactatctgcctctccaatgactagctgctgctgcctctgctcatgtcaaggtctcaagcagagagtcttgagtctttataaggcagggaagagaatgtggaatcactgggacaacacacacactcaagcctgcctgacccaatctttgcagcaactgaaaagagatattatccttattctctcagggtgcccgtggaccctaacctctgccgatcttttccattgtaaattccaaaaacgctctcccattctgattatacacttgtaccaactttggttgaaattacatggcacatgagaagggcgaaaggcgaagaacaatcttttatttttcttccttttcttttcttttgagaaactagggggagggaggggcggggggagcaccttattctcatgacaactttggggctgtggtgctgcaaacctatggtgttagaacttgccggcctcttcggctggattcctgaatgatatccatagttgagaactaattctggtctccactgcatttctggaggcctataagtgttgaaatgaaagggcaacatctgtgg

SEQ ID NO: 15113 - DNA, 706 bp, Oryza sativa
ggccaccggggaagccatcaagcactccctcggacagagccaccctgtatgtacatacatacatacatacatcttcttcattagataattaattcagtctgtttcatatatgtcaaaaaatcagtcaacgtagtggttggagcgtcgtagtagtagcaatcaacgcttacgatttctggaatggcgtcacatgatgtgaatttgtcgcaaaaccactactacactagtagttgatgatctgacacgttcgtctgcacgcaggttaggctggtgccatacaacccggagtacctggacgagtcggtgctgtggacggagagcaaggacgtcggccatggcttccgctgcgtccgcatggtgaacaacatctacctcaactttgacgccttccatggcgacaaggaccacggcggcgtccacgacggcaccaccgtcgtgctctgggagtggtgtaagggcgacaaccagcgctggaagatcctcccctggtgtaagtaattatcaccgatatatagcttaattagtcagaatctttcaactgacattgtttggttttgttccttctgacgcagaaatgaaaagccggtcaccaaaagcatggatggatcggtccctggggctggaattgggcatggttcgagtccgcccaggcaggcaggtggtgttactggtgcgtgtcctgtgtttatgtcactgcagaataaat

SEQ ID NO: 15114 - DNA, 824 bp, Oryza sativa
ctaccccggccaagcgcttacagagctggagtgaacatcacattggcagtggtcgtctgcagcttcagatggcgaaggaacttgtcttccggcttgatgttgcgcaggaaagtcggtctctttcccccttggagacctggctgtggcgagatttaaagttgaagtgtcttggtcttgcctcgcttgagcgtactatcgcgcgtcaacgttcacgtttggtctggcttaaggagggtgacgccaataccaagttcttccacctgcacgccagagctcgtaggcggaagaacttcatcacgcgccttcgtgatggtgaccagcttgtcgtctcccatgatgcgctgcaagagcttgcctcctctcacttttgcgccatcttggggacgagcttcgagcgtgaactcgccctagacctccactctcttggcctccgccctgcgcagcttgaggggctggactgtcccttcacagaggatgaggtctgggcggtgatcaagtccttgccctctgataaggcgcccagtcctgacggttttacgggccgtttctacaagtcttgctggccggtgatcaaggtcgaaattctggcggcccttaactccttgttcctgaccaacggccaaggttttgcttccctcaacgacgccctaatctccctcttgccgaagaaggacgaggctgttgatgttaaggatttcaggccgattagcattattcacagctttgggaagctgttctccaagatcttggcctctcgtctctcccctcgcctggacgagcttgtggcgcctaaccagagcgctttcatcaagggccgctctctc

SEQ ID NO: 15115 - DNA, 14168 bp, Oryza sativa
  unsure (1)..(14168): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggataagatggggccacatgtcaggtgtaactgtcctcgaaaccgtcataactgccacaaccatcatagggacccacttgtcagtgccctagagtagtttggaggcctgttgggccggcccaagtatggccgaaccctggtgacgctagcttcgactggccttacacatggacgctcctgatcgctccccaatgacggattgacggtttcagggcatattggacatttcgcataggctacaaccatcatacctgcctatttaaggaggagctcattcacacttcaaaacacacttaagaaagctcaacatttctatctatactttagtttagtattctagtgctaagtggagtagagtggaatagctcttgaagtcctcggagtctttaggggggaattcgagtatggcggtagtagcttttctttattcttttgtaagacttttggaattaatggaatattattctatatatatttatatattcttggtgctttagtttatgtaagtatcgactttactttatatctgtatcggtatagttgtgtagctagcctaccagagaggtgcaatggtgtgggtttaatgttccattattcggttgctctatgtcatcctaggggatatagagtagtatttaataatgtagacgtggtgtttagattattaagtatcattatctaggcatatatgctgcgggacagtagaggtgggccgctgatggtgaaagtttagtacgggtattcctccatgttagtatatattcctaagataaattcctggggagggtactcctccgtatttagtcccggttggacagccatgataagttgtcgtaaggaactcggcaacccaggatggtctctcaaaacaccaggagggcattgttagagggtattggccatacaactgtatactagcggatataaactaattgatggaacgtatactagaagcataggaattaattgcttttttatttcttcttccacatagcgtaggattgattaatgagagatatgagttctttgctttgtgccactctacccttatgattatattaacccctgtttagactctgatcatacaagtggcatatatacattattagcatagttcttttttacaatcttcccttgggattaaataaataaggctaaattgtttcaggacattgaaaatttgtgtaattggctgtgggacaccacaaaattgtgtcactgctaaaggacataaaaaatagtgtaattgtctgtaggacaccaaacacattatttaataatttccatgacaaagtggagagagaattttaaaatgacaagctctttctcccctagctaagaggaggtggcggcggcgagtagctgtgcaagcaggcagcggcccgctgctatgggcggcccgctttggggacgtcgcccacctgagcaatgctagcctggcgctgggcctgtcccttggcagcggccaaggaggaggaacgaccaacgcgccggcacaccatggtggctaccggtggccgtattgctgtcgctgcagccatcgttgcacgctcgacaaaacgagggacgcagctgcgacggcgaccgtggccctacgcatagcgtgtacacattgttgtccgtgggcgtggtgctaaagagggagtgtgtggaggagatctacggtgagcggatgttgctggagttgttgtcgtcggcgggtggtcggacgagcaagacaacaacaactacgtagggcaacatccgcaagaagctccggtattgatttgtatttgttcatccgcaaagcacggtcttcctggtacatcacatatgtcgacacgttcttgttagactctattgatttgtatttgttcatcttttgttgatcgaatacatgcgagtcactaaaccaaagctttgtttctttgagcagaagcagaaagtcccaacttaagctcaggccaagccaggagcaaacttgtcttttttaaatttctctctccgctttttcttaaaaattataaaataatgtatctagtgttctacagacaattacatcatttttatggtgtcttttggcaatggcacgatcttacggtgtccctcagccaattatacaaaatttggatatcacgtagcaaattttgcctaataaatacgataccttggaatactcccggataaaatactacaatgatatatctgtgcgcttgcggattccttctgtaactgtatatatagcaggaccatttctagcgctattgctggaaattcatatttatagtaatgtcgttaagaaatatcagcaccccacatgtaaacgggaagaagatagaaaatatgacggtgatggcatggttccaatttcgtaaaatttaagttgcacgcttagaaattgaagaattgtaatgactttttttttaataaccacatttgcaatggcatggatcgaactaatgaatatgcacataacgacagatgttgtagcactagcactgttcggaagaattagtgccagtaatttcttcaaaactacttcttccgggttgataatacttatcgttttggactagagacggtcttgaaaactaacattgaccattattttttattataatatatataaaagtgttaacagctatataattttattaaaatattttttaagactaatctatacatgtagttatcatatttgaaagataaatattttaaaaatgatttataataaaaattctaaagtttgatctcaccttgtttaaaacgacaagtattatcggtgcggatggagtattttggagaagacttcaattgtgaaaactctaccctcgtactgacaaattaatggcactactccagtgcactaggaacagtacacatgtgcgtgcatgctctgttcttatttcgagtttgtcctgcagaaaacctcgcacccgactatccaagcacagaggcccccgacacgagtacacgacacgccgtcatgcgccacgccgccgccgccgccgtgccgctggcgaccaccgtcgccatgctgtacgcccgcctcgccgcctccctgaccggccctggcccccgccgcctcgccgcgctcctcccggcgatggcactcctccccgtcctccctctcgccctcccgtactacagctaccgcggcttctccgccttcgtcttcgtctggctcggcgagttcaagctcctcctcctcgccttcggccacggcccgctccacccggcgctccgccctctcccgttcgtcttcactgccgcgctccccgtcaagctcgtcgacgccgccgcggcagcagcaggcgcgtcggcgtcgaggccaccgccagctgcacctgcagctacgttcaagttcgtcgtctcgtccgccatcaaggtcggcgccatggcggccatcgtccgcgtcctccacgccaaggaggagatgcaccgctacgcggcgttctccctcaacgccgtcttcatgtactgcttcctcgacgtcgtcctgccggccctcggcgcggcgggcgtggcgctgggcatggagatggagccgcagttcgaccggccgtacctgtcggcctcgctgcgggacttctggggccggcggtggaacctcgtggcgtcggcggtgctccgcgccgccgtctacgaccccgtcagggcgcgctccggcgacccggcggccggcgtgctcgccgcgttcctcgtgtcggggctgatgcacgaggtggtgatactctacctgacctcccgggctcccacggggcgcgtcacggcgttcttcgcgctccacggcgtgtgcgtctgcgccgagcggtggtggtgcgcgcgccagcacaagcgcgaggcgaggccgcagctgcctcgcgcggtggccgcgccgctcgtactgggtttcgtcgccggcacggcgttctggctgttcttcccggcgatctacggcggcgggatggacgacctgtacctcgcggagattgcagggtttgcaaaaggcctcggccttggcggaagctggacaggggaaaactaattctaatatgtcccatcgtgtacatttttttcttcaaattcaatgcaactaattgtaaaatgggacgcggatactatatgcaagtatgcattagtagtatatacatcggtttcaaaatatagtaatttctagctatctatctgaataaattagtcagaagttgttatattttagaatagagtttcaagcaacacataccaatgagaagtccatagaattttagagggcaactaactaaagatactccctccgtcccctaatataaaggattttgatattttattttgcattgtttaaccattcgtcttattaaaaaaatttagaattattatttattttaattgtgacttactttattattcaaagtactttcagcacaacttttctttttttatatttacacaattttttaaaataagacgagtagttaaatagtgcaaacagaatgtcaaaatcccttatattaggggacggagggagtaaaatttaccgctaatgttctacccaatctactggtataataattccataataataaaaagatagctcgaagaggagttgttaacttctgtagaagaatgtctgcattatagatccaagatcacacaagacagatgtttggagttcaatgttaaccttaacagagacgaatgtgaggtgaagtacacatgtgacatgccatcattttgaagttcaacgaatcctgtgttggcctcaacttcttgaggatcaaacaagttccatccaactgtattgcagaggcggagaaaagacttgaaacagaaagattttttttttccaatgttcatatcatgatatggttaatacatcgctggcaagacgttctaatgagcttatgctatactccctccgtcctaaaatacaagggattttcgatgtgtcatatccacccaaaattccttatatttaggacggagggagtacgaccttttcttcccagctctatgctcaaatgtacatttggattggatgaatcttgagcttgtggaccgtgggtagttcttccatgaagtggctaggatgcagcagagtcagattgacttctggtgataaaatagcagtggagatgtaaaaaaagaaaagaaagcaaaacatccatcagattcagaaatctaatcttttggaacatctagattatcggatgtcaaaccaaagcaacttttctactagctcaaagaactcttcaagcggtacagaaaatgagaggaaagaatcaaggtaaacgattcacaagcaaaactgtaccacagaaaggacaattaacttaatgaagtgagcgatggccgatggacaagggcgctctgacgaatcagatcttgaggagttcgcaactgttcagacatcagcatcaatttgacgagttgatgaactgatggcactcgctggagcagcatccttggtagactattcctgggagcagagcagcccgccagctcatcctgtggcctgtaatatgcatagccgagaattgtgacaggggaaaacatttggaaaattttttaaaggaaaaatggaggaagttcacaggatttgaacccaataggaaattctatcagattagcagtagcaccatgaattccatttgatagacagtgttgcatcaactgctacaagaagacatccagatacatcctatacggatctatcataaatatctgtgaacaatcaagcattacaattcaaagaacgcagccgactcaatgagtggcacaccatgagatcagtatgatttctatcttcaaaacattgtgccacctagctctgcctctggatatgcagcgagagtttcttaactttgcagctcatctttcttagctcattgtttccgtttgcttgctatctttgtggcttctcttccgcttcctaactctctttcgctttgcctccccatcagctttgggcccctgtaggacacatgttctcatcagtcctcgtgttgcatcgacagcaaacagctcttctagacatgcttttccaacaacataatagatactaataatgggcatgttaatctgaaagtaacagttttaggtattattacgtacaactactgagagaaaaacaacagtgatataaaatgaaaattacctgattttgagcagctgacaattggggctttggtttctttttcttacaggagagtgggtttggtccctgcagaaatgacaagcaataaaaattacttacggaagcggaactgttgtagcaaactttctttccacactattatggatagttaaataatgggaaaaattggattcaattgtcaagcggtcctatcgaaaataggattgactatggagtaaggctgatgatgccaactagatcatacgtattgttgcgcttgcgtatacatctaatacatcagaagccagaagaaaataacagaaaatattaacctttggtcttttcttcttaaatttgcttttgtcggccaccccaagtgcattttctacaagagaactgataggccttctgttcttttcatcatcacttgcgttttcactggcagccgcctttccatccgatggaaccttcagtagcttctgatattctgatttacccatatgcagacgcttctcctcgtccaactgagcaaatttacgttgctgcacagagggttgttcaatgaacaaggagctcttcagaccatatatcacaggaacaccaggaacctgcatccagtcaaaacacacatgaacacataaactgattcaagagaatatgtaatggcaacatgtacattattgtgcaccctccgttccatagtgtaaggcgttttgggtttgtcctaagtcaaacttctttatgtttgatcaactttatagaaaaaagttgcagtacttccaacataaaacagatatactacaaaaaatatatattcaaatgtggatttaatgaaactaatttggtattgaagacattgctatgtattttttaaaaacttggtcaaacgtgatgaagtttggccctgtttagttcccaaaacaaaaaattttcacctatcacatcgaatgtttggacacatgcatggagtattaaatgtgggaaaaaaaaccaattacacagtttgcgtgtaaattgcgagacgaatcttttaagcctaattgcgccatgatttgacaatgtggtgctacagtaaacatttgctaatgacagattaattaggcttaataaattcgtctcgcagtttcctggcagaatctgtaatttgttttgtcattagacaatgtttaatacttcaaatgtgtgtccgtatatccgatgtgacaccccaaaacaaaaatttttgccaactaaaccgggccactgactgtccctgtcaggggcgggcgcagctatgattcaagggtattcagatgtatgcccaagaattttacacaaaaaataggtatatatactatatatttcgtatatgaattcaaacaaataaaaaagagcctcaaatacccaataagcaagcaaactagttttcttgggcttgcttcatcctccctcctcattcacccattagcccaaatgtattgggcccaaattccccacttccctccctctctccagctctcctctcccctacccacttccagcctcacccatcaatctcacacatcccattccctcagtctcccctaaccctagccgacgggcggtcggcgcaggcgcacagcctcgcggacgttgggtggccggtggctggacggcggtggcgcgggcgcgcaagtggccaaacacgcagcggcgatgctcgggcgcaagcgtaggcatggcgtggcggcaagacggcgacggcagcgcggggcaaccgaacaggctcgtggtgtcggtgccgcattggcgagctgacgacgtaggcaccaggcaggcagcatcgcagctcgcatggaccaagaggcagggacgctgggatttgggagcctgggatgttagtacttcactgatttcattttttgttctgcacttctacttttctagtattctactaattgttcactgagtacttggaagttgattcatcataattgctaacttgcagacttgatttaagtaactagttaggcgcatgtaggggaatagtaagtaggatttgtaagattacatatcattttaccattttcaaaatatcaagaattgaaaagttcatctctaaattgaaagatttcttatcattttaccattttctattcttttgtgtgtacttcatccaattagtacttacatatgtgctatatattataaaattatatcaatatacgaacttatgtgtattttgtgttatatatgctatatattatataattactggtgtgttatattatatacatcatttattaggctcttgggtgtaggaaatttttttaccctactcctatttcgaatacacaagttctaaatcctgggcccgccactgactccctgtccagatgcttttgcataacataattaaggtgataattcttaaattactctgaaacagcgtgttggcacgagcacgaaagggtagtgaatttccatacctcccgtagctttgcacggagatcagaatcctgggtggcaacaaagaagtgttcgggattcttttcacctatcagtgacagaacacaatccactgcactgactactttgtcatgctcacacctgaacccacaaacaaaaatttccaatggaacaaaaccctcattgcctcataagagaaaaaaaaaaaccatcgttagaagtagaagtgtgctactacttacttggccgtggcgagcagggcggcggcgtcgaaggcgtcggcgtgggacttgccgaggcgcctgagctcggcgaggacgcacttggaggtgaagaggggagggggcctggaggcggagaggagggactggagggcgtcgtcggcggggaggaggctgtgactgaggaggtggtggacgaaggtgccgtcgacgagcaccctgtagggctcgcggaagccgaagcaggtggcgtagaacctgaccaccttgcggttcttggaccgcctcttcaccctcatccttctcgcgtctccctcgcgggcggcggcggcggcggcggcgaagggcggcgctagtggcacgaggcagggaaggaggggagggggctcggtcgcctcgccggcgcgggaggggcggacaacgacgtcgcggttcaagataaaggtggcaggcgcagcgcgacgtcggcgtggaggtcgaagagtcgaacggcgccggcggtctgtgacggtggaggttgtgcttgaaggagttagggttgatggatttgggctttgatgggcctggattgaattggttggtttcttcgcgctggaaggggttttcccttggaaaaggtgcacttaaggcccctcattctgtggacgagctacaaaatcatccttgaacccaaaaaatactctataacatatcccttatcttataaaaccggatcactttgggtcctaaattagtactgttcccgattttaggtgacgtggtggctgagtcaatgtgaaacccacctatcatactcacaaaaaatcattgccttttctcctcactctctccctcactcaacgggtgtccttggcgccggcccagtcgatgttgcgggagattaggtgccatggcgaggaggaacacatggcgcttgtcgtagccatcgccgtccccacgcacaaccagcaacaggtgtcgccacgtcggctccgacgcaaacatgatgagcgagtggatggcgcagtaggtaatctcctgagagggccgggagtggttgccaatgaggtggccgaggagcgctggcggcgcggtgaggaagctgtaccaggctccaggcacaaatagggcgctctgttgggtagtgatgtcacagtaggtgacatagcagtcgcaatcgtgcttgttgttggggcactagacttggacgagcgggccacaaccgtcgacgagtgccctccctacccccacggaccctaacgacaacgtcaacaaggcagacaagatggtaggcgaggctcagggtggcaaggtgaagcgagaggacgggtgtgcttggcgccagccccattggtgtcatgagatacaaggcgccatcgagaggagaaggccaggggcaggcggagccacggaggcggcgaagcccgtcttcggagaagctctgtcgagctccagtgcagagtggcacccatcttgaggaggagcagcgagggcccctccttgcccccacgaacccaacaacggcatcggcaaggcgaacaagaagggagcttctccaatcaaggtcccctccagctacaccaccggcgtcaacaccaccttctacgtaagtactcgtcgtcttcgtattcatttcataagtcaatttgtattgccgtccatcactacccactcgtcacccaaggtggccagatcttccccgaccgctagatgtgagatgcctctgattgggccactgacggcgagcgcttcaagtccgactactgctaccatatgttcgtctcgtgctatagagacctcaagatcgctggctgtgaggttgacgcatcggcgagctgtcacctggtgccggcatcgctgtcgggcggcaccaggctgagtgcgcaatagaacgacaccatgagctagacacaacatatactaatggagctcgacatagcttctcagaagacgggcttcgccgcctccacccgctgttggcgttatcttctccatggcgcctcgtctcccgcaacaccgacagggccagtgccgagcatgcccgcttgtgcggactcatgctgtggatggtgggtggagcgggagagattggggactcatgaagaggatttttttttgtgagtatgacatatgggtaccatactgattcagccaccatgtcacctaaaaatggaagcaatactgtcttagaactcaaaatgatctgattttgtaaggcaaggaaggcgttatatctttcttttttttttcttttagggatgattttgtaactcggcagtaaactgaggaacctgaggtgaacttttttccttctcccttcgggcatgatactaggccgtgatgggctgggagcctgggacgtttttactgccaaagtggacctattgggccactatcctatgatagtgggatgaaaaattggactggatttaggccgtgttcttttctaacagagatgcatgctttctattaccaagcttttctaattgctgagcgatatgttccgtgcaaaaattttctatattgaagttactctaaaatattaaataaatttaatttttaagtttataataattaaaacttaattaatcatacactaataactttcttatcatgtatggccttatttaatctttatcttcattagtacgaataggtttttacaactttgtgacatgcctttactactatgttatgggttcctagcgcttgtacgtttttcatagaaaaaatagatataatattttaggggtgactataaaaacttatcaaaatttctaatgccaaatctcgataacagtaaatcaaacatcaactacacctgcgggtaggtcttaaatatcagcaatagctattatagacacggtactacagagaacgacattattctcccgctattaaggatttggggtttagatttcattgattggtttgtttacttgaaacaaggtgcatgaaaaatcatgctattacattctacaatgatatggctcctcaacacatgtaagcataaagttgatccaaccatttagaaaacatcctcttacatacaagcgttatcataactctaacgtcctcttacatacaagcgttatcataactcttccataaatagttagtcccatcacatctaacaaataaaaccattttttaagtacataacaaaatatcaccagcaagtaactttagaactggatttttcacattttggtccttttgaaaaacttatttcgcaaatagacctctgaaaaaacttattccagaaatggtcctttttgggacgccagagtggttggcgccgtccctcttttgaaaaacttatttcacaaatagacctctgaaaaaacttattctagaaatggtcctttttgggacgccagagtggttggcgccgtcccccttttgaaaaacttatttcacaaatagacctctgaaaaaacttattccacaaatggtcctttttgggacgccagagtggctggcgccgtcctcctgccaccgtggcactcgcgaaccgacgtggcaggaagagggcgccagccatgctggcgccgccccccccccaacccctcgcctccatccctgtttctctgtatgtagttgcaacagtgtcatttttgttttattttttcggatattttttcacacttaggatcatgatacaaccaaccataaaaaaaatataaactcgaactaccacttagctaagtctgaaaatagctagcataccacttagtctactttgcaccttcactaaaattagactataactcctttagtaaaaccctttgcataactcctttagtaatatcctttgatcagcatgttacacataatgcactctatcactatatgaaattacttaatctaattcaaaatatagccaaatgaaatgatagccataagttaaacagtacaaaaagatacaattttttttatttttatttcatttatttgatattttttcacacttaggagaacataggaaccaaccatataaaaaataaactcaaatggacaaaatatgtgacttgtagaattttccaaaactctaccggaacagacaaaatatgtcatttattaaaataggcgtaactttctcatatggactcggaatcaggcaaataatatattcacggacatctacagaaaaagttacatccgattctccatggcttcgccgggtttggcgatattaaaacctctgaattccgcttgcaagattgtgtttttgaggagagaagtttttcggtaaagctttcgaaaattccacaggccacatatttcgtccgtttaagtttattttttatatggttggttcttgtgagtttctaagtgtgaaaaaaatatcaaaaaaataataataaaaaaatttgcacatctctctcctctgtactagttcggagagagatgagaggagaaaaaaaattctacaagtcacatattatgtccatttgagttcattttttctatggttggttcttatgtgtccctaagcgtgaaaaaaaaataaaagaaaaataaaaaaaattcgggggggaggggcgccagccactatggcgtgctccccctagccacctcagcatcgccccgccacgtcggcagggggacggctggcgccgtctagttggacgacggcgccagccactctggcgccccaaaaaggatcatttctgggataagtttttccagggatctatttgcgaaataagttttttcaaaggaccaaaaagtgaaaaatccagaaattcagaaactattttaaaagcttgactacgatggatgatcccaagagcttgtagcacgccataatttcataagcaaaggataatgatcacgaatgaatatacgtataattgacaactaaaaattcccggcccatgtatatcttttgaaaacttccactaaatcaatctacaccattacctctttttagagaaacatcccagacgcgagaaaaacactgctcacagaaatagtgagcattatcctataattacgtcgctgcccacactcccagaaattccaaatgcccccattttcttcggttccatcgcttcgcctcctcctctttttctttttcttttttttttctctcgcccatccatcgtctcctttttcctcgctttctcccccgccacgaaaggaaccaaccctcctccgcagcccaacaaagcgcccgcggcggtcgctcgcg

SEQ ID NO: 15116 - DNA, 90249 bp, Oryza sativa
tgctgacgcagtctcctcctcctccgccgccgccgccgccgtcgtcaccgcggactccgccccaggctccgccgcagggtttggtcccctccgctccttggccctctcgcgcggggttttttttttttgagcgagaatgtgatttgatcagggtttgctccgtgggggtgtggatttcgcaggatggatggccttgtgacggagggcgatctgcgggagctggtgggcaacctcggggtggccgcgcgtgagccggagagggaggggtggcagcaggtggtcgccaaagggaacgatgacgtctcctacagggtgtggtgcgacaagcccatggtagctctatctcctcctgttcttgttgaatccattgatcttgttttatattgttgcgggtcactggaaatgttttattgttttatattgttgctggccaatggaaatgttctaatgatctgcttcttatcgtaaggcggattgtgaatttactctgcctacttgtgtccatgcgatttactagctgcgaaaggccacaactaatgcttactgtatgggtagttcatacttcatagtgcaagagtacaagtcgatcgagaaaattaagattgtaggtattagaataattcaaccccatccaccctgccttaatgctttaaaagtggatgcgtagttgtagggtgtcatttgatatcactgtttggagctaattttggtatcaccttctcaatatcccttggtctattcccctaatgggcttaaatttttatgggacggtgggagcatgccaactctgtgggtgagatcttagaaccacactagaattattgatattggtttatgtgtgctctaggtacttgatcatgatttttttggttaagaattgacaaaagaaactaaagctatttaggctctgtttgcaagaacatgttcccaacccaaacagtaaaaacggaacacggagcggtccattagcacgtgattaattaagtatttgttaatttttttgttcaaaaatggatcaatatgatttttgaagcaactttcgtatagaatttttttgtaaaaaacacactgtttatcagtttgaaaagcgtgcgcgtggaaaacgtaagtatggagttgggaaccagcttttgcaaacaaagccttaatactttagaattcaaaatagttgggggattaattactgatcagctgatgcagtctacgtgaagttacctagggtttaggaattttcgctgggttctgccatgattggattttgatgcctggtttcattttgtgatgctatttccatgatgtcctttgacccattacatttttgggaacatcacaattcccaagattctatttgcttgctcaagtttaacaattcagtttctttatgtaacagttatattcccctatgcaggaaggccctcctagatatcttagtgtgacaacatatgagagatgctcaacagagctattgagggacttttacatggataatgagtatagaatggagtgggataacactgtgataaagcatgagcagctacagtttgatgaaaatagtggaatagagatagggcgtacaatcaagaagtttccgctcttaacaccaagggagtacatattggcatggcgagtttgggaaggaaatgacaagtctttctactgtttggtgaaggttagtcacatctctctctccatcctttctcgtcattaaattctcaactgtttaaaagcgatattttttttgcgaggtaaaagtgtgatatactttggtgtcattgttttggcttttgtacttatgcagtaatgtaaacattgtagattattcgttcagtaatgtacttatataaggtctaagctttcggtaatgctcatggagtcagttgcagaagaaaccaatgatgccacaattgttgattgtgtcctaactacatcttcaattctaatatgaaattcaagttgaattggttttgatcctatgcttgacatttttaaatgaactaaggacctgtttaggatgtgggaatttcacctattgtgggaagtaaactgctccctgtagaattcctgcattctgcattgtaaacaaacagcctaaaacaccactgatatagccgagaatacacaaattctagggataatgcactgtacacgcccaatttgagaaaatacaaaatcagttgaaatctaattgaatatacaaccttagaatgaactcaccaatttcacacgagtatttcatatgcaattttgatgacattaaccttatccccattatcttattttctttgaccactcagtcattttttacaatttgttctgttgttgccaatttgttaacctggacaggaatgtgagcatcctgttgcaccaagacagcggaaatttgttcgagtgcaacttttgagatcaggatggtgcattaggaaaagtaagtcaactctaatattcatagaaggccttctttttgcggtccttattgagtttagaatgacctatcttgtttcagtggtatgtattgcgtcgatgtaatttctaaaaaatacgcatagaataacttcaaatgatctaattgtttggtaatgctttaccagcctctagtatctacagtatatattttatactttaatatttagattgaaatgcagttggatgaatttgttagctgataagaatgaaaggcttgtaatttttgtttctgcatccatgagttaatacactaatagttctgttgtacttgttaaccaaacagaatgggaagagttctactgaagctataagcaggctgtgtatcaactgaaaataaaacaaatattcttttaagtgtttatttttgaagaataaataccattgtcacacatttcttctccttgccatcaattttctttatgaccttgaatatgcaactgaaagttgagccattatgacatgccatttttgctagcttatctcgactctcaattttctttgttataattatgatcaaaaggcatctataaattgttattttctggggatgtatctcatatatgttcaactacttttaaatttgatgttgcttatatgctttatgttactttacagtccctggaagggatgcatgccgaattacagtgctgcatcatgaagacaacggcatgaacatagagatggcaaaactggcatttgccaagggcatttggaattacatttgtaaaatgaacagtgcactacgtcgctatcctcaacgtaacatttcatcaatatcaattctgaccatgcaaagacttaccaagaaggtaaatagtcttgacctattgaccaatctgtggttgatatttctttaggaattggtctatttatgttcctataagcatgaatctgtttttgttaaaaatcatatgtacagtgtgtgtccagtttattttatttgttttatgtatacaatcttttaggtttgaggataatgattatattttttgaatttagaatatatgttatagccagtcgagatcataaattcatacaataatttatgtgcttatgttgtatgctagcctgctgaagcctaccatgtcttgtagattgtctgtcctttacttttgttcacaaattacagctactgaaataggcaatgataatctttctggagatagaatctgttttttaaagtttgaattatgtagtatgtaccccccacaaacctgtgaacggtttactgtcctattatttcgaattatggccattttatggttcatgctctgatgacgcttgtttttgcacatcagtttcctcaggccttggagactgatgtagatgcaaatcatcatcctcaaggaaatacaagagcaaatgttgttcctacacattttgcaagaacttcatcacgccaacagccagggaagaagtcatctcgggcaacgattgcaagtggacttctgcttatcggaagcattgtttgtctatcccgaggccgatctaaccttggggcccagcttgcaatggcattcttcttgaagaaggcgttcaaacaagataaaggatcgagctcgcagaggagcataagtagaactgatgtgactgaacccaggcacttggaatagtattggttaaccttggagacgttttaccttgaccttttcttcctctttcttgagaaaaagtgggaatatcgtttgcttgataaggcatatctgtacacagcatgacggattatgtaaataataggtttgtagttgtctgtgtttgccaatgagtacttctgtggagtactacatcgtctcactgtagaaatcgggtacctgagaatattaatgtatgaaagttaattttggagcaaaagagttctgattgaagaaggtgactgcaagatatgtttggatggaatgctgcaaggattgttatagacatttccaaaactgtacccctcatctcaaggtaaaccgtagcctcaggctgggtccgctgggatgcaatttactttccgatttaccgcatgataccgaccccagcggtaggcggtttttgtatttcgaacaagttcggtccaatttattaagttgggatttatactagacaactgacggctaacaaaaaaaattcagccgactgtcagctagtcagtccctattaagtttatgaaaaaaccttttgaaaatttgatcgaaacctgctttcgcctacgttgaaaccttaaaatttggcggttttggacggccgtcggaaacatgaacaaaccaggtgccgctctcgtgctgcaggcagagtggcgggtactggtgcccattggaataattgaaaattgaaaactgaaattataaaaaaatatattttttttcaatgtcaagcataaggtagtatattaatgtattttatctgccggatctatgaggaaaaaatgaattagtcatgcaagaggtttgaatcaaatatagtattaattttgaaaccacttttcgatctgattaggaaagcaaaaccgcctgctcgctgcacttctgtacttgtatgtgtcgactttggtagcattgtttatcaatttgagtaaggatgatctgcaatgaaggggcaactatctacgaactacgggacacacacaatcaacaacttctgtgattgatcaattacactcatgtgagcttcggtggatcttcaaactcatcctcggttccactgtgtgtccattggtagctatccatgattatgtggtctagcattaattatctctcaagtctgccacctcttgcttgttgtagtatcctcgtgttctaatgtagtgcagtaacaagctatgtgtagttttaaccctgaggtcccgtgtttaatcctaacacgctcacaatttttttaattttttcttaaaagaatgtttgaagacacgtatctccctccaaacagtggcgaggccacatgggttcaccacagggggtgccggggagggcctggcacccctcatcctctgatcctcccccctcctcccccctcccttccctagataaataattaatagatgcaagagtatatatcggtagctagcaactcactaactgcgagtatggatatgtgtagctgaatgcgtatgcatagctctagctgggagcatcgatcagcaactcactaaaactcccgcaagcagctgggtgaagcttttgatgtgatgcgacaaattaacaggatggagtcttcaaattaaagaagtaattgagatgttttgtagtgcatcaaatctcagtgctagactgctagtatagaactactttctccgtttcacaatgtaagtcattctatcatttcccatattcatatttatggtaatgaatctagatagatatatatgtctagattcattaacatcaatatgaatgtgggaatgctagaatgacttacattgtgaaacggagggagtacataaattgtgtttaactctctcttgcatgattcaattatgtaattcttaggttgcattcgattcagcgattggaagtatatttctaacggcagcatatgattaattaggtattaattattagaaacttataaaatatattaagaaacttatataaaaaactttcctacaaacaatttatttaaccgtttaggtagtacctcatgaaaaaccgagaagttgtccaaaacaactcagccttactaaagaagtggatggatggagataaaccgcctagacgtccacacaagattgattgcaaggacaccattctgtaggggggtgaaaactgatcatgcatacaacacgttgttcaccaagcagccaataagctttcttttggatacattgaccttatggttggcccccctaatacctaaatcctggcttcgccgctgcctccaaatctccttttttttaaagtatcctcgtgatctgaaagagagactgtcatgtaaacgtggtagatgccgatcattcccaaagctgcctcacaatcccactcctatgcattgcacatacgacctacgggcatccagtgccacacctatcttatgtggaaatacacaccaacaaacaaatgtaagcattgggtaaatacttgatagccctacatcattatctatcaaaccgagaaaggcatgtacctcacattagagaatgtcacaatgctgttctccttcactctactaaaacttgagttcttttgactctccagcacctccacggctccacattattcttggcttataactagaggttgctgctctcctcatcacccaggtaatttacaatggagaaacattggcatgcataggaattggaactcttgcagcagagaaggtgaagccacatggttttgcctttatggcagcagagtactcctacgtttctttgtgctgtgctagcatgtgccttggtgaggatcgagatctacgactgcatgtttagcagttgcagtgcagccgatggataaaaaactgacggctcagatggtaagaaagtattgttcataaaatactgtggcaaacttacactgtagcggttactgtagcatcgatggtgcaacgggatggtagagcgaatccgagctgttgggtccatcgatccaacggttataatgtgctccgactgccaaggttgcagttgttactactacagcaccggatctcaattcgtcagtagatgttgaaatcaagtaaatatggcttccatgtgtgtttctaaaatataaaccatccgtatatatcaattaaaatatattaagttttatacctttgattcatggatatatacactttattgctactttcaactttatcaagttttgatatgactaggttttggtagggaaacaaactaaatataatgttatcattgtcaccctaacaaagattggcaattccggaagttctctcacaaaaactcaaccaaaatttgataaggtttcaaataaacacaaccgatagtataaaaatccggtaacgtcaaaacgtgtcaaaatttggcatcatcaaaatttggtaaagttgattttgactataaaatgaacaatccctatgtttctacaagatttctgagctggcgaatgaatcaaccaaagataatttatgggcaagtttttatatctatgtttagagctttaaaagtaaacgccgaaagatacaatacgatgagagaacctataaattaactttaatttaaaaccacaaatttaacttaaaattaaattcaagttctaaaatttaatttttcatgtggttgataagctaaccagaaaacaatgagagatataggcccggctcaattgtacttaatttcactgttgtgcggccaacacaaatagtgtattgtgtctgcaactgtactgaaccgccgaacaaacccatagtgttagtaggatcaatcttttaattaggcgttgtcagtatagttggagagcacaagtgatttcttcccaatgagcatgcaagaaattggagctagcaagcagggccggtcctgagtttttaaggtcccgatgcgaaactaaatgtagaggttgttaacgtatatatatgagttattgccataaacgtttaaattgcattcagaaatagaatttttatagaaaacattgtacatattaccttaaaattatatttgcttgacgttcacgtgttacctcttaaaaatttgtccaatgctcctttctaggcttttattaaaccatccactctttttcgtttttccccttttctcgctatccgatgcatactttatcgacaatatggcctaatgattgaaaaaattaacataactacagtgttttaactcgtataaagtatgctagaaaattacaaatctagatttagtatatcttaccaagtagttgattgcaagtatccgagtgcgcagcgcacgaccagtccgcaagtgcgtcgggacacacactgccattgttggttcatccaacactcgtccaattgaattagcaacaggcaacaaataacagattacaatttacacatggaatcatagttacaatttttcatatggcaatggtgttgttgctgctcactagaccagtaaagtgaatcagtgatcgtcgcagtgatttaggccgtgcttagatttaaacttttttctttaaacttttaactttttcatcacattaaatatttggacacatacatgaaacactaaatatggacgaaaaaaatcaattgcacagtttgtatgtaaattgcgagacgaatcttttgagcctaattacgctatgatttaacaatgtggtgctacagtagacatttgctaatgatagattaattaggcttaatagattcgtctcacaattttcaggtggaatctgtaatttgttttgttattagtttacgtttgatacttcaaatatgtatccgtatacttaaaaaaaattttggcacacaaactaaacacaacctcagcaaattagcaacagcaagacatcaatgaggcatgagaagaagtgtagaacacggcaacggcaagaaacctgcgcggctcggcggctgcgtctctggcgcctcgcatgggcgtcgcgcggcggaagcggaagtgcgcggaaacggccagcggacggcggccttggacgagatggctgaggtgttgcgacggtgctactgccagcggccgcgatcttgcgttcgcgacttcgcgtcaggacgtgagcggcggttcggcgtgatcgcgcgcgtcgatgccgtcgggattctcaggaactcggagcgtctccagcaactcatccaaattcgatcctgcatattcctatatggatggtcatccaaaaagattcatcttccatatctcttctcactccagcagatcatccaaattgcatcctccatatcacattcttctatattttataatatcttccaactaactttacatttgtatttgaagggatatattttgaataacttaatttaacggtgttatttatcgctataatatttcgaaatgagtaaattttaacagatatatttttaatggataatttttaactcatatatttaaaatgagtataaaagcaatgcaagtaacatatactactatatgctagtactactgctcaactatttcttctttttcctactagtactagttctctgcatcgttcttctttgttcctactagtactacttctctacatcaagctggcgagcccaggggcggcggcagtcgggcgagcgaggggcggtggaggacgaccgacgagggtgcatctggacagggaggaggcacgcggtggccgcggaggctgcgcgcagaggagtcccgacgggggcaacacgatgaaggagcagcggtgcgagcggtggggcggcgcggatggcggggcttccactccggcgatctccaaatggcagacctggtatgtccatcctctctgtttccccatggtacagtccggatggtggcgcgagtcatcggagctaggcagttggggggatgacgtgaggagagagaaacgccaaatttggcatggagagggctcggtttggaggatgtctaaaaatggcgtgtgtgatggagtgtttgctggagcatgatttttcccctccatatgctaaacaaaggatggatgaccggatagaagagctgctgggcatgctcttacctcccgcatgcatcagtttctgttgggccagaggggggtgaagcgggtggagagggacacctacgagtcgggggccagagcggccgcaccgcttgcccccctccagggccgggcctgtgcatgtttataaaacagtattgtaaaagctcatataaagtaattataaaaatctactgcatataaggtaccacaggtattagaacttccgatatatttctttcctgccacgtttacagtttctacccgaaacagggagtgacatatcacaattcatacactctgcagaggtgtgttgctgtacccataaacgccataaatcttttaatgcccacgcccgtcagtgcttgaagcatacttcatggtgtatgccggcaaggttaaggtcacaagcttttcatcaatcacatctgccaattatctctgctgcggtgattctcgcaacaattggcaaatcatcggatcctgcaacaacggcgatccacgtcatttaatcagatttcgcaacaacgacaaccctcatcgttagcccatgctcacaggattcgcgaaagtccttaagcccgcaggataaagccattaaaaaagaactaataagccagcctgtcccatttcaggtcatgtggtcgacacgatcgctaggacgcttgaatgctatataatagttattgtaaaaagtcacaccgtttattaagttaaaaacgtgcacgtcaaaaataaaataggtgaagttggaaaagtagccttttgttcagaggagggggttggaaatgttagattaatgggctaggcccaattaaatcctaataaattccattagcccacattaagtgctatgggtaataataccaccttggaaatcgggtgaagaggtctcaacttaaatacggagttagtggagagtctctgttgaccagttgagatggtgcgcggacagccaggcggggcgagacgaggcgagacagacagctgctgctgctgcgctctctcgttttgtaatggacagtaataaacacagagaattgatttcgtatcaatgaacgcgtcgttacggaattaaacaccatgaattgattccgtcggttacggaattaaatgccatgaattgattccgtattaacgagcgcgtcggtttcgaaattaaacaccgcggttgatgactccgagcgttactctcgcgctcgcatattatatactccgcagcgaccagaaggactggagaagttcttcccgatctctcttgcacttcgagttcctcctcctctgttcctgagctgcaaaatccttccccggttctgttcacctgcgcgcacaggtgtacgggatgagcaggtgcctctgaaactccgtccgcttgagaacctgcacgggtagacggacgatcaagattttgggtagcgcttcaagcgcgactgctcttgctcttcacggctactgcagctgcatcgtcaccttcaccaagatgtcgacggagattggagacaagatgatgaacgacatcaacggaggcagtgctgcctcaaaatccagcggtgggacgttctcggggtatactttcattctcccgattctattagatgtttctttgttaatactcttcgcaatggcatcattgtgttaatatgtaaatgttgatgcttattttatattaagcatactcaagttgtatacatctagcactgtcactagatctactcatattgcaaatgtcatgtttattgtcttactattttggattaaaatatgctgaattatgaccaaatttccaacaatccaaaaacttaataggtctttttcggtagttggctttgctgcatcactaaaaccacatgctttcgatggttcaaattataaaagatggaaagcacatgcacttttgtggttgacggcgatgcaatgtttctttgtttcacggggcaaaccgagtgaaccgtctatctcccctgaggaggaggctaagtttgaggctacggattgcttgttccgtggagcattgatcagtgtgctcgccgatagtattgtggacgtgtatatgcacatgccttcagggaaggacatgtgggatgctcttgaggccaagttcagggtttctgacgccggcagcgagctgtatgtcatggagcagttctatgactacaagatggtcgatgaccgttctatagtggaacagactcatgagattcagatgttggcaaaggaacttgagaacaacaactgtgagttgccggacaagtttgtggcaggtggcattattgccaaattgccaccttcttggacggactttgctacttctctaaaacacaagaggcaagagttcagtgttactgatcttattggctctttgggtgttgaggagaagtcaagggcaaagggcaaccggggcaaaaagatcgagggaggttctagtgccaatttggtgcagaagaagaaccctcacgcatcccacaacaacaacaagaaagtcaaacctgacgtcaaacccaaggctacaaccaattttaagaagaaaggcaagggaaaggtaaaaggagattgctttgtgtgtggcaagcctgggcattggtccaaggattgtcctaagcgcaagaacaagaagtctacaaacatggttattagtgagggcggaggaacatcgaggtatggtaaatttttacctatagttctctctgtctgtcactcacctgattggtgggttgatactggtgctaatattcatgtgtgtgctggcatttctctgtttcttcttatcaggtcgggagaggttcctccttgttgatgggaaatggatcgcttgcggctattcatggtgttggtatggtcgatctgaagtttacttcgggaaagatcgtgcagctgaagaacatgcagcatgtcccttcaataaagaagaatctagttagcggctctgtactgtgtagagatggttttagacttgtgtttgaatccaataaatgtgtcgtatctaaatatggaatgtttattggaaaaggttatgacagcggaggcttgttccgcttttccttggatgatatatgtaataaagttgtgaaccatgtaggcgatgatgatgatgagtccaatgtgtggcattcgcgactttgtcatgtgaattttgtgaattttggttgtatgacacgcttagccaacatgagtttaattccaaaattcagtttagtcaaacgctctaagtgccatacttgtgttcaattgaaacaacctcgcaagcctcataaggcatcgaggcgaggaatttggcaccactagaacttgttcattccgatctatgcgaaattaataacgtgttaagtaaagggggaaagaaatatttcatgacactgatagatgattgcactagattctgctatgtgtacctattgaaaacaaaggatgaagcattacattactttaagatctataacgctgaggtagaaaaccaactggaaaggaaaatcaaaaggttgaggtctgataggggtggagagtatttttccaatgagtttatttctttctgcaaagagtatggaattattcatgagaggatgcccccctattcaccccagtcaaacggggtagccgaaagaaagaaccgtactctaactgagatggtgaatgccatgttagacactgcaggactgtccaaggaatggtgggtgaggcaatattgattgtgtgtcatgtcctgaatagaattcctactaagcttaaggaagtaacaccattcgaggaagggaaaggaagaaattaaatctctcacaccagcgcacatggggctgtttggccaaggtaaatgtacctatagccaaaaagcgtaaacttggaccaaagaccgtagattgtgtgttctttggttatgctatccacggtgtgggatataggttcttaatagtaaattctggagtacctgacatgcgtgttggtacaattactgagtccagagatgctacattttttgagaatgaatttcctatgaaaaatgcaccaagcacttctagtcaagaacctattttatcccctgagcagtttgcaccgatagaacacattgatcaaatgcttgaggaaatcctgaggaggataacattgtagcaactcgaaagagtaagagacaaaggactgcaaagttttttggagatgactacattgtatatcttgtggatgatactccaagaaccattgaagaggtatattcatctcctgacgctgactattggaaggaagcggtatgcaatgagatggactcaattatgtctaatggtacttgggaagtcattgagcgtccatatgggtgcaagcctgtaagatgcaaatgggctttcaagaaaaagcttagggctgatggtacaatcgaaaagtataaagcaaggcttgtggccaagggttatacccaaaaagaaggcgaggacttttttgacacttattcaccggttgttcgcttgactacgattcgagtactactcactctggcagcctctcatggtctactcgtccatcagatggatgttaagacagctttcctcaatggagggttggaggaggagatctatatggatcaaccagatgggtatgtactagaaggtcaagagggaatggtgtgcaagctgttgaagtccttgtatggtctcaaacaagcgcctaagcaatggcatgagaagtttgacaatacacttacatctgctggctttgttgtgaatgaagctgacaaatgtgtgtactatcgctatggtgggggagagggagtgatcttgtgtttatatgtcgatgacatattgatctttgggaccagactcaatgtgattgaggaggtcaaggactttctgtccaaaagctttgaaatgaaggatttgggagtagctgatgtaattcttaacattaaactaccgagaggagatgagggtgggattatacttgtgcaatctcactatgtggacaaggtcctgagtcgctttggttatagtgactgcaaggcagctcctactccttatgatcctagtgtgctattaaggaaaaaccgaagaatagcaagggatcaatggagatactcctagattattggttcattgatgtacttagctagtgcaacaaggcctgacatctcatttgctgtgagcaagttgagccggtttgtttcaaatccgggagatgatcattggcatgctcttgaaagagtaatgcgctatctaaaagggacaatgagctatgaaatttactactctgggtacccaaaagtactagagggctatagtgattcaaactggatatctgatgctgatgagataaaggccacaagtgggtatgtgttcacacttggaggggacgctgtttcctgtaagtcttgcaagcagaccatcttaacaaggtctacaatggaagcataactcacagttttagatactgccacagttgaggccgaatggcttcgtgagctcctgatggacttgccgatggttgaaaaaccagtaccagcaatcctgatgaactgtgataatcaaacaatgattattaaagtgaacagttcgaaggacaacatgaagtcatccaggcatgttaaaagaagactgaagtctgtcagaaagcagaaaaactccggagtgatagcattggactatgtccagacggctaaaaatctggcagatcagtttaccaaggggctaccacgtaatgtgatagactgtgcatcgagggagatgggcttgagacccacttagagttgcacaataatggaaacctgtctattgtgatcagagatcccgtgaatttggatggcgaaacaaactattgtgtaactgagagaagagaccctaaaatgggcttatcttcatgatgcacttctcttctaatctgtatggtaggatggtatacaccttaatgtaatccgagtagcttttcataaagcagatatgttggcctacagaacatcttagaaggaacacacctatatgagtccgactgctagtcacagtctatgagatctggttgatctctagatactcatgaaaaggccgggagtatgacttatacgctccaaacagaggggatgcaaacggcagcctagtaccagttaagggtttgagtgaaacctgaatcgcacaagactgacaattcaaggtatagtccatttttcagttgtaatctggtgtagcttttttcctaggaggaagttcaacttaacagtctccaccgaaacactggtataacaaacaagatcagaatcgagagcatttcctgtgagccatgaaatttggtggggattgttagattaatgggctaagcccaattaaatcctaataaattccattggcccacattaagtgctatgggtaataataccaccttggaaatcgggtgaagaggtctcaacttaaatacggagttagtctctgttgaccggttgagatggtgcgcggacagccaggcgggcgaggcgaggcgaggcgaggcgaggcagacatttgctacactctctcgttttgtaacggacggtaataaatacggagaattgatttcgtatcaatgaacgcgtcggttacggaagtaaacgtcgtgaattgattccgtcggttacagaattaaacaccgtgaattgattccgtcggttatggaattaaatgccgtgaattgattccgtattaacgagcgcatcggttacgaaattaaacaccgtggttgatgactccgaacgttactctcgcactcgcatattatatactccgcagtgactagaaggacgggagaagttcttcccggcctctcttgcacttcgagttcctcctcctctgttcctgagctgcaaaatccttccccgattctgttcacctgcgtgcacaggtgtacgggacgagcaggtgcctccgaaactccatccgcttgagaacctgcacgggtaggcggacgaactgctcttgttcttcacggctactgctgctgcatcgacgccttcaccaagatgtcgacggagattggagacaagataatgaacgacatcaacggaggtagtactgcctcaaaatccagcggtgggacgttctcggggtatactttcattctcccgattctattagatgtttctttgttaatactcttcgcaatggcagtattgcgttactatgtaaatgttgatacttatttcatatcaagcatactcaagttgtatacatcttgcactgtcactagatctactcatattgcaaatgtcatgtttattgtcttaatattttggattaaaatatgccgaattatgactaaatttacaacaagaaacccctcttccccggcacgtaaaacgaagttcattttattgcatgattaattaagtattaactattttttttaaaaaaatagattaacatgatttttttaaacaacttttatatagaaagtttttatataaatcacaccgtttagtagtttgaaaagcgtacgcgcggaaaacgggggaagaacacagcaagaacacagccactcccgtgaagcctagagaaatcctggccatccaaacatacaaaaagagcgtccaagatttgacaaacggcccagccaaggcagaggacactcgccttgctcctgctccgctccgctccggcgccctgcctgcgctgcgctcgcgagacaccacacgagggcggcgccgcgattccacggcgtcctgccgcccgccgccctagcctgtttcctccccagcatccgccgccgcaggggagcatgaaaccctcacccgcttccaccaaagccccgctcccgtggatctccccgctccactaccgaagccccacacgcgccgcgccgccctccccgccgccgccgccgcctccgctgcccgaagcgcccctcacgcagctgcggtacgtccaccaccccgacctagcccgcctcatcgcctcctccccctccgcgcagcgcgcgctcgacctcttcaacgccgccgccgcgcagcgcggcttctcgcacaccccggccaccttcgccgcgctcctcgtccgcctcgcccgctctcgcctcccctccgccgccgccgccgtcctccgccgcgccgcctccgcgccctgccgcttcctcgagccgcagttcctcccgctcctccgcctcctcccgcccgaccactccctcgcgctcctccgcctcctccccgcgctcctccgccggggccgcgtctcccgcaaggccctcgccgtctgcctcgaccgcctcgtctcctcccgccgctgccccgatgttctcaccgagctcctggccgacctgcgcgacccccggagcaagtaccttccgcagcccaacacgtgcatctacaacatcctcatcaagcattacgtcaagaaaggcgatttggggacagccttccaggtgtttgatgaaatgcgtaagatgaactgcgctgatgttagaccaagcttagtcacctattcaacattgataggtgggctctgtcgtggggctcagatgaaggaagcgtttgaactatttgaggacatgatcgagaaggaccgcattgtgccagaccagctaacatacaatttgctcatcggtggattctgcaggctaggacaggtggagaaagcacaatcgatctttggatttatgaggaagaatgagtgcgagccaaatgccttcaactatgccactttgatcaatgggcactgtaagaaaggggaagtggaggcagcgaggggggtatttgaggagatgattagatctggggttcagccggatgctgtcagctatacctcacttgttggatgcctttgtcggcatgggaatgtggatgaggggatcaatcttgtgcaggagatgtggcagaaagggtgtaaggctgatgttgtcacatacaatctgctgcttgaggggttgtgcaaagatagacggatagcggaagcagtgaccttgcttgagaagttaccgtccgaaggagtacagctgaatgtcgcaagctaccggattgtgatgaattgcctgtgctcatgtggagagatggagaaagcggctggcttgctgggcatgatgctcggacgaggatttgtacctcactatgcagcatcaaacatgctgttgattggtctgtgtgatgttgggagggtatcagatgcaacagtcacattgtatggactggtggacactgggttcatgccagaggctagatgctgggcaaggctgattgagtctgtgttccgggagagaaagcttaggagatctattgagctgttggatgtgctgattgctgaagggtgaccaagtcaacttgctccagcatggattgttttgagtttttgactgatttcatcacctgaagggaggtgaaaaaccaggtattgagatgttccaataaggagtgatgacctactgaagccacataggtttgatagacatgggctgatgactgtgcaggagatgactgaagggatgagtgatttgcagcaggactgtgtgtgcaatcaatcttcactaaggttagcaagcaccaagcaatgaccagcctgacccaattcatgatggaatctgcgatcattccgaggttggggaatcttcggaaggtgccatgacacatggttactttgatgtttcatgattatgccaaaaatagtactctgtacatgattaataactgacaaaggaagctgaagtctgaacgaccattttgtggacaggtgttcattttccttatttgctggtgtgttcttatgaagggttactgactgcttgacaatggacatatctgtgtaatacactgtcattgtggaatccatagagatgtttcatggtatttgactgtatgcaagaaggaaatgtgcagagagtcaccattgtcatcttgattgtttgattatagagatccaaaaccaaagttttacacaaggccaaactgcaaagttgagaaacatggtatgagttcatgttgaaggcagagattcattcaaccttcttgattggagactttgcaatggaattatttctatgcaaatgtagagaatgtccaggagttcaggacctgctggcaacataaagaactcagtggcagctggcaatgtaatattacggttgctactcaggctaaaacaactcaataccaaattaatgcattgtccttgcatgagttcctgtttggaacagattatttaccggattattgctgtggattatctacttgaatatagtgctaccatgcatgtatgccataattatggattgttgctattttcaaatctgactaagtttttttgatgagttacagtgtagaacaatattgcactgcaaagtttcctattaacaatgctccttagctctgataatctgaaacctgaatttacttttttttctttatttacaaagttggagactggatatgaagagatatgatactttgatgctataatactttcagccttttacttaaattcttgatcaaaataatctatgcacttataacaccttactccttttctatttcataggtattcagcaaagatcatagttgttttctgaccttcaatggcaggaagcagtcctaaagcagtgcattgaggctgagcaacttgaaagtgtcaacatggctggaataaacctaatcaataaactaagagaagccctcaatgaacaggctttgagcaccttttatatgtttcttaaaaaatattctaccatggtgtggcatataatgatataagcatattattacattcataaatatttatgtttttttccttttatataacaggaaacaaagtcagagcttcttcgcaatcagttgcatgtaaggattattcttttatacattctcacttgttattgtccttgttataacttcatctttcactgcagaagcacaccttagattattctatttcttatattccatgtctattatcgcttaattactataatggaacatttaagggtcaaaattatgatgagcattttcatggatgcataagctttcgtattacagtgtctgcttgctttgagctttactccattcttgatgcctcagcctaagatgacccatgagtccatgatatgtgagcacaacctcagttttgctttgtcaagcacttccataaagtcataaacttaacttatctataagcgtatcctaataaaaaatttatggtcaaaaatcaaatatcatatattttaacgagaggaatagctcgtatcttcaccaatctgttctatagacaattccatgtgtagtactagtactgaaagacctcatgatgtcacaactggtagaaagacaatgagtgacaaagtatgcggcaaaataacggtggtacacaaggaatttgttgaagatttgtacttgtaaatttattttgtattgttgtggaaatttgttgtgcttaggctaaaacttggatactcggagaaattttctttagaactacttgactgttttataactagaattctacattgtattttacgcacatgtttggatgggtcatgggtgtgatctatataatggattgtttataaatagagatattatatttctaccactatgttacactaagttatccaaataaaaagaaaatttatccaaataaaaagaaaatatttaacgactagcatggcctcctcgtccagaagaacaaaaggtatatgatgatgcgaagacgtgtgctgatcctgtgtgccagatcaaatatcttctgcacacttaatcatatgtgacgcagtgagcaatagttgcggttgcgagaaggtggccaacgatcagttgtgaccagcggccattgtttaccagaaattttacggttcttgtacatttacataacttcttcctctataaagattactgtcattgcaatacatttacataacttcttcctctatgaagattactgccaatgcaacacaaacaagggctccagcagtctacccaccacggtctcgctccaaaatctgtggtagacgaggctactaaaacttagtcccatggtatgactgttgataggtttccacgtgcctcctatttccaacatgagtcagcttaataaatagtattagttagatatctcccgctccctttttaggtatttccattagcaaatggattgtaggatcaagcaagaaactgactctgactgctatgtggatatatagtttagtttgcatagacaggatgtataagggatgcaggtcatctgcagtactgtagcatctctgcattttctctttcaatgcagaggatcccaatccaataagaactcggtaggcatcttgtagtgagagatggatagagattaaaatgagactcggtaggcatcttgtaatgagagatggatagagattaaaatgaggcaccaacaaagctgtacacttcattaaaattagccacctttgccatccatccatgtactcggttgtctctctaactagttgatatcccgagcttctctaactaattgatatcccgagctttgctgcaagatatatggatgaatgcacgttatacattatagaaattgtagatgtatgtgtttaaataattgaaaaatattatgaagataatgatttgacatttcttgcatattatcatatttttcaataattgtacatattatcacgtaactttgcatctattttacgtcaaaaggaaaatgttgcatctgctgttatcggtgccaatgcaaagaaagaaattaatgttccttcagctttctcggcaaaaaggcaatacaactttgcaaaggagaaacttgtttaggtgcaaatattatgttatcatgtacatgtcaattctctagtccatctagaacaaaattgctagaatcttcaacaaaaacaagccaacattgagctgtccatcgagcagcaatcctgcaattccgacacgacaacaacattcctagatcttccattcccatgtttgtatgcacgctcgtggcttcgtgcatagtagtgcgagcattcatcgtgtgtacatacacgcctaccttgttgacagaaaagcttacctcctctttttgaaagagccttgtatatgaaacatataaatgcatccatgaactctttcagatatactcctatatgagtagtaagtaggagttgatattagagtaacatcgaacacctagaataatgtccttgctgcagattggtataactaaggctgtgtttagttccacactaaaattagaagttttaagaaaaaagttgaaagtttatgtgtgtaggaaaattttaatatgatgaaaaagttgaaagtttaaataaaaagttgagaactaaactcggcataagccacatgcagtagtactacttttgtaccaccatttgttttggagctagctcttgcttttgtactacattgtatcttcgccaatcttgttctacaggcaattcattgtatgccagtgaaacataagttttttacaaggtatttatgcaagggtaacaccatagaagcctattaagttattacgcctaaactatgaagcaggtatatatttacagatgtatatggatgttgtagaggcaattcattgtaagccctctcaaaaaaaaaattcattgtaagccgctcaaaagtttatcttttcggttagagtaaatttaacaaaactataaatatattgaccaaattatcacaaaactacatatttaaaatggtgtatcacaaaactagctataggtttagtgtcaatttaattacaaaacttgaacatttataactcaaccataatattagtgctaaggatttaaaccccaaaatatatagttttgtgataatttaattattaaatatataattttgtgatacttagagttaaacctgtagttttaggataaatttattgttaaatctatagttttataataatttgatcaaaatatctataattttgtgaaatttactcttttttttgcgaggagaaatttactctttctgttataggctactaaggtcactttttttagacaatataactacatggagtatatggtaacatatataagttcatttttccccatcttgaaaatcaggatctgaggtatagaacctacataactcaccagaaaatagctttttcttttagttggtaagttttcacgggagtgtacgtagttttatatttacaaaacaacaacacctcctcccccactcccaactaggggtgggcaaaaaatacccgaagaccgcaagccgaacaaaatcgagccgaaccgaatcgaagtgtcggtttttttaggcatcggtttacccttcggcatctgttttgcgtttgatcggtctacggtcttttaatttctatggtttttaattgtcacgaaccgaacaacccgagaaaaccggagaaaccgaaccacacgtacacagtatcacaacaaattaggcaacgtgcaagctttaaggcccaacatctctttaatggggcccaacatctcctaagctacccatgtctcaagccctgtttattatcatcacgttatcgtgcgaagccacggctgtggcctcatggcaacgtgttccaacggtttgttcagtgaaccgaagttactccgtttaatcggctcggttttcttttttatatagattcttcggttgcaatagaaaaccaaaatttattaaaccgttgaaaccgagctgaattaaccgagtaaaccgaacgctcacccctacccccaacccacacatacaaacgcacacacacacatcaatgttctctgaaactgatgtgaactttctaaacaatacggttcatctcctacctccagaaagtatttggcatgtcgatcagggattgcaatttcagttcaaaatttcaggcccccttgctggcaagcgattattttagtcgaaattttcggttttctcaaatttttgcaaatttggccaaaatttagttaaattcagttaaattatgctaaaattttgagaaaaaaaaaaggtccaaaaagtaccaaaatttcggatgaaatcaaaattgaaaaccctagtgtcgatccattagctcaattaccagcagctgtcactttagaagaatgcagttcacattcaactagcagcaacgcctcgagtgaaattcaaccccatatatactgagataccggccaagacacatgttagcacattagtatatagtacaactgctactgcagctatccatggttcaagtactaataggaattccagttttttcctgtttgatcgattcctgctgcgagtacgaggtggaaaagagttacaatcccacggtgtcggctcccagagcttcagtagctgatgctatactaaaacttcgtcgattggtgccacagctgatgggattccacatgcctcccatttctagtgttgctcaagttggtaaatagcgtgtgtttcggttactattagcgaccaaattaaaggctggagcaaggaactgatgaccgatatgtacatatgtgaagaggatatatatatacatacatagaaataattaagcatgcatcttcaactatagtaatggatgaggagtttcggcatgatgtactatgtaaacagaaaaactactcaaccatatcccgtggaaatggaataagtaggtaacgctttgttcttatctatttgccttctctctccgagtcttcgtcttcctcctccgcctctcctattttgccctccttttccccttcccctcctctctgttgcagagagctcctctatgaaggcatggcaatggcgaagcaggccccccgaaaacggatcccctccccctcctcctcattgctggttctaccctgagtgcatgttggttacaaggtcatattgcctcctcctccgtctcaatcttttgaggcatggacacccactggatctagctcccatggcggaagggggaaggagggaaggagggaggctgtcgagaaggatgctgaccaacgtgggtttcttggcctcatccttcaaggcgctttgctgatggtgatggagctttcattcgcggcgacgtgatggcgagccaccatgctcattgccggagtgtgtgcaagtatgttgtgcgatgtatcatccacagtcggtaccccataggtaccaagtttgatacatgtggtattaccgctgatacccaggtatcagacccagtacctgtaggtaccatgcttaatatctatggtatcatggctgatacccacaggtattaaacctgatacctggtacctgtgaggtatcaagtatcatggctggctgcgaggtatggctagctacgaggaatcaagcaccacatgccttctctccttttatcccttcccctcggctccatccttgtttcctactactgctgcaaccgatgtcactccttgcatcgccaagcgttggttcaagacgtggagggagcaataccaaggaggagcttggaggaagagggcactgtctgctgcttcggctagctgcgagtgtgctccaccgacaaggtatcgcgtgtggaggcgcgtgagaccgaggaggatccgtgtaacgccccgattttcgttcaggattaaaaatcattaaataatgcattttctagaaattaaataaaagttaaagcaatttaataaagtgaaataatgggagaattaaaatttcctttaaaaatcattggccgagaatattttgtaatattctttgtgccctaaaatactctctgaaatttcacgaattttcggagctcgagaaataatttgaatagcacaaagttcatttaaccaatctctactacttaaaaaataagaggtgcttccatcgtccgtcaaaaaaaccgggcgaaaaaaaccaagtttgtccgatccaaaaaaaaccaggcgaaaaaaagtgcgaaaaaaaaaccaaatatgtccgatccagaaaaaaggcaaaaaaaaatgggcgaaaaaaaaaccaaaatttgtccgataaaaaaaaccggcgaacaaaaacgtgcgaaaaaaagaaaagaaaaaacaaaatagcgacaaaaaaagtccgagtcggtccctaaaaaaatagcgataaaaataaaaaaaagtttgactcctcttgttgcgattcaaaaagtccgactctagatccgaatcccacttctctcagattaagtccgagatactaggcaccacttctctcggtttcaatctataccattattccatacatcttggtgaaaaaaaattgatgtgctggattgaagatctgtttgcaaaaacggaacctacatatcgagagcattccatttttatatgattttaatttttgggtttgtacatttgtatttgagtccctgtaatttttatatttgcatttgagtccctataatcttgcaataaggtgcttttggtcttttttaaaaaaaacaataaataaaagggatataacaaaggtagaaaggtgcataaaaagaaaaagaaaagccacacaaaaaagaaaataaacaaaaaaaacaacaacagaagtctatttcccctaagtggcgaaaaaaaactgtagatgcaaacgggaaaaaaaatccaattcctataaaaggcaaaaaaaaaaaactggtgaaaaaaaacgctagatccgattcctttaaaaatggaaaaaagtctgattcctgtaaaggcgaaaaaaatccgaaaaaacatctaaaaaagtttgtccgattctctaataaagtggcaaaaaaatggttcgtaaaaaaaaaaagctggttcgtataaaataaaaaatgcacgcaagaaaatatggaaagggcgaaacaaagtccaatttctaatcagtataaatctcttctctatctctaatctaatctaactatttaaaaataaaaaatgcatgagaaaataaaaacgatcaaaaagacgtgtgagaaaaaagtcagaaaaaagcgcaaaaaacacgctgaaaaggttttttttccatcttcttacaaaataaaaaaacacgtgtgaaaaattatttccattgccagcaaaaactttttaaaaaaacatacgaggaaaagactgtcagaaaaaatgcgtcatttctaaaaaaaaatggtttaaaaaaaccacgcaagaaaaaacactatctattaaaaaaaccgctctgaaaaatctgtcagaaaaaagctaaattgatggacgcttgagtcgggtaggatccatcaattttttaccatctactacacggcttttatttcgtcatatattctcatgtattggaaaaaagcaaaaaataacatttaaaaaaacaggcaaaaaaaaccacgcgagaaagtaattgtcagaaaaaattgacaaaaaaacacgcgagaaaagcaaaacaaaaaagaggagaaaaatatggtttttgtcatcactaaaaaatggaaaaaaaaacatgctaggaaaaaactattagaaagaaatgcgctatttctgaaaaatggtttgagaaaatcgtggaagaaaaaaaaaacaccgtttataaaaaaagcaagctgctcattaaaatacaaacattgtcttcacatgattatgcatgaaaaacgtatattatcattaaaattttttcacccattgcaacacacgggcatttttgctagtttaataaaaagaaaaacaatcaaatctcccctccttcaatttgggccacttccggcccaaagccctccttccctccctgcggcccgtcccctcccctcttccttccttcctccttgggccatcgacctatcttccttcccctcgcgcaaagtctaaataaccccctgggttctcctccctctctccctccccgacaggtgggcccggcgaccccacctgtcaggccctcctcctaccttcggcttcccaggccgaagccgccatggtcggcggttgccgcccacgtcccgccaaatccggcgccctcccgctcgcgccctcgcacccaaaccaagtgaaaccggttcccctccaactcctccacattttcccccacttttccccaatttttggcgccaaattgagctccacttcgcccacgtcggcatcccacgtcgccgcctcttccgcgcgtgcgtggacgcggtcgtcgcccacgtccgcgccgttttcccccactctccccgcaaaatccggccacgtcgccgcctcccacatctctctctctctcccccacgtcgccggctggtttccacccctctcgggcccgatcccgcctccccgagccctatataaagcaccctcgtgctcccctcttccgtttcccccctccaccccgagctccctgcgcttttccccgctctccccacgctgctccccatcgccacccacctcaggcgagctccggccgccgtttcctgtcgctagggccgccgccaccttcggcatcaccgagccaagccctacctcggcatccactctgtttccccattccattgtcggaattccatctccaccatgaaaccgagccgccgccccttccaccgcctccagctgcccgccaccgccactctagccgctgccgcaccgcgccgatgccgccttcgggttcgccgcatcgtgccacgccccggccgccactccacccgtccattccatcgcccgaggactgcttccaccatcgacccgagctccaccaccgcctgtgtcgcctcaagccaccactcctcaccgcctcagccatcgccacgcaaatccgccgccaccctcggcttcgccgcgctgccccgcacaccggccgccactccaaatccccaaacgatcaccggagccccggttcagccgccaacccgagccaccaccacctctaccgcctccggcggcctctcctcgctgtctccggtcgccgcgcgcggcctaatccctctctctctccttcctcgggccaagacgctccccgaccgccccctcgcttgccgggccggcgccgccatcaccgtggtcgtcgtcgtccttccccgcgccggtcatcgtcatctcggtgagcatctccctcctcctccccttcctttcttttcctctctttgccgcactggccgccgcttgcacgtcgccgccatgcctaggcaccgctcgccgccgcagcccgcgtgtgccacagcttcccgcgccggtggccgcgccgccgctcgccgtcgctcggccggctggcctgagccgcgcccgtgccccagcgcgccaccccgtggccgcccgatcggcttgggtcgatccgggccgtcggttcccgtggaccggcggtggaccgcctcggtggtcccagaccacggtggaccggcgcccttgtgtcgctgaccggtggggcccgcttgcttgcgccgcccctcccccttgatgacgtcagcgcgtcccttttcctttgagaaaataattaataattgcacaataattcgttaataattctagaaattcatttaaatggctcaaaacttctaaaattcatatctaattcattcgaactccaaattgggccattcaacttgctaaattcatctaaaattgagatctacatgtttgtttactttttatgtactgtttccctggtttttattagagtttttcctcgttgtgcatgctagcgtgtagaatccgttgttcggaagttcgcggtcgcaaggatcagagttcagaaggttgaagtgaagaagcaaggcaagtcacacattccccttgagcatattgagcctactttacaattgttttactatttgcaaataaacatgcatattttgctaattacatgggatctgggtattacctatctgcttgcttgtgctatgtttacttgatatctgtcctttgtcaaccttgggtaataaatcaactagctcatgttacttatgtgacctagctggaactatatgcttagccatgcttaattaccactagctcagttgatgggataattacagtattagaccatttcagtaacagaatgagctgcgtgctcgagacatctggccatgcttcatggtcgtaattatccaactaaaatgcgactaaatggtgggctgtaggtgcatggttttgctagtcgcacccatggcaattaaggaccggttcgcgggaaaccttggaagaatttatcgtgcttaccacaagccaacgtgggcaacggctgggcttgtagtgtagctttcctctagccgacgtacccaggcgagggtgggcgtgatagagttgggtcggccggggtgtccggttgatcggcttccggattcaccgcggcacgagagggggctgcccgttgcctgctgggaacgggggcgaaccctgaggtgtggtgcgatcggttagagggggttatgagaagggtcctgtcacggcctctttccggtatgtcgtggtggcatgtcggcgcacggaaacatatcgtggggatttgtcttgtgggtacagttgtacacctctggccagagtaaaactattcgaatagccgtgcccgcgtgcccgcagttatgggcagtcgaccagattcaccgtgattagtctcaccttaataaatcgactcaatgcactgtagttcaggtgggttggttgggcctgttcaacgtggtgcagcgttgatcagtggaaatttaatgttattttaattactcaacagttttactattttactcaataaaatattttacaaccgcctttatacaaatagccacaaaccgtccttgtgttccccttacatgtctgcatcattggtgtggcttgctgagtacggtggttgtactcagccttgctattattcccctttttcagaagtgtagtgcttctgagctagaggcaaagttagaagaccaaggctcagaccccagttgagttttgcctgtggagtggagctgaagccctgctaggatcgcctttttcgctgatgctgcttttgtttcggtgtgagaaataagtgcctcttctgtaagtattttatgctttatttacgtttggaactgtttattacttgtcgttttgtgtaccctggctagtcctggacagggatttaatacacaaaatagtctggaaatttgggctaaatttctgggcgtgacaatccggctggggaaagcaacgaggaatcgcgtggacaccaggtgacgcggttggaaatatctattaatttatcaagttgtttaattatctcgtgactttagtcttgaacggcatcccgtgcgctagctgccctcttttagaaatatgtattacgtaaataataggtttgaaatagtcttggtttgcctcttaatgctgaaggaatctggtgtactatattggcttgtgtacaaatctggtacatgacaacactaatgtggaaaagatgataagtttggagcaagagtagcactttggttgaaggtgcgctgtgaggccggtacgtttggaaacttggaattattttaaaggtcaatataaagtaaagtgacaacactaagggaatgcacggcatcacgccgcgcgcagccatgcacacaaacatcacttaagcaaaaattttattaaacacaaattagctatcattgataagcgttctccatttaacataatatcaaaacgtagtactccctccgtcaaaaaaaaaaaaagctaacctagaaggggatgtgacccctctacagtaaatctggacatagcaaagtatacacaatatatatcaacctcccatgttatctaaccacacacattttgctagctgtaaaggaggatgaacacctgcaaaaaggaaataaatttcctagaaacttgaggaaaagagaataccaaacccccatcagacaactgataatagaagcaatggtacgtagcaagataaaaagcaaggttttaacatcattgcctaaatgtacccaaacatatttatttgaacttgtgtttaagcctttatgctgtaattgttttggacgccctaaaatatccagtgaacaccaggtacctcggcaactcaagcaatagtgaatcagctctgtgcacactccaaatgatgtaaaagctccttcaccaatctcatgcatccgaaatcatttcaaaaattcgaaaagtctgcacgtagaatataatcatttgtgaataataagggaaagataacaataacactaaattgttgggagcatcggagctaatatcatgcatgctagactaaaatcatggtaaagaaataagaacagcggaacaaagcagcagaatggtctctcttaatttggattaccctttcctaataaagtaaagagaaacattttcaagattcactaggcttgaataaactaaatcaactaacatacctgagtaaaccagaaacaatttattaactccatatgaccaatctatatgttgtagcagggggctaacacctcttcctcccattcggtcaaaacactggagtaaaagaggtgttgagaattctaagtgtccgaaagggaaattaccctttcgaatggtaaaacaccttttcaagtggaagaataccttttcaagtaggaaaacacctactcgagtggtgaattaccttttcaatggtaaaatacttttcaaatggttttatgttgctcagttaacttgagcgaactataatctatgtcaggtaagttccaagagcaaagcaagtggtaagaagtgtttgaactttcaagatagaaaaggcactcaacacaagggctcgaggaagaacactacttgagtaagggaagatgctaaaagaagattctgtgaggaccattctcaaccactcttgccagctggcgccaaaagactataatgacctacaagatgtaccaaaatgcacctagggttgacccgcgggggcaaagatgtaatcttgcatgtacgaccatgggctatttaagccggtcaaaatcctgtagcgggacaagagacattttataacacaaaagtaatcaccaaaaggttgtgtgtactgtttgagctctctaagaataggcaggagagttcctttttccgcctatccccaaacttggtcacgacatgatacaaaatcacaaagttcaacaaatggtatgtaaagcaagaacctcatattttaactttatttttggatgattcaatacttacagctgcagagtcggcagagatgcccatgtcttaatttggattaccctttcctaataaagtaaagtgaaacattttcaagattaactaagtttggataactaaatcaactaacatatctgagtaaactagaagcaatttattaactccatatgaccaatcgatacaaaatcacgaagttcacaaatggtatattacgcaagaacctcagattttaactttaatttttggattattcaatacagacagctgcagagtcggcagagatgcctatgtgcagggcttctatacgttgcatatcgagtttaacaaccatgttaggttgacttgatttgaacacaatctttatggcttcagccacctgctcaacacataggctatccatccatccatccaaaagttaagatcaccataggtcaatagcagcagggcgataacagctcaaatgtcaacgatgaaattgaaaagcattactaactgtaggatgaggcaagtacgcaaatactaccccataattcagacaacaaatccactcaattctgtatatatctaatttgcattgcacatacttagtagacctagataaattcctatgagatctccacaaatctgaatttcaactacgatttccaccatacattgcgatctccttccctcccattctctgatttggtcgtaacttgctttacgtcgagtttgataataaaggttcataacttattccatccgcatggaaaacgatgttgctcattagcatatgactaactaaatattagcttaaaacttaaaaatagattattatgattttcaagcaaatttattttttttgcaaaaaaaaacagatatcatttaacagtttgaaaagagtacacatggcaaacgatggagtataagttgggaaaggtgagtgcccaactcagctttatgctgtgttctttttcacacgcatggttcccaaacttctaaacagtgtgcttttatatatatatatatatatatatatatatatatatatatatatatatataagttgcttgaaaaaaatcatattaatacattttctaagaatgtttagctaatacttaattaatctgtatgatcgaatcacaataactaagctaaccagaggggggtgaatggttggtatacccaaaaaccgaaaacttttagcggaaataaaagttaccctcaaattcaacggatcgcagtctgaccgaaattgtcatgttggtctgaccgcctggttgccatcggtctgaccgaggttgaatctccggtctgaccgccgagatcagctcctgtcacctgtcgccgaagccggtctgaccgccgtgtccccgccggtctgaccgccgcgatgcctccggtctgaccgccggtgcgccaccggttagaccaccgaaacctggtgaaacacaaatcgaagaactcttaaagtagatgacaactttattggttctctccgtatttacaaagtgcaccaacaacactccttacaaaaatttcgacaaaactcaaaactctaactcaaaactcaactcaattgctctcaaaagcgataccaggaagcctcacgctccccctctatttatacccgaggtaggcagcctaaagccacgaaccaaactcatactagaagtcctaaacaccttaggaaaccctcaagtacaagaaacaaactttacataaccaatcatatcaaatttggactccttccaaattcgactccgcatcccatacgcacacaatacctccatcgtatgccatatggaatcttcaccaaccacatgcatcaactctagcctaagtatcccgcatgatctctgcccaccacggacgtcgtcttatccccaagccgactcccggtccatcaccgcaaatactctcccgaggcatcgagtcacctacacatgaaataaacaaagaaaccatattccgagaccaaagctatctccaacttgactcatcgttagcaaacaacagtattacatacgcatagtatccatctagaaaccatagtcatgaaataatcacagatatccaaacaaacaacccgaaaccgaaaccaacacagagtcggccggccagaccgcgggctggccggtctgaccgcgcgcataccgccagtctgaccggcaacccttgcctggtctgaccggtcacataaaataataacacctgtgattcacctgtaaatccaatcatctccaaaaccacttcgtaaataaattccaaataacaaaaccaataatctctaatgccaattgttcatcacagaataataatcaaaaacacctttgattttacataatcatgcgctaatccgcgtatccgttttacgtgtcggaggggaaggttcccaattccaaccctccttgccgaactcagccttagtttgcttcttcacaagtaggaatatctccacgaggtggcattcctgttgacatgatctgttcagaaaaatcaaaatatcacacacacactgaccatagcaatcgacataatcagtaagaaacaccaactaaaatcagtatgcaatggcgatcagtaaacaacaccaactgaaattagcacgcaaccacatgatcagtaagaaacaccaactgaaatcagtatgcaaaggcataatcagtaagaaaaccaactgaaaccagtatgcaatgacatgattagaaagcaacagcaaataaaaacccactttgtccacttgtcagtataatgcatagtcatgctgattgcaaacacggtgtccctctcatcctgaaaaggataaggtcatgctacagattgaaggagaaacagaacaggaaagattatatatcccagatttctgttatgtacgattattatctctaatcatcttagttcagtaaaaactctacaggtcacatgcactgaccaaaagtcctgtacaggaaactaaaaaccaagacagtgcacagttcagagttcagaattctactttattggtcaactttgtttagagttagagttgttcatagcaacttgatagtgaattcatagccaagcagataattcacgtccactaaaaaatagatatcttcacaaacaactgaagtggttagagatctgcagagacaagacctcatcatcatgaaagcacaataaaaaatggcatggacagccataaaaaacctctgctagtttggctctttttgaagctcaagaaagttatcgaggatatacatctacttggttcaatgcagatcaagaaaatgaccacggatatacatcaccaagtagactatgtgtataatggacgggagcagaccaaatggatataagtataatccaagctgagagcagtgttaagtgaacagccatataatggaaaacaactttcatgtttgattcagagagcacttttttcgttgggaataagttcttccctttccttttgtgtgaacagctttgtttcctgaatagtcaatgccactgttgtttcctgccagcaaatcttttgaaaaaatcttctgaataaacaacaagcacatgtttagaaaaataaaattaccaacaaaactttaaataagatgtccacgtatatgtgcggggctctcgtcctacttatattaaagtgcctagaaaagtcattttaaatggtattgtcgaccttttgcaaattatctgagcacaattttcttcgtaagttgctgcttgaaaaatgaacttgtcagcctttacctaagaataaaatctgtagattaagtccaataaaaatgtgggtcactctgtatgttacccctcagtgatttaactacacgctaaacaaccgatcatcaacgagggtttttcttcagcgatttaacagcacgctaacaactgtgacgggccgctggcctccgtcacatagaaaagccgttcacgacgagtcgatggctgtgccaagatcgttcccaacgcctcccattcccatgcctgccttcctagttgggactcgggagcaaatggaaagcttaaccagatgagcagctatggacgtctgattattgagcagcacagcacgcatatagttgctggggacatctcttattgttagctgatctgtgctaatgctagtgtagttgtgtacattgcagcggcgtgcctttgttcctctggtactcttttggacgtcaaaggtgaaggtaatgcccttttcctttattttgtagagaaagtagatatatactccctccgtttcacaatataagtcattttagcattttccacattaatagtgatgttaatgaatctagacatatacatctatgtaaattcattaacatcaatatgaatgtggaaaatgctacaataacttacgatgtgaaacggaggaagtagaacttatgtaagctcgtgtcctccttacgaaaggtcttgtttatagaggaataaatgcatccatcaacccgagcagatgaatatataagtagagtttaatatcgttgtaacatggaacacctgtggcaatatccttccagcagatcaatacaattcagccgcatccagtacatctgtactactccctccatcttgaccgtattactttctcatcaagaccaagaagagcactaacttctttctgattcatttaatttgatcacttttgttcctaatccttatttttcgtgagaccttctaagttgctctttattggtaatattttaccactgcttcctccgttcaacaatgtaagactttctagcattatccaaatttatataaacgttaatgaatctagacgtatatataaaatatatacattgatcaatgaatgaatctaggtaagataaaaatgttttacaatatgaaacggatggagtagcaacggttcgagctatcggtttataaggatgcattggtacttttcatgcttaaagaacctttaataataaaacaacaaaataaataaatacttaattcctcatttcacaatgtaagttgtcggtgacatgggaccgggagtatcatgactagaggcttgggcagccgcgatcacccacgtggcccgacccccccgagggggtcgggtccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgtttatccggtccgtgaccgggcgcagcgtgtgaccggtcacagaccggtcagatcgcgggttaggtggtggcaggtggcctgttacacgcctcgccccgtcccgttggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcaggtaaaagtgcgagccaaatcttgctcaaagtaggatgggtccccacccaaaagaagggtaggtagaaatggtatatgtggtatccccttgagatataaaaggaggaccatgcctaccaagaaaagggaagaaaaaaaaaagaaggaagaaggagagaggggagctcatagaaaggacggggaaaaagagtagggagagggtctctagagttgaaaggctcttgctcttcagctctttgtaactccttcagagacagatccgccagaacacaggagtagggtattacgcttctcagcggcccgaacctatctacatcgcccgtgtcttgcgcgtttgctctctcgcgaaccattccacagatcaagggcttagaacctcacttagcgcccccggccgaaccggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagctcgtactccgccgcccccctctcgccgaagtcttaggcgggaggaggcgctcgagggggtcgaaagatccgcgacttcaccgcccacgagcgatggagaaggacggcgagacggggagcgtcgtctcctcgtctacggtgatggcagcacgccccagggcgtgctccaggctgcgggcgcgctcctgcgtcacccgcccgtcgtccctgatccagagactccaactcgacgttggctagatgacgtggccaacttggtcatgacggcgcagcagcgtttaggcgccggcgggcggtcctccgccaccaaggccactggtgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgtcgtgctgcccacgcatcggagggcgcttcctcgtccggagcgccacttcggtccggacacggaggccagccccccgtgtccccggttggcggtgccggctgtcgagcctttgtggcgagccttcgaaacgtccgttggcccccaaggttccggcccaccatcaccgaaaaatacgacggaagcgtcaaccccgccgagtttctccagatctacacgactgggatcaaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaagggacgatgagtctcttcgctcgtacattcagcggttttgtcaagtccgcaacaccataccatgtatccctgcacacgcggtgatctacgcgttcaggggggacgtgcggcacaaccgcatgctcgagaagatcgcctccaaggagccccagaccactgcggagctttttcagctcgcggaccgtgtggctcgcaaggaggaggcatggacctggaactccaccggttccggtgtggcagcttcagccgcccccggatccgccgctcggtcagggcggcgggacaggaggaggaagaagaggtcggcccattccgacgacgagggtcacgtcctcgccgtcgagggcgcttcgcgggccacccgaaaggggaggcctgcgagtgacaaagagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaagtccccagcggctccctctggcaaccggcgaagtgaggccaagcagaaggcccccgccgaggacattgacgatggcgacgatgacctagggttccaggagcctggggccaccatcgccaccgtcgatgggggagcatgcgctcacgtttctcgccggagcctcaaggccatgaagcgagagcttctggccgcggcccctacccatgaggcgatgcggcgggcgcggtggtcggaggttgccctcaccttcgaccagaccgaccacccgccgtgcgttgcccggggaggacagatcgcgatggtggtttcccccaccgtttgcaacgtgaagttggggcgtgtcctcatagacgggggagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcttacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgagcaaacgctgacgtcttcgcatggagaccggcggacatgcccggggtccccagggaggtgattgagcaccgtctcgccgtacggccgggcgcaaggccggtccgtcagaaagtgcggcggcaggccccggaacgtcaagccttcatccgtgaggaggtggcgcgacttctggaggccggattcatccgagaggttatccatccggagtggttggcgaacccggtcgtcgttcccaaggcgaacggcaagcttcggatgtgcatcgactacaccgaccttaacaaggcatgtcctaaggatccttaccccctaccacgcatagatcagattgtcgactccaccgcagggtgcgaccttttgtgttttctagatgcatactctggttatcatcagattcgcatggctagggaggatgaggaaaaaactgcattcattacccccataggaacttattgttatatgacaatgcctttcgggttaaagaatgcaggtcctacttttcaacgtactactcgaatttctttgggtagccaaataggacgtaacgttgaggcctatgttgatgacttggttgtgaaaacacgcaaccaagagaccttactctcggatctagcggaaactttcgaaagtctccgcaccgcccgcataaagctgaaccccgacaagtgcgtgttcggcgtgcctgcgggcaagcttctcgggttcttggtctctgctcgaggcattgaggccaaccccgagaaggtacgagctatagagcggatgcgccccccagcaagcttagggatgtgcaatgtgtcactggctgtatggccgccctaagtcgattcatatcgaggctgggagagaaggcgctacccctatttaagctcctcaaacgctccgggccgtttatctggacggacgaggctgaacgggccctcactcagttgaaggcgtacctcagttctcccccagtcctggtcgccccggagccagatgagccgttgctactttacctggcggcaaccccgcaggtggtcagtgcggcgttggtcgtggagcgcgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccacggggccactgcgggaaggccgcgcctgtcgccctccgaccccgaggtcgtcggcacagaagccgagtgcgccccgcgaggcctctcggacgaagagcgccctggagatgtggcccctagtgaagaagatcggccccgccgaaaggtgcagcggcccgtctacttcgttagcgaggccctccgggacgctaagacccgataccctcaggcccagaagatgctttacgctattctgatggcttcgaggaagttacgccattattttcaggcgcatcgggtcacggtagttacgtcttaccccctcggccaaatcttgcataaccgagagggtactggacgggtggtgaaatgggcaatcgaactctctgagttcgatttgcgctttgaaccacgccacgcagtcaagagccaggccctcgccgactttgtggcagagtggaccccggcccctgagcccatctccgtccccgaggccagctcgggcccctcgcagctgcctcacaccgcctattgggtgatgcagttcgacggctccctgtctcttcagggagccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgattctcagttggtcgttaaccaggtctccaaggagtaccagtgctttgacccgcagatggatgcttacgtgcgccatgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtactggtgggagggaccctctatcggcgcgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggtcgacggctctcaacgatgcggtcgacctggtccggcggtgcagggcgtgccagttccacgccaagcaaacccatcagccggcccaggccctgcagacaatacctctttcatggccgtttgctgtctgggggctcgatatcctgggtccgtttagacgggccccgggcaggtttgagtatctgtatgtcgctatcgacaagttcactaagtggcccgaggcttatccggtcatcaaaatcgataagcactccacacttaaattcatcaagggcatcacagcccggtttggggtgcctaaccgtattattacggataacggcacccaattcactagtgaactcttcggtgactactgcgaagacatgggcatcaagctctgcttcgcctcccccgcccaccccagaagcaatggccaagtggagcgcgccaacacggaaatcctcaagggcctcaaaaccaagaccttcaacatcctcaagaagcacggcgactcgtggatcgaggagttgccagcggtgctctgggcgaaccgaaccacgccaagccgagcaaccagggaaacgcctttcttcctcgtctacggcgcggaggcggttctcccatccgagctcaccctgaggtcccctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtggcccgggccggcggaaatcgccaaacggggcccagaaccgagccgtgccccggggcgtggtgaactccggaggggaatcggcaaaggcccacaatcgggtcatccataaccctcggtcaccacgttcccggcctggccagtctcgacacgtggatctccccaggcactagccccgacccgcgccatttgaggctaggacctgggcacgagccctcgttcaaaccaagacacagaaggaccacggcacaggccatcctcgtctcatacacacgacaaacagagctgacacaaaaatttcctctttatttgattgcagattaaattagtttgtacaagaagggggcccgaaggcctcagaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtggtcggcggcgtcccggacctgcgcgcgcgcgtcgtcctcggttccaggagggaactcgtccagcgccgcccacggggagaagtccgggtccctggcctggtagcttgccagtacaagctctactgccccccgggcgaggtctctcgaggatgacttgatcgtctcctcgagctcctcggggagccgctggagagtcccggccatctctgagaggcgctgggcgaggcccccctggttggcggcatatttcgcgatccgcccgccccagaggcccgcctgccgcccgacgcggtctagacgggagacggcgtcccgaagcatgccgggccctacctcgcctgccaagcggagggcctcgacctccccggcggacgagtccagcgcgccctgcagctcggcgatagtgtgttcggcagctgcgaggcgggcggctagatcgccgtcgcccgtggccgccccgccgctacgcgccctcgcatccagctcccttgcccgtgcctcgagctcagcggcccgctgatccagtgcggccctctcggcgcgggcaccttccagattgcgacgcgtttgtttctcctgcgctgcctcacgaagggacaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtctgccaggtccctctccttcacgcaggcgcgctcttccagcgccgtggcacgggcctcaagggcttcttcgcgacgtcgggacgccgcctcggtctccgccgcccgccgttcccgggcagcagcggcatcaaggaccccccgggcggcgtcgagcttttttcctagctccgccgcccagctcccgtattgaaggcggaggtcgtcctgcgcctcgttcatcactgcggtggcgatgagggcagcctcccgctcctcctccacctccctggcgatctccgccagctccttccgacggacctcgagctccgaggtgtgccggcggtgtgccttgcggcccgcctccaccatggcctccaccgagcgtcgcccctcttcgacacgcgcccatgcagcgtcgagctccgcccgctctgcctgcaggacctccatctgggcacttaacccgtccaacaccgtggtgttcgcggcggccaaggcctgcagaaggggctctacgctcagtggggcagcggaaggcatgggggagagccgcctcggtggggatgccgcacggctcggcccgccgatcgacgtaccggactcagggacgtcccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgtgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgcctccgggcctccgcggtcgccgtatcctcggcctcagaccggccggacttggaatggcgggaggggcgcgacgggatctcgctgaagcagaagaaaaaccagaagacaaacaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgttgctcgcgcccacgtctccactaattccgctcgcccgtttgcggcgcacgaggcggatgtgcggctgtggcagttgagatgggacatatcgtgcgcgcgttaactatgctcgccaacctaagcgccatcatcatatctccaggcaaaacgaaccggctcgtcccgattcgcgtgctactcgagtaatgtagcggtcttaaagagaccgctcattatagacagtcggttttccgttgccgatgtgcgcgatttgcgaccgctgggtttctgcccgcctgtagagaccggccccacctgtcaccaggcctaaggagtggcgtcacgcccgagcgcttccttcggggggggcgatcgccctggcataacgccgggggctactgtcggtgacatgggaccgggagtatcatgactagaggcttgggcagccgcgatcacccacgtggcccgaccccctcaggggggtcgggcccaagggtgatgtggccgcccctccctttgtctccccgaggggtcggactgctcccgtttcgaccccgagggccggggcgccccgaccccctgtgggtttggcgccacgtatatgggttaggtgagcatagcggggctcacctaaccgcatttattgcgggttgaacgagcgcgtcacgccgcatgtaatgcagcgcagcgcgctcgtttatccggtccgtgaccgggtgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccagtgtcaggtaaaagtgcgagccaaatcttgctcaaagtaggatgggtccccacccaaaagaagggtaggtagaaatggtatatgtggtatccccttgagatataaaaggaggaccatgcctaccaagaaaagggaagaaaaaaaaaagaaggaagaaggagagaggggagctcatagaaaggacggggaaaaagagtagggagagggtctctagagttgaaaggctcttgctcttcagctctttgtaactccttcagagacagatccgccagaacacaggagtagggtattacgcttctcagcggcccgaacctgtctacatcgcctgtgtcttgcgcgtttgctctctcgcgaaccattccacagatcaagggcttagaacctcacttagcgcccccggctgaaccggcaaaggggagcccgcgcggtctcccggtgaggagccccacgctccgtcataagtcattctaccatttcctacatttatagtgatgttaatggatttagatatatataaatacgacaaatggtcatgttaaaaagggataaacagaagcgtacatttaaaatggatgtggtagtttcttagttggtagtgtttttataggaatgtatataatttcaaagttatacaaaacaaaaaaagatgaggaaaaaatatgtttcacaatgtgcatagcttcctcatctctctacttctataaagaggaagttgtcctcctccacctccgcgtaaaaacctttcttaaaagaaaaggtccatcctaaaaaatactttctaaaaaaacaaccattgaaaaaaaaaaggaacaacccactggactaatatcctcccactaaactgaataaaaaatcgttctgaagcacaagctaacatgcatgtgttcagatcacgtgagcacagctcgtgcgtagggagggatgcaagtgggtagtctcgttacccgcttgctagtttatttctggtatggtagtacaaaatttagaagaaaaaataagctagaagttggataagcggaataaaaaagcccgcttgtccgcccccgcttgcatccctactcgtgcgctgcatcaagccaagcccctacgagtagagatcactcaagaagaacggctgaacgaggccatcgccggagggctgtgagcatgtgaccggcatgctttgaatccgtgccttctttctctgcactgcttgatgccattgcaactttgcaaggcaaccaagtgctccagcccccctggtctcattcccagactttggtagctgaggctactggaactatgttcggtgctgcaaccgttgttggcattccgtgtgcctcccgttccagtgatatcggtcaccttgaaattcagtatatgtgtgtgttcccttctgcttcctatatattttttatcccaatccatggagttgaaagaaaatagtgtaaagaatagatcagtatgtatttaatacaaatgaaggtaaggcagatcgtgttaaggctaaatgtaaggttatatctatatgtgagcatccctacaaaaactaacccaatggaagagatgtcccaaaggcatttgcgctaaaggtcaagaaaaggcgccccaaggtcggctcttacctatatgaggacccgaagaccggttcttaactcgcgcttttggggaacacacagcaagggaccttttttttttttgtgagagccagggttgagccctggcctgtagcctcacaaatgaggacttcaccgccatgctatgagcacgttctcagcatatctgaaataagaaacaacataagatacaaatccagaacaatccttaaggatacatgtagggtgctatttatattctgcaaagaaacctagccagtaactttttatcttttgttgaacaatttacagagtcatcaaatagtaactgccatatatactgtcaagataatcagaaccatcctaaaaagataataaagcaaattatcccatattaaatcatatctcagtacctcacaaacaagtaccccatcacatgttaaatggaaaattagacacaactttgtattacaactcatgaataacaccttttttttattaaaaagaagtgcatagctaagaaaagcaccctgatggaaagataatgacaacgacagaattccaaaataatttgtcctgacagctaaaatggtgcttgcaataacatactaaaaactgatttggcatcagtatttggtaatttgggacaggattttctaaatatagcaggaaaatacaaaagtttattttctcagaataatgatcaacgaatctacatgtaatatgccagttgttgaaagagaagcaaaaaaaagagagagagagaaagaaatgcaatgtgcaaatagcaaagatgcatgtttggtgtttccgctacaaaagtcatggaccaagcgaaaacattgctctaaattcctataaagattaaagaagagggggagagagagaataagatggcaagacaaggtaatactaattgggctcaattatcttcccttaaagtaataatatagtactatgtttcattcagcaaaagtatcataaacactaaatatatatattccatatggtaattcaattggctaatggaacactattaggacaatttcaacaaacatgttatggatgaaaagatgacaccaacctgaggtggtcagtgaattatcaattatgcagtgtcatctttatatttgcctgcttgtctccccctcgtcctagggatccttcttaagcttcttgcttgggatcacacgagggatgctttttctcctccttatcaccaacttttagcaatcacacccagctagagagaagcatgctgtggaacggcagtagccagtaggcaagtgaccatgccagcttgaacaggttagtggatggaggagagtacaggaccataattccaactctgagtagattcagtggtgccatcttaaaatgttttctctcttttcgttccattgaagggttctatttattagatcaccagacacggaccattatgaaccttaagtacctgacgtgcttgaataccaataaaaagccactttcctgaatggtacccttctccattaaccagaggatggtcctcaccaaatcaatgtatctggaacggatgtcacattttattgtgccaaaccatatcctcaaaccatattggctgcaagtgtgtaattctagtaatgcacgttgaacttgagactgcaagatgaattaattcttcaaccttaaggcttcacttgagaatgatatctgttcaataaactcatgagacatgacccctcttttttcccccagagacgtgactactcttaggattggaaaattatgtgaatcaagtgctctaaacatcaagaataattagccactcagctcaatacaactccatccaggttccttcattaatccttgcttgcttagttgcctcctataacttgtggccttcttccatttccctaaacaactgagcatattagacatcagaacacagtgatcagaatcttgagtctccaaattcagaagttcctctggtatgaaatctatggatgaatcagcacaacgagcactgtatgaactaattataggagctaaaaccttattttgcacctcacttggcatctgcttgaagaactttagggcgctcccaaaatgaccagctttacaaagcaaatcaaccatgcacatatgatgttcaatagatggctcgataccatattccattgtcatgctgtgaaagcactcaagaccttcatctactaaaccagaatagttgcatgcggtaagaacatgagtaaacgcaatcccatctggttgaaaacctttgtttttcatctccttgaaaaggacaagagcctcacttccttctccattgcaagcatacccattaatcatggcactccaaacagctatatctctattggtaacaccctcaaatattttcctagccagattgatgctaccaaacttgctatacatgtcgattaatccagtagctactcgcggctctgaatgcagtccagtggcaattgcctgctcctcaacctttttccccagattagcagaccccaatttggcacaagctgaaagaactgatgacagagttgcttcattcggctcaatgtttgcgcacaccatgctatcgaacatcaccaacgcttcattcagatgaccaccttcaacatacccacttatcattgaagtccacacaaccacattcgccatgtgaactgcatcaaagacttctcgagcggattcaagatctccacactttgcatacaagtttatcaatgatgccgcaaggtcttcctcacattcaaagccaagcttaataatgagagcatgcacacccttggccaccgacaagttcccaaacagaacagcagctgatatgagattcacgagcactaccgagtcaacatttttcccaactccccgcatgcggttgaacagatcaaacacctccagataatcccctctaagtaaataaccagatgccaatgcagtccaagtaactacagacttgttgcatattccatcaaacaacaaccgcgcagcatccagatggctaccacggacaagcatggtgagaaccgagttcaacacaggcaaaccggcatcaagcccagatttcacgctaaacccgtagacgcacatgccaggattgcttgcggaaacggagtccacacacccggagagcacgccgacgagtgtgccctcgctgggtctgacccccgcacgccgcatcgcgttgaacaccgcaacagactcctccacctgggagctcctgccgtacgcagcgaccatgcagttccaggagaccagggtcgggcgcggcatttcgtcgaacaggcggcgcgcgtcggggaggcgcccgcacttggcgtacatgtcgagcagggaggtccggacgaacacggcggaggcggcgccggcgaggagggcgtgggcgtggacggcggcgccgaggcgggggaggcggagcgcggcgcatgacttggcgagggacgggaaggtggatgcgccgccgccgccgaggcccgcggcgaggagggaggcgtagtggcggaggcagcgggagtaggagcccgacgcggcggcgtgctggatcaggcggttccactcgcgcagggcggtggtggtggccgtcgtcgtcggcggcgtgggttggctcatgcgtttcgaggttttcgggggcctttcggttgttactatgtaaatttcgacaaaattgcatacctacgatcgcaaagtttggacacactagaatgccagcacttaaacgggcttcgctagaataccacgttgaaatgccattatgtaccaatctacccttgggcttcatcttcctcactccaactcctcatcttcctcgtcaccggtggctacggtggcagcaaggagagccggcggccagcggtggtcgtttgcatacggtcgatgggagtagtgggggcagaggcatccttggggcaaggaggtgcagctagcggtcgacggcagccgcgcggagggctaggggtagagtagggcggagcgcggtagggttggcgaggacagtggcggcagacgtgctctcgtcggccgcacacgatgaccaccgccgggagccgtcccggggcgacgacctccgcccacgcgctcccgccgccgcacctgcactcctgccaccgcccacatgttcccgccaccgcgtgcaacgaccgctgccgcccacacgctcccaccaccagtcaccgagctcgctccctcggttcccctcgccgtagccggccaccaaactcgctcccttggttctcctttggtgattaatatgcagattctatgtttttcgttaacatattttttaaactactatgcagcatagtagaaaaaatcagaccggacaccgaaccgcttgaactcatggtccacccgggtcatcgattggacccactgggtcgatcggtatttatacaaaccaagctatatgatgagtgaaagccatgacacctcagaccgcttggcactaagatgttatagctcagcgccatcaaagatgttatagctcagcgccatcaaggttggcgctgagaaaacgaccttttttaaaattagtttttggcacggttcaatctcagaataagttttttaaaagtgtcaagttgtcaaaaatatggctaatttattttagttccgtcactagttttcctgttgcaatgttcggcgtaggtcatctttttatactagatgatgccccgcattttgctgcagtatatatgttagataatagagaaatgataaaattatttggactgaaatattatgaaaattatttaagagtaataatttagcatgtgtatgtttagttttagaatgaaataaattgtagatattattactatatgcttgcataataagctttgtgtgctcaatgggttgatgtggcatacttgcatgtaggttttaaaagtgctaataaatattatgcttgcatgttgagctttattaggtgtttagttgacattatgtttatagaaaaaagagattaaaaaaataacaaaacaagcctcactaaacaatcaatctactccctcggtcccaaaatataagggattttggtggatgtgactcttactgagacaatgaatttggacagactaggaaatgtcacatccacggtgtgtttggttcacggtcatgcatggatgggatatggccatccatattttgttggatatggcgatccaatttcttgttttggttgaagggatatagcatggatgggaaatgccaaaagttagtgggacccatttgtcatatatatttttttatcaaaatataatcattcgagatcttgttttaaagattcaattgtaacaaatataatgtaatggtgtaatcaaattataaattagataaatggtttaggtgaaaaaaatcatttggagcttgcttaacataaaatcaaaccaatcgcagccaatcagaataggcaaaatttgctacaaaacactcaaagattgtggtctttgctgtgagacatccgaagattgtgtatttgctcgtggacactataaaaaaatggtaattagctgctggacactcctcctattattttattattagaaactttggttaaagacaagtttgcccatgggcctacttgtcaatctctctttctctgttcttcttcctctctttctctgttcttcttctttaatagcaacgcgacacttttcatcgccctcggtgcgcccaacagcagcaacacggcggccggcttctcgttcacaccgatgcgccgcatcccctcggtgccgacgttctacgtcgtgacgctcaccagcatcagctgctgcagcacgcatcgccggtctccgacacgtcgagttgtttcatggcgacggcgcgcccgccgctgaggtcggcacggtacacggtcccgaagctccccctgccgatgcagtacgcgtcgttaaagtgctccgtcgccgccaagatgtcgccgaaggagaacgtcgtgtccttgctccataacgaggcctgcaccgccgttgtcgtcgccgccgccgagctcccgccgctcgccgccgtctccgcgttctctatgacgacgtcggcggctcgcctcgccttgcgtgacaccgtgcaaaccaccacgaccatggacaccagcagcgcggtggcgagggagagcgtgacggcgagcaccagcctcgtcttaccggagtggccgtcgccggtggtggtgttcgagctgcaatgttgttgccgcacaggccagggttgccactaagatccagcgtcgtcagcgacctcatcttgccgagcaggggcgtcaccttgcgggagaggttgttgctgctcaggttgagataccacatctcggccagcttcgtcatcttcccgccgccgccccgccgtggccgagccgtctcgggttgggccagccgccgtcgcgcctctgctctgctgcaaggaagaagaaggggaaaaaaagatagagagaggaagaacagtgttaggggcattttggtacttacacaactctttctctccatctcgatcagaaataataaaataatgggaggagtgtccagcagctaattaccacttttttacagtattcacgaacaaatacacgatcttcgggtgtctcacagcaaagaccacaatctttgagtgtcctgtagcaaattttgccatcagaatatgacacatcaccgagactaaaactggatggctttatccagccaaatcagtcggatgcactcatctaacatattgagggaatattctctattatgggccgccccatccgccctgccctccaaccaaacaccacaaaaaatcgggcggccatctcccatctaggctccgagggagtactttttttttttttacctgcttcctcctctaacctctatgggcccattggcccaagggcccaattccccgctcccctcctcctttcctctctctctctcccagcccgcactccctttctctccccctcccctaacccctagctgagcggcggcggcggccggcggccggcgagcggtgagggcgcgaggcggcgcggcgtgcggcgcaggatcgagggagggctcggactgccggcggggggcaggcggacagcggcgcgacgtcgtcacggcgagtcggcgacggcgcggggcggggcagcggccagcggcggcgccggcacagggactctgggagggagccgggcaggcgggcagccggcagccgaccagccggggagaggagggattgaagattcgaatttcgaagtattgaaccattgactcattgaggttagggaactaaagttcactgatttcatgatttgttctacacttctacttaagtacttatctagtgaagtatctactagactactacttgcttagtttttacaactgtacttgtgagtagttcatacttgatacttcatagttcctactccctccgtttcacaatgtaagtcattttagcattttccacattcatattaatgctaatgaatttagatatatatatatatatatatatatatatatatatatatatatatgtctagattcattagcatcaatatgaatataggaaatgctagaatgacttacattgtgaaacggaggaagtagttactatcttgcaaacttgattagctagtaaggcagttagcgaggactaggagccttcaaccttggctactaggatttgttcataggaattcagagatcttagtaattagtatttctatcctttatgtatttcatatgctggcactttcatatgtttaccaattagtatttctgtatgttaaacaatttcaagtgattgtcaattctatcaatgtgtgaacttatgctcaattttatgttatacatgctatatattatataattattagtgtgtgatactatacaagctaatattaggcttttaggtgtatgaacaaaaaaaaaattaccccttcccatttcgaatacggtttgaaatcctgggcttgcccctggcttgttcgtagatttgcaatttgcaaaaaaatagagacgaaaacatcgcacgtggtatttcactgataacgctaatgctatcactctacagattggtatttgcatatttatagtcattttcactttccatcagtaaagtacaagtagtacagctattatatttcgtaatttttctcccttttttatgtttttatgtgtgaatttggacaccattataccgataaatgcattgtttgtataaactgatgagtactccctgtatttatctcttgtctttgccagtagcagctgcacagttaaaaggcttgtttctaggaatgtaccattgtttgcttctatagttttcagtatgacctgttgtggttgaagccgtagttgtctggtgtgctcattaacataaatattatgtgttatttgttgcattgaaggagcaccatggatggaactctttgaatgcttttcattcatttggaatatctagatatggttatggtgcatcaattaatttattcacataggtggtcaagggcatacttagagggtctcctctaagggttcatatgttaaatcaatgcctgtccaattcattggcctcccagtttagtttccatactccttggctgtattagtttcctgatctcgcacttcaccgtggtgcttactgaaaataagcaaactgtttgtcttgcagttgtctgttctgattgactgaaatttttcgtttttcagggctgaacctttttcttaagtaatagcaaactttatttgatctgaaatacatgtacatgctttttagccctagagatcctagaaaactttttattgttagcatggatccctgattttatttactgagagcattctaattactaaaacactgagaatcacctcactactctaaatactttatgcttagatgatatgttggtgttcttctcacacagccttgtagtgttacaatatacagtttctaaatcctggctccaccatttttttattattattaacttcgattgggaatgcttcactaaatgttgggctggaaacactgtttttgtgtgtgtgacatttgccagcaggattattccctctccctcatcctaattacatttgtgccgtccctgctgttgggttgttgggtcccccttggacctccaacagcagtatgaacacaggtacacaacatgtcaagcttaatttgcaggcaaagtggacatgagcgagggctttctgtcaatgtgttcacaaatgtgcctactccctccggttcccgtttagttgatgtttgaggcttggactattttggatggaaaatcttgacgttttagccatgtgatcaatttagactgatttgcccctgcttggctgcatgcatgcaaatcacatttaacttggtgcatctgagtccttcacagcaccataaaaatcatgaggataaaatcaatttgccgaatcatctcctacagcatagtaaaaatcgtgtggaaaagtagggtgccaagattcaaacttagcacatgaagctttgggactagcagtcataaccaccaggttaagaggatttgcttgttggatgtgctattctaatgtgaacttattaatcattccttggtatgtgagctcctgtccaaaacgtcaataactttgaaaccggagcgagtactgcctaggggcacaaagccaattattataaccacctccatcaattagggtttttatccagggcaagacttccatccctatgttggatgccctttgctgaaaagctatttgttgtattactacttagctcattactttcctcttttgtatctgtactagatagtaaatgtgatagcatctcttgttttctcttgagggaaaatgatagcatctcttgtagcttatagttcttaaagatagtctttatattcgtaactgattacctggatgttacctctatttgggtgatacagtttttcccatccattcatatctacaggtattaaaggcagcatctttaccaaggtgctaatcagtcacatgcataaccatgacttctgaagacggagacatttcagctctgctctctgaaccaagtattcctgaagagcagcctgaggcatctgaattcgatgacgtcgtccctgcaattttggaatcaattaaatcaagtgagaaggcattcaaaccttcaccggaggaggctgcttgggctgattcttgttttgtgcagacatctgagctttcggatagtgactggggagcaatgaagcatgccctgcttaatgctcttgaaaagccaacagaaatacccaacaatacttctgaaattgtgcacgaagaaggttcccatgcaattttagaggtcaaacctcactctctccctgctgaaattgtttctcagcatgatgacatgcaaatggagcaaaaagaaaataatgattatgacactggtactactgaagcttcggaagttgctaatgtaattaggggcacaaatgaacatggtaagcaaatggatggatacacagccagacctgaagatggcgatgagttgtcttcgtctgaagttcttgagcagacagagtcaagagagactatctttaaggtgtgggatctggacgttccgttttctgatgaggatgagcttgaactcatcaaggatctgaagaaactcctcaaggacaatcctcaggagtctgaatttcgacctcccagtggaacagccaagacattgagccagatagccgtcgatgatctagtggcagacttgagcgacttgtcattgcagcaaacagacgagtagcaacattcccccaagatatttctgtggcaaaattttttaccatccccgatgaactattcttcgttctctagctaacagtgcagatggcttaagtggaggctgtgcgtttgtaagaattagattgactgtttcgctgttcttttgaatctctacctttcttaataggtagttgtagtaaaaaagttgttcttttttatctgcgtgtattaaactataggtcctcaaacttgcacgcttggtttgtgcacgtccctgtactgattacgcatccacataatttgggtccttctggctatagacatgccacttgtaagttgacttgtgctgcgaacggcgtttaatcgtcctccgtgttttgcgctctcgtcctcaatctgccgctcccgggcgggctgtcagtttagaggagcttatggcagttgccaaaacatcttcaaacagtctacatttctacttaaatattaaaaagatgtagttgtataatccaaaaaaataaactagaagccagaagttgtatttccctgcttctctatattcttaccaactaggttctcagaattaaacttctcaaatagggcctaagattctaaagcagatggtagcttttgagaatatgaaaaagttaggtttttcaacttctaaattttagtttattttctgaattttacaactacaacttctcataatctaaacgaaaaactgagttgtttaggtgagattctaattctggaagaagttatagcggccagaaacttccctaaataggtcctaggtgagtttctcttagacaagttttggcactgtcagagactatattgattttggtaaaaattggctatcatttgtactaagatttggcattaaaccaaatcagcctatcaattctatatttaggtcttacctacaagatcacatatttagacataatcaagatcttcgataagaatcctataaggccgactctctcacacattgagatgcttgatatgatcattgagttgaattataccgggcaactctcgcatatattaagacaccatctctaaataaaatcttacaagaccaactatctcacacattaaggtatgatcttacaattctacaaaactgactccatgcaaagctagctagacacatcgacagctgtcgactaaaggttttagtgacgcaagaaaagaacgacaaatgcacttgcgtgctattgatgacatgtcaccaatgttttaaatagctgactaaggcatttagcggttagcttctcaaacagctatagcgggctaaatggagctatagcggctaaattgtacatgaaagcaaatagctagaacccttctcaaacagctatagcgggagatagcggcagctatagcgggagatttaaaaccctgcatgtcactccccatgggtatgtaaattatcatttatttatatactaagctaaactttgatcatgcttgaaaatatctaatgatcatatagtttgaacctaaatttgatataacataagtaaatatcataaaaccccatgtattatggtccaacttcataaactacgtggcttttggcacgtgatacattacccccaagtattatggtccaaaaattttacaaaatcatatggttaataatttgggttaattggatcatgccattataaaattgctagttttgataaatactattactatttatcttttttaagcataccactacatctgtctcaaaattggatacatgccatcatctacacttaatatacgttttgaatcattttacatgtgttgtattttagtatggaccaaaatacctccgcttactacatcgcaagcattgtggttccccatcctggatcagctcacgctagacctgctagcacaactccggtctgacttaacttcggctacacaagcacatgcccttgctttcaaaggcgagctaggacggggtcttgctatcaagccgattgccagagaggtggagcgactggagatggcccagccggccgaggaactccaagttctagtcgaagcaggagttgccagagagcttgagctagttgaggaattagcagttggctaatagcacagcgtggcgggattgggtccttgagcgcgttgccatcacctcacttgatgccactgacacctgcctgtttcaccgtcgctcatcatttccgtcagcttgccgttgagcttgtcatcgccgctggggccacgtgtggacccgccgtagaccaccgcgacacaaccctgccaccgtcgccgctttctttgccgttagcgccgccgctggaccatgtgtcaccgtcagacccgccgtccctgacgttgcaccttgtcatcggcgctctgccatactcgtcgtggggtagctgtgattgggggattgtgggtttttgaagctaggttgccggaattcggggttaaggttgaaagatgattggcatgtgtatttttgtccatacataaatacagagcacaaaatatgattcaaaaacacgtgttaagtgtaaaggatggtatgtatccaattttgaaagaattatagtggcatacttataaatagatgaatattaatggtatttttcaaatctagcaaattggagttgcattctagctaaaataaaaaatgcttaagttaaatggcgaaagctttttatacaatggatcaaacaatatgaaatttcacttttaattagagggagctcatagagaaagtatcgtcgtaaacaagcgtcttggtctatacgaagtttttttcgtgctctaaattgggatagaccgagtaataataagaaatttgggccaacaaaatagcaagttggcaactcgaaaagaataaacaccattgtttctgattttgccgtagccaaaaattgctggtatgatcgccaccacacatatcggaccgtccactttccatcggaaggcccagacttgcccacgcatgatcccaaggaacctaccctagtccaagcggcgacgatgaacttcaccacgggacaatcagtcgctactcgctggagcgaaccaagagcgccgacctgcaaatctccaaaaccccggtgtacggtcgcctcaaaccccgatctccccctccggccgccgtccgccgccgcggcactccggccggcgggatgagcccctccgggcggctccccgcccccttcgtcttccccctcgtcctgctgctgctcgctctggtaagctgatccccctccgaacctcgatctccggttagatctggtcatttcggcttctcgacggttttcgcccttcgattgactcccccttcgctgcaggtgccgtcaccggaggcggccgagtccacgccggggacgcggacgcgcaagatcggcggcgccgcctcggtgttctcgctcttcaacctcaagccccagaacaagttctggtcggagtccgtcatccgcacgggttcggttccgcgcttcgcagtggtttcgttgtttgcatgttgcatccctttttttggttggtggtatgctgacgggttatgtaatttttggtagaattcgatgacttggagggctcaacatcgcgggactccagcaagaaggcgctgctcaacttcactagagctggtagatttttgcgttgctcgtaaatttattgggcttttgaccatattgcaaacaaaccagattagcttacaattctcccctaaagttgtggtgttgcgtggccctttactagctgctgcagtgataaattttcttttggacgtgttcaagttgcaggacaatgtaaaactgctgattgaggctgatatgattttgtttataggcttctcattattgattcctgaagagtctggcataattaaattatgttagactactatatcattgctttgttgtactttctgacctgaccttgtatgtcatataatacttgagattactgtaactcttttgttttagccatgagggtgctgatgctatatttcaagaacctcgagttctttagtaagtataaatggaattattgatggaaggttaagagtggagagagaagtggttgttcctaaatagtcataatgcaacagaactaagaactaccttagaaaatgattttttttattgtgatatatccgataatcattgagcaggaatgtataaccaatgcaacttcaatatctgcaaacaaatcataccgatatcgttcagaaatggctatgttagagaggcaatatgcccgttattgaagcattactttgtggtaaggactgtatttttgcatgattagtttagtcaagaaacgactacttatttatgtactccctccgtcccaaaataactgaacctaggagtacatttgagacaattagttgcatgcgaaatgtgcatagtgttgaaaattttatggtgtactcatgaattacataagacgactgttcactactaaatctgtcatttttttttgccatctgttgttcttaggtaatattgccaactatatgagccttgcagaggttgattctatatatctttcagtacctgtaaacttcatctttataggatttgatggaaaaggaggtcacggtaagccgacaaactatccttatgcaatacttatgtcattctctatttcttatttgttcatacgaagtactaacaatatctttactttatttagagtttaaactgggacctgaagaactggaacgctggtttacaaaaatagatcacatatttgagcaaacaagaatacccccagttggcgaagttcttactccgttctacaagaccagtgttaagaaactaaagcaatatgaccttcctttaatcagccacataaatcacaagtacgttcctttacttctctgacaattgttcttacttggcccaatgttttcatctattttgtataaatatgccacacataattaaattttgcctttaatttacctcactttctgtgtggtgcagtttttccgtacatgcagtacacatgggtgaagatgtcatgtctgtttttcaacatgctataaaagttctatcccgtagagaagatatcacagattcaaggtcagatgctcttgagacacacatattgcttcaaacttaacaattattctcatccagcagtttgataaaatttggcaagtgcttcatcacataaaaaaactaagtgcaagtgtagcacaaaacagatatggtctttgcattcttttcctattacttggcaatgatgtttacaaaaaaatagatggttctgtttttagttttcacagatttctgcttgtttattactatctgttggaatccatacaagaggaacttgttaccatgcttgtaattgtttgtaaatttgtttgctttattgtaaaccagctaattaactatgaacagctactaggaggaccctttgtggtggcacttgttacttctataatgttaacttatgtttctcatcaatgtctgctgttggtaacagattcattttttgattatgttgtacagagaaggggcagaagcactttggcaggtggacagtgaccaaatggaacatttattttcaacacttgttgatcaccttcaaatacaagaggcatacaacatcttcatacttaatcccaaaaccattggcaagagtacccagtatggttatcggtgagtttgtcggcactgttaatacaatgcatataattaatgcaacaggagttagaaaaatgcacatttattatatttagcatggcaggatcatggactcgtaatataacaaaaacactacaggtcatttatggtagcttttgatagtaccaacatggctatgtttcattgcagtgctaccctgcatctgaatttcttcaagatattaatctagaacctattttgcactgctttttctaaaaaaagcccatctcattttgaatttagaatttgattttagaacaatttatgtgttttttttttttgcttttaaaaaaagcagtgccaagcggggcaataaattgaatggcaccaatgtagctagtcttaaatttatccattatcaatgttaaatcctttgctcaatataaatattgactaaggctccactaggtgctgaggtggattatgataatcctataacccaaatgaagatactgttgcattccacagaaatattgtgagaaacaacagctaaataacatattttgtctaatctaatctgatttctcaaaaataccacaacgattttctgatcagctcaagaaacaaacacatcatagtgcagtgcaccaattccaaacggtgtcatttacattcatggtctgttctctgttgattgttttatcacatggagatataatatgttctcaaattagacatgcgttttgatgggaacacctctgaggcacgtcacacaaacaaataaaaggagactcgtttttcttggctgaactgcctagaaatttagtttaatattagaacaaaaatggtgtcagttcttataaatatattttgtcgtgttgttgtatcatgcaaacgttacctctttctattcgatcctattttctgagtgtgagcttggagcaatttccataagtttaaatagcccgcaaatggagttctacaactagtcttatgaataattgtacagttttatttcttctgagaggaaataattcaaataattgtactgtaacactgttacttgataagtgatgttatggaattcatcaggtcaaatatccttggcctctattacatgtgaaattgtcaacaatggctgcatgaatatcagaaggacctctgtggtgttatatttgtatattccatatatattttacaatgtctacattactataaaacgagaacagtcaaatttgacctttgatattgttaaaattaccgaacattgcttattggaggatgaagttcctaagcacctatggtagctttcagctgaaaatgggtacatgtgcatcaaaataaagttatgtggtaacatgctaggcacatgcagaattatcctgtatacatagtaactcaaacattgcttaaaatggtggcatattgttactcttaggtgattttaataaccatctgtgtttacgtagtaagcaatcactttgttgttcatcagctaactgaattaattatttttcttccattttttttgatttgttcaatacagagtctgttggtaagatgagaaaaatctttgctgtagaaataaccactagtttgtacactgggttctggattgtttcatgcattttctcctgtgatgtttgattatttaagtgtaatttcaaagaaatcacctaactgtttttgtgttaattttttcatcttattttgtctatgttttcataggaaaggcttctctgagtctgagatcaacttactcagggaggtaagatgtggcatgctttatccattctgctatatatttaagaataccactgcttatatcttcttggtagcatagatgatagatctatttattgttgttgcaatttctggtaatatatctttggttggaagctggtggacctgctgataacaagagggcgccctcatatttttctttatacttatgcattttaaggagttattttcagttataactgtaattcactttatatttactgtcttcctttctgctctttccatttcgaagttgacatgaatacatgatgcttgactccagtttatcaggccttaaatatatgctgtgcagattatgttcttctgaatggatatgctgtgcagatttatgtttacctttctgtatatttccttagtaacattggatttgtttgttgagaaacactgtacttttgtggacaatgacatgttagtttttttttttcagaataagaccctgcaagctcggattcttcaatctaaaagtgacaagagactctatctgggtaattataatctttcctatgtatattattttggtttctaatttctattgcagtgaagatgaaaatacacatggagatagtctacttagttcatccagatattgccgtctgaagtttgtttatgtgtttgttaaaatgaaaagttattacttaagaatcaagaggtgcccctccataatattgtatacattatgaatattttggaaattttgacactgggtaaagtaggcccacataattaacagaactaatgatgtttacttaaaggttgttatggtattggttaagacgttcctttgcaatttccctagtttattgcttatttcggaaagtttaaactcgttactaatatatgtcactactatatttatctcccgcttagttccaggacttggcctaaatttccagaattgcaattagaagtgagcaattcacctgtttggatgtaataccagggactgcatgatgaagataaattttctgttgaaataaaataaccatgtgatataactatggtgatatttacaagaggaatttttagatttacatagtttaatattatggcaattggctgcagtttcaatagcagggggcagcggatgatgtatttttgtgggtgtatgccagagccgctaaagcaattagatcaaccgagtaactgacattggttattagtgatacattcctgccccctttaattattatatgctttatgcaaaggaagtgagagcacccatgggagcggataggttttggtgaaacatgggatctcttgaagctttctaagtttccattatcaattctcagtgaagcacacctgaacagccactgggattggcatagagttggatacgggaagaggtgttgcttgtgatccaaacatctgaattgtgttagatctatatgttgccgtatgtgtccacttcgagtagggtgttttctgcatattttcatgtagtgtgtgcagtgtgtgtatgctttgtgtattcacccattaggattcaagatctaattcctcaacgtgttgtcatgagcacatggtgggggttagtgtttccatcactttctccagccatcagtggcctctaccattggaaacctcaccgactggccagtctctgcaccttacatcagattgtagcgaggcgcagagccgtggcctggataacaaccggaattggtgaagaggtggcagctgatgaggggaaacactaaccccaatccatggctcatgatattgtgttgatgaattgaaccttgtattccaacgggtcatgggccaaagtataatacaacagggttgcaagcacatatgcacaaaacatgctgtactagaatataaatgcacagctatagatatagatatagatatagatatagcaaaaggggaaaaagattgcagccatctgtcatttgtccaatcatttacagtgcgcattagtgcatgtttagtgaatatatgtcgttattccacattacaaaacattctttggaagccctaggatgaactatttagggggcttaatcgatgtgcagtctgatttttgtgaactgtgcttccagttgagaaataatatgctgttattgaaatgtgtgtcgcgtgaacacaaggtagatccttttgcagtcacaacctccaacaaggacactgtttcaattcagttttttctctcactgtagctgtatgcacagttttgatatatttaactgcaagctcctttagttattttcctttcggtacttatctccatctctatgaatcagatattgaaaagggagtcaacagaagacccttgtatgagagtcatcctttatcatcattttcgtggacaacatctgacaatatggatatggtatttttaatgttacatttctgtattctttacaaaatcatttgggcctgcatcaacgtgttagtttttggtcattgtgttggccaatccaaacatttcatctgtgttcaaccttggccataactgacttagtggatgaagcttgaggctgcataacagtcaaccacaaagctaatcaaatattgacttgcttgctacttactccctccgtcccaaaataaatcaacttctagctacgaacctggatataggttatgtccagatttgtagccagaagttgatttattgtgaggcggagggagtagctaattagttcattagacggttacattgtttttccgtacatgcatgtattcagagttcttagacttttgatctagtgaattcaagaaagtgatatatactgcaactggtttatacaacttgccatgtattataaattgcacttgaattttagagttcaattttttggtttgaaggtctaaaaacaaatactttgttgccagtatagtatggaatagcaccaattttgacattgaactgcttggaattaggaactgcagtactgcacacatctttcttgacttcaaatactgacttttgttgacacttggaattaatgaatcaaaaaggatactgtattcccattggaattggttagaatgcatgatacgaagttatgaaggcaaacattcgtaaaaaaaattctaatgtataaaccaaacagaatgcatatattcaaattctttaacagggggattggtcaaagaagtgcaaggaagccttaagcaattttgagctgttgaaggaaggaaagagcaaagatgatattatttatgacaaagctgtccaggtgtcacattttccttggtacactaaatacactaaatgaaatatctctatatttgcatgtctaacatcatagtatcacacgctcttgtaggtattacatggcaaaaaggatgagttgcatgatatatttgagagtgcactcaagtccagtgatttgaagggtctgcatgctgaatgccttacagatatgtggattggcagagacaggtttgctgttgtttcatttcattaatagttaaaatcttagagttaggctagttcctgttcttctaaccaaactttattttcaggtttgctttcattgatctgagtgcagggccatttgcctggggccctgctgttggtggggacggtgttcgtactgaacttagtctacccaatgttgcaaagactgttggggctgttgcaggtcacttcatttttcttatcaggccttctctacctattcaaattcagttactgcctaatgttatacaatttggatggtgatgaactagggtgtatagtttgctgtgtcagtatatcttttgtttaaaaagtctcattagttttccttagtggcttgaacgaaactaattcatctctagaatcataagaagttttttagtagcccaggtcaaaagtgaagtttttgtaaatccttttttgactaaaatggttgtttcttgtgatggtttatgtcttctccctcattattcatgatgggacgctaccttagacaactcagtgtatgcatattggttttggaattagttttttgtagtagcaccaggcacttcaatctttcacctgtataattttatttattggcctaatttgcattttttttacttcttcaaatttaatactcattccatatgcacttggaatgcaaattcctagaacaaaaaagagaggacaatttagcattgatacaaagctagcatttttaatgggtcctgtgttgtgtcaatagattattcatggtaaccaaacatgggtagtcatgttattatattgactcattatactcaagcccgtttacattaatctaaattctatgctgatcgcacacaaaaagaaattgtatactcattatgtcattcaattatattatattaaggcattcttgctctacttgtttcaaacgtcataatttgttgattcaacaaacttgcagttatttttcttaaaatgttatgctcagttgcttcatagttcttaattgttaacgttgccatgaattaatgggatatggcaatcacattaaatgagcccatgccaatcttcttatgtttattgtaaacgaaaacctcataagttgtattcattacatcatgtttcaaattctgatagtcttatagaagtattgtcatcctgattattaatataagtgaaggacaatacctcaagaagacaacctatcaattgtgtggcagaatcatagttgttaaacctggactggtgatctaactgttgagtccatcagttcacctggtcagaccactggttcaccggttcggccactggttcaaaaggagataataaatatattttccttagagatttgctcaaaagggttaagtttaatctattttaccttccataccaaccaactgccttgcctggctgttttggtcctcgtgtatgcaacgagaggtccctagtttgatcccctccgcgcacctgtgggcaaattgtttagaaaatttgttctacccggtccaaagggcaaaaccgcctggtttaacccctttttccaggtcacatgctggtctttcaatcagaccagactggactaggctctggttccccttttttactgtcgaaccccggtccagtctggtttaataactaggggaagaatacatattcagactctgtaattattcagctaggaccaggccatctggtcatgttgtttgccctgttgttgctctgattataatcacaaggatccggtccttaattgaccggaacaagtcttgtatctttatcattacaaagcttttttattacaatttgaaatacttatacaaagatggtagtaaatgataaaaatcactgtaacttatccatcgcagatcttgttttattcataaaaacatcagtaacctacagatggattccactcacaaattggatttgtataagtcaaaagttacaggatcaaaaaagaaaagaaatattgaatacaccctgttaggttcctcagccatggctgtaaatacgactgttgatttatggtttgaacaatgcacatttacagcatgggatggtgggagggcagagggtttctcgagcatcggtaatgaggccaaattgctgtttaagctaaacaatgccctggactggttataggctcagtttggcattcagtgaattatcatattcttgtttggtgcaactactttagaagttttgttgtttggcaagcttgcttttcttttgatttaagttgcaaaagataatagtagtattactttccgaaaatgtggaacaaatgaagtgaacatgattgttgaataacatatgttctagccttatctagatcgccagaacaaactataatgattctaattttttattttccattgtatctggaggaataatcgcaacggagcacagcacaacaaccacaaactgggccttctgtatttctatgtgtactaacatatcaacgaatacttgattcatgtttttactacaatattttgggacttgctattttccttactgattcccaggcttccagcaaaccagtagggctagaaaccaaatgacctaattatctggaccagtatctggatgctgggctggcaaatcattgttttttcctttcaataattttctacatgcatacctgatacatatataacaccgaaacagtgctggttaaatgttaatatgtcaaagtaaacggtgacaagtagtattcatgaatgtatagagtagcatctgatactttagggtccaaacataacgttgtgtgggctgtgttgaccccttttggagaagcatggacaaaagctctggggatgcttcatgtgcatgagcatatcctacatgaggattagacacaagtgaatttgggtggtactagactgtctgtgtggggacatgtggatgtgggcctatgtggagcatgtagtgtggatttttgccatcacttatcttggtatgcagctttgacttttggggtggaacagggtgagtgtgactccatagtcaaattgctgggcggccagtggtggcttatatgacaccaagttagttccataatccatttatagtctggaatatggaacagttcataatgctggacagtccaaatgttgcaactgcatgttagcccttttggcagaggtggctgtccaagcatgttgctagctttttatgggctatgtgtgtaggctcatttctggaatatggaataattcataatggttgacagtccaaatattgcaactgcacgttagcccttttggcgaaagtggttgtccaagcatgttgctagtagctttttatgggatatgtgtgtaggctcattgctggtggggctaggctatatcagggctggcaagtgttgcaatttgacaatttatttctgtaacacttaacatgtatacaatgtgtttgctctgtactgagattctctttgcggcactaatttatgatagtcattcttatgcagaagttatagaagaagaggctgaagctaaattacaagatacaatcagagagagattctcatcttttggcgaggtatgctggatttctcttagaatgcactggatattattattttattcatttataaattattttttactactcaatctcataggctaaatgatggtacttattcttgtaatctccatgttaggcaccatagattttcaaggtgcacatgttgcttatgcaaattccttttctttctcttgcccctagctcttatttttgagggttgttgtaaagttcaattgagatcagtagagtgagagctttgagatcagaactgtagagaagagagggtgtagaaatattttggcagcttggaaatattttgctctgcattgtactcaatacatttttttgctagacctgttgacgattcaatatacaagtggtccataagtcattataactagcacgtcactggcaacgatattccacaacatagtggcatcccaagaccccactgatgttaatcactatagacaacaagtttcctcttgcaatcttgtttgctgtgtaactttcccttttgtttctgtatattgttatgacatcttgaactagctcttgacttgtttatctgatgccatttttggggttcagaattaccatgcagtagatatcctattggcagagattgatgtatacgaactttttgccttcaagcattgtgttggaagaagggtacagcttgccctttgcaaaggtacttttgatggccataaatttgggtgttccttttaattattcacattactacatagtggtagactttacttgtagttgatatttctaagttatatgcacttgagctactgtttgtaccatacatgaaagacattccttatgtttctctccaatcattacagcattcttcgctctttttttattgttttgtcctttgcccatgttttctcacaagttgtggatgccaataagctaataagtgttcttttctttgctgagatcttcagtttatggtagctgctggacagccttgtactgttcacgaatttgctttgctttatcagaaagaccttccctttaactagaaccttattttttcttcaaatgtagaacttgatgagagaatgcatgatctgaaaagtgaactggagggttacaatactggagattcggatgatattaataagaagaaagctcttgatgcattgaataggatggaaaagtggaacttatttaaagatgttccagaggttagctttgtccagcagcttctactacacaacataaaaggaacattgtaaaatcagtttctatagcaaaacattttccctaataagcaggataactaaaaacacatattcactgcgcatgcaattgctgaagtctaatatttatttgttaagttaacagaattttaatcatacttctaatgacgaagtccaatcacttgtgccaggaacatcatagttacactgtggctcgcgattcattcctcgcacaccttggttccgtgttatggggttctatgagtcatgtaattgctccttctgtttctcatagggctcaccattactatgataagttgtcgtttcaactgtactttgtgacacaagaggtaagttcaaggggcaacttttctgttgcttatattcgaatgcaatacagttatctcaacatgttttttaacgtaatgcagaaagtcaggaacatgaagcagtttcctgttaatgtaaaatcagtaacagagggccttagttctgtgttactacaattccagaagccaatgttcagtcaacgcatgtatgtaaccttcatcctgtaaattttggtttgtagtcctgcttaacttaccaggggtttaatattcatattggaagttatatgtgaaagtcatctgcacctggctagttttttattgtagcagtctgacttcctaattcctatcgtatgtctgcatgtccaatataatactggatcaaacttgtttagagcacaatattgatcataaaagtattagaaagattggaccacgccaatgatttgtatccatttagtgtttgattttttgatacttatgctgtgcactgagccactgaccctgtgggtaaatgacctaaagtctgtatggtggtggtcaatatggctatgattcacgaaggcagaaggaacagataatcacagtgcaggggatgggtgcatctgaaatcaggagagattagaactgagggagttcagatatcacttgaaagctgtaccctttataggccctaataaacaatatctaatacatggaaatcaactggcaagtcttatgtctaagtggctcaagtccaaagcaaggagctaacacgaaactcgaaactcactgttgctgagctgttgccttcgacaccctggccacatgagcgaccgcagacaactcagttctctacccaaacaagccaatgggcggtggattgggattgtaattctttggtttcgtttggaagatgaaaacagttacttagtatgctttctattagtgactggtctaatcatgtaaagtgctctatcttccatgattataattcttgtagaattttaggagtgacctaagcaaaattacttgcatattcaataaacatgtgtgcgtgagtagtttgtattcaataagccctagtctatcttgaataatttcataaaggcttatagatgtaagctaaggacaattctatctattggatgaatgatactttatttctgttcgacatatacaagttactcatatacacactacaagttattttgtataagttgtctgatggatttgttctatcagtcttttaccaacattactagtaattcttacattgcaaagttgcaagttgttatggatacccttacaggttgctaactaatttattaatcatatgtacttagttcagttagttacaaatcaatcatctgcagtggcggagccaggatttagacttgggattgggatgggcctatgagtcttggacggggcctaatacactattacttaagttaattacctaattagttaggtgattatgtgtgaaaagaaatcgttgtagggggccaggccactggccgtcccccctgtctctgacatggatcttctgtgcatagaatttagttgcgtcatttaatttagtagaaccttgtaagcttattatagagtgcaatacctagaagggagttaaatgtacttacaagatatattatatcctctataaactaaatatgtaattattttttccagtctaatttgttatggttgttgatatataggttgtcattatcagaggatcctgccttgatgatggcattttcaatggcacgtcgtgcagctgcagtcccacttctgttggttaatggtacctataagtcaactgtccatacatatcttgattctgccattctccaacatcagctacagaggttaagcgagcacaactcgctcaaaggtatgcacattttagtcgcctgggagaggctcaattagcgagtcatcttagttgcctgggagatttggaaacatagaaatgattgtgttttccatggagctacccctagtgtgtctgtggtaaatccaagctgtagttaacgagggtgcactttggtgctgggcaggagattcaaagctccaagagctgtttgctaaagcaatagctcctgtaccttaagcatgtgtttggtttggggaccaagtgggatgggttagacctatcctagtttttttgggatgggatggttccagttgtttgttttgtttatggtatgggatggttctagtattttgtttggtagaagggattgaggtgggatgggatggacaactttgcattgaccgttagtgccgtctggctcccagcggctggggtgcagtgagcggcgagcgtgggggcggaggagctcatcgccgcgagtggcacacaggcaaaagagtggtggctagaggcaagggagtcgacggcgttcgtggaggtggcggcctgtcacagcggaggagaggccgcggtgtcttggagaagcgctggcgctcacggagttggcgactggcgcagacgagcgccagcggatgaagaggcgagctgatgtcgtgtgcttcgtccaggttggacgagctcgtccggccgattttgcttgatggcttggtcccggatctgagaggaatattcctctccagggagtccctaaaccaacccaactcactcatccctaaaccaaacactcctaaaaatggcaccatcccatcccatccttgcaaccaaacacatcctaggaagtcgaagttcgtgtttggtgttgtgtgtgcgtgcgtacatgtgtgtgtgtgtgtgtgtgtgtgttttttgtgttttgtaagaccttggtgggtgggtgctggggttggctaattccttcacctctcgcctcttttttttcctgcttaattaaacgatacgcaaatctcattcgtattcgtaaaaaaaggtgtacacattttctttgcttttcatgatataggaacagaagacatcaagttctgcatagtagaagatgctaaatcatatgacattacaatttatggaccaatgaacataaaatgctaaatattttgtattgaacataattttaatgctataaaaattccaataagaatcatgatttttgtacactcaacattatacagactggcaaaaatctgatatcagatttatcctatttgtcaggatctatacaacacaaattgtgcatctattccatgatgaatagttttgattgtttttttttattgagaatggaaatttgatggtttgtacctttatatgtactatgatcatgatttgtttttgaacgttcgaatcacttaaaacgtggtgaatttgactgaagacacaggtaccctaggacagaaaaactgcattctttatgagcaactagtgacatgcccgtgccttcaacgggatgttaaggaacaaggacgaatgcctgtgcttagcaacgggatgatggttttacggggttaagtttttcctatccagttcttttagttggtcgtaaaaacacaggattttggtggggtggttttttgaggtagggtggttttcttacgtggaggaagaggtggtttttgggtggagtgtttttttgaggcagggtggtctttttacatggggggagccagagaggacaactctttttttacagtagagagattatgaacaaaaaatatgtgcaaggaggccaagattttacagtagagggttgaatgatattgatcgaggctaaaatggcagtggggaagttcatgggtcatggctgagctgtttaatctattattgctaaatattacctatattgtgtatttgttatttgttgatatcagtaggcctgcaaacacaaacctttgacagctactttctagtgcaaaagtgttaacaatataatcagttgaaatttgatggcatgttactaatgccatttctgtgtgacagtataacattacatttacttaggtacgttagtggttaatatcgtgagcaagtttgtaagctagatttctcttctatatgcaggaggacactcaaatcacaggtcaacattggagattccaatattctggttcatacatagtgaacccctattattggataaacattatcaagccaaatctctttcaaacatggttgtagtagttcaatcagaagttgattcttgggaaagccacttgcagtgcaatgggaggtcaatcttatgggatttgaggtaggattgccatatcatacacatgatttatttggtttccagttggttaccttcgcaatctattatacagtcttgtctttcatgtaccaaattgtaaccattcttgattttagaaaaaaagaaacactgggctcgatcacaggccaactttaaattgaaatttaatgttttgaaaatttatgttcatccgtttgaaaatggaccagaatctgacatgttcaactgaagcggtgaccatatttagggttcattcagtttatgcacacatgtggacccctcatagttagttgcgataacctgactttggcccagtccttttcaaatttactggattgttgaaacagattattggctctactcttcgaaaaatacattttctcagaaaacttttttctactatattgcttagaccacttattttaagttcctttttaagtttatttatcaaaatattttatttatctctataatcaagtagataatctgcagcaacaatctgctcaataatctgattcaaactgagccttgagcattgtcgagcagtgagaataaggctacataatttaatgaacacaagttaagaaaaaaatggtggctagaccagtttaacttgggcattccaaacctgaagaagagaacgcttagaccacttgtttggtactttgtttcattagcatcggtcaaccttttgacatcaacaccacaccagtttaatcacaagattgtacagagccaacttgctgcagaatgtggccatgccaatatttgggctttggcaggtcttaatatccatcctcaaaaactaccttttttcctcctgattttgagtttgattgaactgcattaatgctattaataaactgacttgcaggagaccagtaaaagctgccattgctgcaactgccgagtatgtatctggtttacttccttcacatctggcttatagcccagctcatgaaactgcaacagaggtttgtcatacgactatacctattagtcttcctatttgttaactgatgggcaggatatgtttcttttctggaaccagataaaattatcaatatttttacattttttcatttgcccttcgcaaaagaaagcatgcagtcaaatttctatattttttttaccagtatatatgaaagactttaacacttatcatgtggtatacttagatatgctgtactgtagattttcttcaacatgttcatataaaacttagtgatcaaagttatattttggagattctgccgatgtacagaaaactgcagtcttaaacagattgagtgatagtttagtctgctactcattacattttctgttttctaataattctaggactggacttggtctgtgggctgtaatcccttatctattacttcaaaaggctggcaactttcggagtttcaacgtgatgttattgctcgtaactacatcattactgcagtggaggaatctatacaaatcatcaattcagcaattcaacaattgattacagaaaggacaagtatcctaataattttgctttttttaatctaatacgctcgagagctgcatatcatttcattaaagaagagaaccgtatgagtctggaaaccttacaaaaaaatagcaacaaacaattgcgccacggactattttgctggacaaaactaagaacaaaattttgctgtttcattattcaaattccggacaatttaatgtttgttgggaatcatgttgttttttttgaaaaagataacagagatggatcaactttatgtatgtgtcatgtttccatgtgaactagctgaatctttgaagagcatgacttttacactagttgatttttacattccaaaatttttactatgtaaagacatcagctagtagataattaaaatgacccctatgtcgatagtcctccgactggtatttatagtgtaggttgtgggttgaacctcaaccaagaacaggttaatgtcttctgtaaaaagttgggttttaccattaagtagatgaaagccacaagcctattagttcatttgtattgcttgctctcaaaacttttcttgaagggccttaacaatatttaggtgaacgaggctttaaacttttcaaggctcaggagagagtgctggttgaaaagtataattctgttgttagcttgtggagaagggtaagtcgcttcttgatgtgcctttttttttcctttgttttacataaaaatattatggcacttatgtttggtttgtatttaggtttctgctatgtccaaaggattacgatatggtgatgctgtaaagcttacttcaatgctcgaggaggcttctcatgggtcagtggttcttatgctgcgtacaggaaccttttttttttcttgcaatccattttatttcttgaccttgagattttttttaaagcgccgaataaaaatatgaagggattatagcttaatgttctacttctgtttatttattattcatttgatgaatgggccaatatcctcaactacaataccagcctcattagttgtctggtattctggattctcatgttgctttctctttccagatttgctaatgctgttaactcaaccatttcaagtctacaccctgtgcaatgtactcgtgaaagaaaagtcgacgtgcagctagacttgacaacgattcctgctttcttggctgtttttctgctgctctggtttcttctacgaccaaggcggccaaagcccaagatcaactaaaccagctaattttcagtgtggctgttgtatgctaataccgaggacgtgaatattgtgaatatgcacacatgtcatgggggacagctgctgctggagcgcagtaagtcctagattcaaaggggaaatgacaaggccgtaaacgacttgtgccaaacggtgtcactgtttagagaaaatagaactgaaattttgtttccgaaactggtgcaaggtttgaagttgccacatcctgagcagacttgtgtagtgcattgttggacttgttctggatggacgttgatatgaatctagttgagtaagcactgtagagttgtagactgagccgcttactgtgtagagaactcaatactgtttttgttttccagagaacagcgggagaacatccctaccaatcttgtcaattgactcaattctattttggtttggttcttgagacggaacatttcggatgtgggtccaatcgctgacacattaacctggactcgcatatcagcgtcagccactaaggctgagttcggatgggggagatgggaacccaacttctgtgtacgaaaaacggagcagtccattaacgcgtgattaattaaatattagctattttttttaaaaaaagggattaatttgatttttttaagtaacttttgtatagaaacttttttaaaaaaatgcaccgtttaacagtttgaaaagcgtgcacgtggaaaacgaggggaaggggatgggaaaaggtgcatgcgaacacagcctaaaccagcagtactgcatacctgtcgagcattaacaaacaatccgtgggttaatagaataatatgaatctattagagcaaggtcaatagtaggtcaatagtatagctgtatagccagttaatggctccaaaaaatttcatgtcacctagagccatagctagacacatgatacaataaaaagctgcagtgatttctgaatattactttccattttatttattgcattgcatgttcttcatttgcatatagcaaggccaactgctcatctatttgctagctagggctgtttggatcagggactaaaattttagtccctgtcacatcggatatttgacactaattagaagtattaaatatagactaatgacaaaaccaatttcacaaacctggactaattcgcgagatgaatctattaagtctaattaatccataattagtttatgtgatactacagtaaacatgtgctaattatgtattaattaggcttaaaaaatttgtctcgtggttagctctcatttatgcaattagttttattattagtttacgtttaatacttctaattagtgtccaaacatctgatgtgacagggatttagtccctatatccaaacaccacctagtcgctagctgaatctctctctctctcttcaacttttgctttcaacttagttttttaagccacggaggacagctatcgccggcttgaagcatctattgcacctgctcttgttatatagaattccctccagttattaatatatacatttttacactaaaattagtgttaaaaggtaatatattaatgaccaaatggagtaccttattgaatttcatttgtaatcatgtttaaaaaatataagaattcataacagatatagtttaaggcttttaaaagtccacatatagcttaatatacaaaagggataaatctacttgacccctaactactgtgtttagaaacaaccctcaactctaaaattgggtattgaacatgtctcaactcttaaaattgattaatttgcccccttgttgttggagcccaccctctcagcgaatgttatcttcccccttgttgattaattgagcagtactgccactctacactcttttctcttctcctcctaataccactaggcatcgggctagatgtggtggcaatggttgtcatcattgcgccatcagatgtcagctcgatgaggcgccacaacccttggcgctaagacgttagacctcaacgccaagattcgtggctgaagttaaggtccatttctctttagtgtttttatggtctatttgtgaaacaagttttataaaagggctaaagtgttaaatttcacaagtgaagtaatgagcacaacttcggccttgtttaaagctaagacaaatcaagattaagtgcgggtacgcaaaataagacaagtcgttagtgcatgattaattgagttttaattattttaaacttgaaaaatggatttatcctattttttaaagcaatttatgtaaagaaagtttccgcatgaaacacctttcatcaataaaccaaagatagaatctgcatagtaataaaaaaaaacaatttggttcttgggggcaagttcaggtgacccacaggtctcttttccatcccatcccgaagccctagaaattgtcaagccccaagggacataagagcaagtttaatagtatagtcaactactggctccaaatcatacaatagctacctataaatatatactacacaattaatacctggtcccacctagcatacacacatgcatcttggagtccgtgctccagcttctctctcctcttttatcatctcaaaatgtgtttatagttggcttatagcctgctattgtacctgttctaagagcttacatagtgtggggatgtggggaatggtattgcctcaccatgttggatccacgtctccacattagtcaaggttgtgcacctgcagagccacgcgtgtcttctgtgggggcacgagcaccttatcaggcagaggctgctagcgcatggaggcacgaaacaagccatgttgagtgaggccgcgcctcacggcacggtgcttcatccttcccccaccaccccacccctagcacagagcacccaacaaatagctgatgtagttggaaaaggaggggaaaatgagcacaacgtgggggtagaagcgaacttaccgcaacagtgcgtgaagctgatcaacacgaacccgttaacgacgaccaaattcgcgtcaacagaaccgtccccgacccaccactctgccgccggggttgccgctatcaggtcctcgcaccaagcagatccgtcatgtcgccatcaccacaagcggatccaccactgggcattggcatcaaataggaagggcttcacccatttcttaaggggtgatagcctcaaagctcgttgactgtgctgccttgatatgtgccaccttgtaggttaggtgcatgatatgaaataaaatagggtaattagacatgtaccgtgtattctaggaataaaaaaaagtaaattacatattaattgagtaataataagaattgtgacttgaacactcctctaaacccgaggaagatagtggcgttgtggcaatgcccaaagttttcatgtcccgtgatgaccaaacaattgtccaattgattggcacgctctgaccctgatcaattgatcgatgccataacctatgttgtgaatatattctctctgggcaaatgcagttcggtgaacaacgaatactgtagcccacccatgggcgcgggtctcctaggaaagtgggctgtctcgctgctgtagcaggcaggcaaacctggccgtggagagcaacatgatccccatgacccttttacagcttgcaggttggtgaggttacaacttgcggagctgctcgttggatggtgcattgatcgaatgcctgccattcttgttgtggcctcaattagaatttggcatgtgtgactcatgagagctatgtgcacatgtttagtaccgccttgctggtttagcaagggtggaaccaacttaaaaggcctcacatccctccaatcaaaccactcctgggttaacccttttacacgaaacgagaacataagtgtaagtgggatggtatgtgtaaatgggcccgctagttggatggcctagttacgcggttttggagggagggttgttacagggcacctcccctgcgtgatcccgaaccccatggccacctccgtgatgcttggcaccaggttaggtgatcaaatcaaaatggagccatgcattgataaatagcccagtgtcatagcattgccatctcggcgaccaaatgtggataaatcagcgaaacgaacgggtggcgccacgcgcggctgagtctcttgaggaggttagaacgttcgtcccttcatatttgtcggagggcggactcctcgagcgggggaccgtgggaccccctttccggttcggaccggggacacgggtgaaggatcgagatccaatgagggaatgagagggggtcaggcccctcgggagcgatgggagatgcagagggtttagacaggtttgggccgctatgggagcgtaacaccctacttctgtgtatagttgatttcgttgggagaatacaagtgctttatgcttattttgggatttgtcctctctccactggggcatggacctctttttatatcttaaggggttactacaaaggtccaagccctagcttcaacggcaaggaaaacattctttacaggcaattaatacttatcctgtcttccgacgtgcggagccacgcgcgccttaccatagcatggacccttcccatcacgccgagtgacacgggcgcacacccgtgtcattccttcttaattaacgacgacttccgcccgtcagttcccaccggtcggcggtgatctcttcgaagggatcagtataaggggatttggtctgggttcaaatgagaggcaaaaagcccctcattaatggcgattagacggagcgtggcgcagaccacgctacctaacagcagcaggcgcacgcgcagggcgccttacccgccgtcacatcaatcattccggcttcaattggtagtgcgcctgcacgtcacatttaatgcaacgtgccgcgcttactattgacggtcgttatcgatcagttttgaccgtcaatattaccaaaatagaggagaactagtgatgcttgcaatgcataaatatgttagaataataatattccactagtagtaggtatactaatattttgcagagaatgacactaaagtggaggagaatcgacatcaacatagaagataaatcaatcggacgatgtcgagaatcagagttatgaatgaatgggccaagaacgcagaattgacacgatgaattatgccaaaattcacaagtctacgaagtgaagcagcggaggaggccaccagccaaaatgtgggctggttgggccgactcttg

SEQ ID NO: 15117 - DNA, 15661 bp, Oryza sativa
  unsure (1)..(15661): unsure at all n locations
ccgaacctatgccagcgccgatggatgcagggttttgagggaatggtggagattcactccctatggcgattggagggtattaccgacctttccaaccgccataaccgtcattacctgcctatttaaggagttcactctcttcacttcaacacacacctcaagcaatagctctctcatttctctcaagtttagtttagtagtatctagctggtggaataggaatagagtagaaatcaggagtccggaagtcttcggaagagttcgggtatggctctagtagctttcctttcctcttttgtaagctttgtacttttatgttcttctaaatacatttatggtattgaaatactttctgagtatatgagtatctactttacattatgttcatgttatactaaatatacggctagcttatctgggagatactttggtgtgggtataatgtttgcttatgcaattactctatgtcatgatgatgatattagagtagtatctggtagtttaggcgcggtgtctagattacgggatatcattatttgttatatattgcagatgagaggtgggccgctgatggtgacagctcagtacgggtattcctccgcgccggtatataatcctaagttaatttcctggggagggtattcctccgtatttagccctggttgtatggttatgacgggctgtcgtaaggaactcggcagtcaggggtggcttctcgaagtaccaggagggcatcggatagagggtattagctagtatagcagttaactagaatgtatgtatactatgcatattagaagtataggaatagattttctttctcttttctttccacctagctaagataatatattatgagaatgagtagtaatgcttgtgtgtcattctaccattggattatcttaacccctacttagaatatgattatcacaagtaatatataaattattagtcaagctctctctacatgattttcccacgggataaaataaatacgatatccttggaatactctcgggtgaaatgctacaatggtataaccgtgtgcttgcggatgaactctgtaaccataatataccaggagtatttctgcgccattgctgggaattatatttctagtaatgtcgttaaaaaataccaacacttactgttctcaataaacgtagtgggtgggcgctgggagtgtccgcccaaaccacacacgtgtggcggtgcgtggagggggttgaggcggcctgacccctttcgtgagggatagccagcataccagccccggtgcgacccccccccccaaaacccccgggtcgaaaagcgccatgtgggcttgaggcagacttttccctttgtatgtagtacctcaggcccatatcaccgataatattgatctgccgatttgtctcgtgcatatcaaagtaatatatgttggttgctaaaaggcctcgcacatgagaatgagaatgtaagttaaaaatcctcgcgcatgagaatataagtttaaggaataaagatcaagtgcagaaatagactgtgtcgcatcgcatggcggaagcaagatgaactggaaccgaacacgaagaggggagcgtgcacacggacagaccaacgacgtggggttggaagcagatgagcactgagtcgcacgcgtcgctttcggacgatggatgatcacgatgtgatggacggaaaattatcaattttttaagtagtttagattagattaaaaaaggaaaagaaattagagaaaaactctaatcaataatgcttaattcttcttaagttcttaaaaaaagagagaaactctttccagttttgaaaatagaaaaaaaatagggcaactgcaaattaaccactgttttaaatcattattgcaagactaccactagaaaattacaaaataacactagaactgtcattaagtggcatccttgcaaaattaaaaaaaccggtagtaaatttgcaaatgccaaaaaaaaaatacgatcaacgtatcacttgctgccttcttggaattgccttctgcgaaacaaaagcgaaaaaaaaaatcaataggtacatgttaaagttatatgtgggattgtgggtgccagtggtgcggccagggctgttgtattcgcgagcgaacatatgtttgacctgaacgtagagtcggctccacggcggcgcatgaagcaccaacaacggtccaacggatggatgaaaaactaaatgtgacgatttaaaaaatctttttttaaagtaggttagatagatgtactaagagcagttttatattggatgtgaagacacctctaattttatccacatcatcaactaattaattaagagatagtatatacaataaattacctctaacatacttactccaatacaccatattaattttactatatttatttcctatcaatttattgacctcttgctcttatctctcctgaagtttatatagaggctgccaattgtatgagatgtggttccttctctctttatttctctcatccacctcatcatatgaatttatatgatactcctagagtagtaactaggacttaattaatgagtttttatttcgtgtgcactggaaatttctttgtaagatgactgaatggatgcggccttattaacgattaaaatgcaatttatgaataaaagttttatatacatattcttaatgatttggaagtaaatgttaaaaaagcaaactatgatgagaaagtcctaaaatttacttaaatttaagtctaaaactaaaattttggttatgcttgaaggctgtacaacggggatagctaatcctctatcctcttcggaaaaaaaaaagaaagtatatgtgactttttatagtacaataaatttggacatacagtgtggccccaccaccaccttcctatccactcttccatcgtggggtagcgtagtactactactccctgcgtccccaaaatattactctctctatctatcattttgatagctatatttttaaattaagaaaattatttaataggcatatttcaatctaaccgtctatcatcttaataactttctcggatttaatgagaaagtaatctcatagcttctaatttctcatatactttatagcaacaaaattataaccatttgaaagtaaatttaattctcaatctaatgatatattttttaacaaataaaattcatttcatattataagtattggccagatgttttaaagattgaatcttaaaatacaagcacgtcttatattatgggatcgagggagtagtaacctagtagagctagatggaaatcacctaatcctaacctagtagagctagattaaacatcacctaatcctatgtgcatactctctcagtaaaagaaaaactctatctgtaaaaaaaagatgggacaatgaatttggactatcctttcattgttctgggagatctcctcctaggttgagttttttttatagagagagagtataaatctagatattggattatcttcatcctaaaatataataaattttagctataaatataaataaagagagtaatacccatctacttttagattattgtattcttgtcatagactgaggaagtactccctccgtcccagtgtataagccagatccatctaaaatctcttactccctccgccatataatataaaagattttggatggatgtgacatattctaggataataaatatgtcgtactagatgtttatattatctaaacttatactccctccatcccataatagaagggattttgagtttttgcttgcactgtttgaccacttgtcttatttaaaaaatttatgcaaatataaaaaccggtaagttgtgtttaaggtactttggataatagagtaagtaaaaaaaaataaataataattctaatttttttttaataagatgagtggtcaaacactacaaacaaaaacttaaaatcctttatattacaagacgaagggagtagtatattttaggacggacagagtagcagtaagagcaaggtaaatagtgtagcccactactagctctaaatcgtctatagccaatataatagccaattcatacaatagttgtttactatactattaatacctgatcccacctgtcatacatacactacgtcttgaagtccgtgctagagctggctacaaatctatagcctgctgctcttctctctcctcatttatctttttaaaatatgtttacagctggtttataacctgctatttcacttgctctaacaatagaggagtagcacacgccagtgcatcgccaccgatgtgacccatcaatgcttacgcctgcccgattcccacgccacgtctcgtccatctgaccaaccctgtagtactccacgtctctatggcgtgtctctagttctataccctcctctgcggctgccacgtgggccccacaccacgagcggcgcgcctaggccgcctagctatactactactcctagtcctactacaaagcagagcactgagcacgccgtcgcggctcaagcttagctagtactactccagtagtaactgccgcttccctttccccgttcgccgcatggcaccggccgccggtgagcccagtgcagccgcgggcggcggggagggagacaccgaggcgcatgcggtgatcgacgtcagcagcagcgaaaccgactccgaccccgaccccggcttcggcggcgccgggaagaggccgcggcgtgtggtggcaacggctggcagtggccgggaggcggagaagagggctaggattctggccgccgccgttccaccgggattcctcgatccgctaccgcggccttctgcccctcctcctcctcctcctcctccgcgcgggaggaggagggtgacgaggcagttctggaatgccggggactacgacggcaagccggacctgctcggcggcgacccttcgctgcgatccggtaccgaacagattctcgaagcttctactattaccctaatactaccttcgccgatgttgctatgcttccaatggatagaaacggagagtattgttgcagcttgcataaatcgactacttgcttcttcaatgttcatgcaaaagtactgcatcaagttacatttaacccattgtcaatcccagccccaatatagcgctgtgctactgctagagagtagagaattagattatggtggtggtaaaagctggaaaaaaacatgcatggatggactagcttttcagggatatattctgctttctgcacaaagttctaatcttggtctatactctctagttcttttcacaacgtaccttgatgctctgtttctgttgcatgttcttctgtgtgggagtcaactttgtttcaagacagtatgctgttacaaccagtgttgtggatgacggaatacggatgtcggacggagagggtaccgtcaacgattaatcggaatacggacgattaatcggaatttggcggaaatttaacgttttgtgcaaatatgtgtacatagctgataaatagcttgttttttgacagataattgcgtataagtacatatattgactatatacatactattttcaaataaaacaagcatagcataaagtgtaggtctgaacattcatagtggtacaccaaatactgataggtttggtttgcaatgcataaaggaaatattaaaagcatgccatacggtatcaacaacactaaattaatcccaagtaacatatcgattactcggaagaatcgtaattacgcctggttagttggctgattagtcggaaacggtcgtttttttagtcgctaatgacggcaattatgcatactggaacgatcaacaaccaccgtttcatcaaaatgtgacggagatgttagcgtcaccgtactaacgtccgtatatacggccgtatcaaccgttatccataacactggttacaacaccggatacattgctttttctgcttatagctgagatacatttgttgttgctcactgagattttccggttgtcagattcgggaatggaccacattcgcgtccatccaagatttctacactcaaatgcaacgagccacaagtgggcactggggggtacggtctatttttcccatttcaattatctactaccgaatatatgcccatgcatgcagccgaccataagttcgctaacgttggcagcaacaactttgttaatgtatgctctttactaacatgtgcagctttcgcggagcttcttgacaactctctggacgaagtacgacttgactgaaaatagaacattgtttttgtttactgtgtcggttcctcttgcttactcaggcagagcatttctttaaaaggttgcgaatggagctacttatgtgaacattgacatgttggagaataagaaagatggaactcgaatggtgtctgtggaaggtgagaaactatcttgctttgcatgcatgggtgtttagatttatttgacacaaggcatcagttttcgccaaacctctgttgtgaatcaaatccatcttctacattgcttaaaactgtatctatttcatacccccaaggttgaaattgatactccctctcatcccaaatgtaggtcttttttgaacctggacacaataattaagaaaacaatcaaatgactttgttgctcttcatttatattgcattgggaaagttgaatcgctttatttgcgagagatatcatctaggagtatttaccaagggcaaacaaggaggcatagttgaaaagttgagtagtatttagtaaagagttgagaaggctagaacgactagggttgttcatgttccattttccaaacccctggtttaacatgccacatgtgacaatattgagaattgaatgccaaatttcagttcatactaaaccctattgcatgttacattctagaattggttttgctgtccacagttctaatgaaatcgtgttattttagatgcttgtaaatgtgtatatcatacctgaggtttcattctaaattgattcatagatgatggtggtgggatggacccagataaaatgtggcattgtatgtctttgggttattcagcaaagagcaaggtgaaagataccattggacaatgtaagttttggtaggataattatttagccatttagccatttagccatataaataattgatctgaatccacatgcttttgtatctctatcaaatgttgtattttaatttgctcaactcactcatcagatggaaatggtttcaagacaagtacaatgcgactcggtgctgatgtattagtcttatcacgtagttgtggtaatggcggaagaaggttatcttctgttaccttgaatacttcaagatatgtgttattctgattttttttctaccattttccatattatcactcctccattcaaaaccaaagcatgtttctgaatatgtcaactcaagctttcctagcttgacaactaatagaagcaaaagtactttgacaacataaagttttttatggttttaggcagcataataatatactttttttcttgtggcaaatattaatatggatggtatagttctaagctcaggatctaccagagagtgcaaaactttgtttggcaaaatcctgaatgtaaagtcagcaacatttctaactgtcgcgtcttcccattgcatccatctgcgtcttcccattgcatccatcttcaggatgatggtcgcaggttttcacttttcaatgtcaccaaaccaatttttctttaaagtaatgtgtctcaatatttcatcatcatcttggccaagtgatatataattatctgactgtcgaggttagaacatggcaagttctttctattcactgagtacaattccagtaaatatttcctgataatgtgtaaacagtaggttcctgtcccattgtgtgaacacattttaatcttgaccaaattatgtctcgtatattttgttccacatggacaagatgctgatccttttccctcatgacctggttggcataaaaggcgcacacaaagtattggcatgctatcttacacattcctgagagagaccaggaaagatgatattattgttccaatggtaagctcaatttcatcttgtgttgttgtatcaattttaccattttacagactggttcctttgacatcagttaagttagctgattgaatcaaaactctgcaattttagttaatgtcttcctttattcgttttaaccacagcatgcatgatgtttgtataccttgcagattgattatgaaaagggacaacaatattggaaaaggatgatgaggacaacatcgattgactggcagacaagcttagcaacgataatagaatggtccccttattccagtgaagcagaacttcttcaagaggtttatgttatgttatgttgtatttatattatattattttattggttctaaatgcggatatagctgtgttttgaatgtgttcggaatagcttgttcattgtttgcagaataaaggaaagggcacagctttgcaaacaaaaacatacattaccaatgtagtaaaaccaagttactgttagattacgcgacacattgttgaacctggcatatcataaaaataaagtactgatcgttgttgctgatgtctcttcttttcttggcttagttccttaaatgattttttttctctgtactttgttaccgttgtcctcatcttcttttctgtgtgtctaatggctttataatagtacagtttagctcaatcaaggaacaagggactcggattattatatacaatctatgggagaatgaacagggagagttggagcttgattttgatactgatgtaaatgtgagtgccaactaataattaatgaagtcatatagccagcaacagaaaatgtggttaaatatgaaatttagtgatgtttgagatggcaggatattcaaattagaggtggtaaccgagatcagaaaaatatccagctggcaaagcagtttccaaactccagacatttttttacatatagacattcactgcaggtaggttccagatttactttgtctgtttgtgccaaagcaatgctctgaatgcttttttttttcttttttcctgaggaggcctctgcagttaatgtatcaaaagaaaaaggaaattttagtttcaaagagaaaaacaaaaaaatcatggtaaaaagagagagaagaaattacagggaagacaacaaaaaaagagccctctactctgaatcataattgatattaggaataccatttaatgttggatggctacttattttcttagagaacatgcaaaggcactgcatatcattttattaaggcagacttagaaatgataacaaggcttggttgattgtagtgctatttgctaatccactaattctatggtgaattttctgcagtagaaaagacagtagtaagcatatgagccataaatagttcattggaaaatttagcacacttacataaattgtgcagaggatatatgtcaacctgatgttacttcctttctgcagagctatgcatcgattttgtatcttcgagttccatctgtattccaaatgattttacgaggcaaagagattgaacatcataatattattggtgacatgatgatgaagaatcatgttatttacaaaccagtgatgactgatggatttccgagggatatcgatgtaaagattacaagttctgtacccatcgtttcttgtatagtgatgatcccttaacatattttgtgcatggttcctcatctttgcatgctagatgatgactgatgttacaattggttttgttaaagatgcaaaacatcatattcccattcaaggatttaatgtttaccacaagaaccgcttgataaaggtattcatttagttatgccacatatatattcttatgatgatgaaaataaatacatttttatttctagcttctaaaatgactgcacatccatataccaattttacaattaatggaaagtaaatagatttgggatttgcacatttatgttctatgttaaatttctctgtaactcttatgttttaagctgatctatttttggagtaaaatgcaccataggtccatatggtcctgttgtcaattgggcatcgcacttgggttcttcaagttgcgggcatgtcgctttggttcctacttgcaagctgcacatataggtctgtaattttgtaaagcagtgtcaaaaaaggtcaaaaaccttcggtagttaaagatgatatgataacttagctcaatctaaaccacaatgtgaccatgctatcacctttttttagataatggaagatgagggatacatctctggtggtctggcctatgcagaatgcacccagccaatgtttcaccatttgaagtcattgggaaactaatatttttttgtttgaataataaagtttgtttctgcgtgccgttgattttcgatgcttctaattgatggtagttggcaatagcattgtcatattttagcttaaataggattgaggtgccacatttccaattaagctcagtgtcagcttctattggtacacctacacatctaaggatctagatgtgcaatcatcacgttgaggataaatgataacgtgcccacacaagtttatggacttatcgcacaccttatttctcttattacgcttggtaatcaactgaatatttcttgttctaagcatggccatcagcctgtcttaggtgattataacagtcaggatacgagtctcatcagaagtatatatgtttttttagcctttctggagagtgtgggctctacctggaattcaagggcgtggtgttataggtaagaaatccttctataagcccctttggcacaacttcttcatgtgtggaaagctgatactggaagaagctggtgacagacagcttctccttcatagccgtaagttgctgcagaatcagattctgtcaaacagcgacacttcaacttcttagtggagaagctgatgtagaaattgtgcctaaggggtctgtaggtcccttcttcagaccatgtgtaatcattataacttgcaggtgtacttgaagtcaactttgtagaaccagctcatgataagcaggactttgaacgcacaaatagccttgcaagactcgaagcacgattaaatttaatgcagaagaaatactggtttgtcatgtcgttttgcattgtccatttgttgtctgtaggcataccagttctttgaagaattctaattagagtctaattaccatggaaaacacttacttctgtttcaggtctgataattgccatcgaataggttatggtggcaattctgctaacagaaaatctgggagagaatataaaggtaggtagtgacgcagggctccctgcttgctttatttggattacttggtttggttaatagcttaatatttgtatttttttttcaactacatagtacaaaacaagataaaccaaattggtttggaactttagatagccctgaacgcatgcatgcatacctttgaacctagcaaccttagttctttcttttctttgcgttttctttttggcagaggttttcttttacacagtttttctgcataacctgtgctaacaactgagaattttttttttgtttcattctaaggacatactattatatgttgattcaaacaaatacactggcatgcatgtcagttggcaacttcccttgtgtgttcatgtttgtacatccattgccaaacatatgtcaagacataggctaaatatgctaattatatagttgatgcatgagacaattgctttattaagtaccctattattttgttggaatagagacacctgaaaatactccacacacaggaccaacatcagatcaatctcctgaaggctgtagaagttcgaattatttgcaaagaaaaagaagttttggaagtccatattctggatcaagtaataacaatagcaaaactggaataacatccttgaacacaagtaaaataagtcttcctgagagcagattctctttaagaacaacagctcagcagacagttgagaagaccaaaaggaccttaagatatacgagaccactactgcacggtctatcacatacaagtaatgatagtgatgctcagacttcaggcaccccatcaagatcaacttctcatattctaaagacacctgaaaaatcatgccacaatgagaatactttgcctttaattccatctagtgaagcaataagaagtgaagggacaacaagatatcagtcagaggtatttgtgttcctctacatgtaataaactttgtttctgtttccaatatttgtgggtatagtggtagttaaataagctttatcatgatcttacacagtaagttgcattcataatggctgcaacatagcagatagcacaaagcttggattggtttttggtagatcctttactgttgaagtgttcgatttccttttggcctcaggaacaataagatgaatgtactctgcacaacttatctcactatgggaccaaaaaaaagaaaaagaagcaaatgataataccctaccttgttcttttcctccatcttaattacattggatgacctccttcggtcatcccgacaaaaaaaaaaaaacataccttgttctattccagtaattatgtgatggaaaatagttgacatgggatgatctctcatagttttactttcttctagatgactgtttcagtagagatgacctctcaccttaggaagacagtaacattcctcccattaaaagttaacaaagtatgtagtaccagaaaaaggaatgcagatgagtgaagtttaagtacagtgtaaattatagtaagaaaaaactgaagagcaatgagagatggtcattaaagatgtactgaatgtcctaatctatccttctttacattttgcaaattttccttggtttgttctttacatatcaagagcatttttttttccttttgagacaactgatatatatgctttacaggaaagaaatgtaacaaataatggagatggacaaactgttgataaccctgagacagttatcaaattgttgaccgatgaaaattcgtcattaaaagaaaggtagctattaccagtgcttcattcatttcttttttacgttttactggcagttgtatggacaataataggcggtaatcagttgaaatctgaaatcttaagtaatgttgagaggttaaatgttactgtagttgaatttagccaacatatgggtgtttattccaggaactttaacatttgccacatgttcctttttattcctttgttaacatcagtacccttttttgaattattaaaattgtttcctgatgtatgatcagcagaaacttgtttgtttaattcaaaattcatgtaaaatttttattttaaaatcactttatttccaaacagaagtatatgacaccatttaatatcaaacccaagatcatgaaagcttggcttagatatttggtttttcagtgttcaatatatcaaaggtcctaatccaatggattgcttgttaaaggttttccccaaatgacacttagttgttcgcatgaaataagatttggaacttagagtgacttttcctcttcattcttgtttttttccctgtgtgatagtatcatgaagatggaggaatctttgtcaagagaattacatatcgaacgggacaagaataagtctctcattgaaagggtaagcaatactaacttttacctgtggggctgttggtagtatactgtgtgcttgtcctgaaatttttactatttagcccttattcaaaacttgctgcaaaaatgaaccccgccaaaaaagttcaacaaaaaatggcccctgatctctgcaccatcggactgacactgagatcgcgatgttggcattgacccttgccacggtggtgggtggggagactggcgtggcaaagggggtcagcaccagaggtattggcgctaacctcctattggtaaaagggtaataggctattctatacaacgatgcaaaatgtggtgcagtggtgtgatgtctcatgctaccaacacatttattttcttctttatccaaatcatgcctatatatgcctaattctgaccagctaatcgaaagtatgttttatgtttagctaatgtgaactgtatatttttgcaaaagtaattagtacctttttttaaaaaaaaaaacaaagaatttgaacatgtgtgtgtatgcttaataatggtcattcaaagaagagggactcatcctaagaaggccttctttggtaaagcaacaaactactataaggccttctttgtgttgaaggtgtgcctactacatttttaagttataggaggttagtgccaaaggcctcggggctgacccctttgccacatcagtcagcgagctcccctgccaccaccgtggcagggtcggtgccagcatcgatagtgctgagtacctcagcgcgaggtcggagtcaatttgtggttaaagtttttggtggggttcatttttgcaataagttttcaaaaggagcaaaatagtcaaaacttcagcttgccatgcgttaccccaattacaggttaccagaattttattcaactttgcacctactgaggacaatttattctttttcactacagtttggtgtagtgatttatagaaacattttaggcgtcacaaaatatactgacatgacacatgcgatgcgatttactggagccaataatggcttgaagggtttgaaaggtcagactgcattatttcagtctttgtaaccaagtccttccatattttgttttccagttggagaatgttcagaagcaacttggaactgcaaacaaggagcaagaagcattggtagatatctttacagaagaaagagcgcgtcgagaccaagaggtggagaaccagcggacgaaactaaaggttagttagatcttaaaactgtagtggatttattgcgcgaatgcaccgatccaatccgccttgtcgttgaggatggcatcacggcataactaagctcctcagtcggcatagccatttttgatgtcgtctctgctgttccaggaggcgtcgtccaccatacagaacctgctggatcagctgaatgctgccaggagctgccgcaagaactagaaatggaatgaagaagatcaattacctcgttggtccattgtggctatcgccgtaaaataagtttcccttgtacatgttagaataagctatatatgtcccagatggttaattggtgctagaacagctagctgttggtatgttttatgtgcaaggtatgcagtgctgcattttccagtgctaacaaagaagggtgagtcgaccaccactctaaactcgaaaatgtgggagatcgaccatatcggtttcagaccttcagtatcattcgatgcaatactttgtctaaacttgagcagtatgtaaaactgtagttctaaaactcctatcataatgttagtctggttaatcttatatttttacgagttcaccttggtgtgtattatgtttctcggtattataattgtcttccgtgttgatacgcacatatgcttttcctatgaagtccattttttggtagtaaatttattttacaaaacattaatcatgaacttggtatatacatgatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15118 - DNA, 6205 bp, Oryza sativa
  unsure (1)..(6205): unsure at all n locations
attaataaaacaaaggataacaaagtgatggtgcatattgaaggagtgaaggttaatcggaaatcaatgaaagtactaacagaaccagaatacttgaatgacgatataagttcgcctatttaacaaacctactttccttttataactatatttgtaatgtaactgaactaacctcaaattcatatgatggatgcatacatcagttgcctccgtgataaagagaaaggaatcaggggagatgacaaggccttcctagagtaggcagggctagtcctgacttttcagagccccggtgtgaaactagatataaaggcccttatcatacgatataataataatcaatagatatatatattgaattatggtcataaatatttaaattgcattcatcaataatatttatataggaaacattgaacatttacctcgaaaatttcttctgacatttctagctgcgaagtcattgataatggtaccaatatcaatttcatccaataatttcttctcaatgcataaagttatcaaaccatttaaccttttcttttttataatgtacatgtgtgcagcacaatagtgcagtcagggccttcgtcgattcgtccaactctaggagcaacatcaattgaattaattaaataatcgattttgctatatctcactcgaaagattttttcttatctctcactcgattttctcacttaaatttacagtacattttcttttcttgtaagttataatgtaatttatgaaacttacattgtaacttttgtaagttacagtgtaatttttgaatcttcgcatgtaagttttgaaatttgtattggatttggtctttttcttaaagatatggtaatttagtgtctactatggtgtttcttagttgctttttgccttttactgtgtctattggattttaatctaaagattaaaaatctgtctgatacgatcgtaaaaatcttttaaaagatgcataggtactcccttaaataattaacctaacattcaatcctagggaacaactgcaactgaatcaatttttcacatgtacttatggcaattgggaatttgagatttaggaaattgactcactcacctgaacacaaaacataccactccgagtcctgattcctgaatttactgatcgttctcctcggcagtactcgatggcagcaaagcaatctggaaagcggcaagctgcactgcaagaagcggcggctgcggctgcggctgcggcctgcgggcttgtgtcggcgggacggcgatggcgcgacatcgcgactcgcgtgaggaggagacgaggagggggttagggttttgggcggcgacgcggcaatgtcgctcctcgatcgcgtcttctgatctgatcttctctctctttatgttggctttctctgcgcgaggccgaggggccgaggctgcgccggcttactggtggattgggccgtaagccggtaaataagcccttttgtccctgtatttcggcccattctgccgaaaagcaagtgtgccgccgtcgtcgagctttctcctttctctctctctacaccgttttcaccaccaccgcgccgccctccccttcggtttgcgccgccacgccaccaccgtggcggggggatgggatgtcatcggccggccgccaccgccggggggagggccgcgcttccctcgctctccttcttcatgcgccggcctctccgcctccacctctcgttccccacatctccggcggccgtcgcgtcgctttctttccaagcagctcgaggagatgatgcatcatcagtatttctgcaaacaccctcggttgctggtggtaggttgaagcatcttgcgatttgtttttcttgtgtgctcaagtgtgattcatggacagctaagccgacgtgttacgttttattaaaatctagggatttcaagctttgttcatcagattgtctgcacaaattatcgagctcttgttgacatagttgccttatgtgctcttgaattcttgtaaagaggctgctacttccacctcaatttgatattctattccgagattttgatgatcaatgctacgaatttataatcgatttatcaatttttgtagttccaaattgatgtttcaatctgaaattcaatgtctgatgcaatgctcaatacgacaatacccattttttggatcagtaatgcaccttactccactgatctagccgtggatgttcagtaatggggggctattatttcactggtatagttgggttacccaactcccaagcatgctcctactggcttaagaatcttaggcattcgttgaatgaaaattataaatctcaactactatatagatgttcagggacatatatagaacacatccaattgaaggtaggctacatatagaaacttcatagtctgctattgtgtatgcatttgctctcccagcactactctccagccataccttgctgacttcctccaaaactgtaaatgccttgcttctttcagctagaaagactcagctcacagtggatgtattgatcacctttaatttaattagcccatgcgcttaccctgaataaatcaactgcaactagacaagtactattagtcgtacagctaaaaattctatttaggcaagatcaaaaaaaaaatctacgtaggccaagagattgagagtagagctatatgacttagcttttaaaaggtttgaggttgccgacttttaactacgaagcatgagccatgtgataggaattactgaataagcgtcatatctcaatacttgactttgactttcataccatcagtttaattaagaccatggactttgataacatagttgacacttaatttgtgcatataaatagctagctagctaactgcacttttacttcctatcaatcgtcagttcaatcatatatatacattctacatgaatgctgtataaataacatatgcagtagtgttcctgagttttaattggcttgtttggtgatgatgatggggcacttcaggatcatagttctaagccttgtgataatagcatcctttcaagtgcttggctctgctgaaggccataagacggctgtaccggcgatcttcgtgttcggggacggcatgctggacgttggcaacaacaactacttgccgtctgacgccccccaggctgactacccctactatggcatcgacttccctggctctgagcccactggaaggttcagtaatggatacaacatggctgacttcattggtaattaagcgacttgatcgatcatattgcccttattatcttttacagttatgtcaccattaaattgtattttctgtgtcatagtttttcatatagttatttgtgaattagatggatgtttgatggttattatacagtcttttttttttgctttagccgaaagattttttaagtgttttcaagcagttagaataaatcgcccacaatatacccaacacgactacaaataattaatgaattaatgctaattggtagtgtggtcgttgctctatactactattgactttcagaagacattagcaaataaaggtagtaatgttattgtagtttgtaaaaaaaaaatgatgaatataaagaaatactaacgacgattcagcatttcataatgtttggtttgcaaatggtatttctttgtacattgatatatatgattctatatttgagaaaggtagtgcatattatcaagtattcttttatttgagaaaaatacccaagttaatttttggtatatgcatgcaactttaattggtgtgtgctatgcatgcagcaaaggatatgggattcaaaatgagccctccagcttatctatcgcttaacagttcgataaaaatggagaccaatttcaccggagtgaactatgcttcagcaggtgctggcattcagatcatcatggtaactccagaatatatgcttaaatgcaaattcaaccataatattaattgtgaatgctgccatggcaatggcatcaagaaatggtgattatatatccaagttggtcatataaacatatttgaattgttgcatatctatatcactaattatcagaagcatgatctttcatgatggttaattaatgattggaaattgcaaatgaaagaagagagtaacatgtgactagatatcttgtcggcattgtaattttcaaaaaatttctgacagtgacataaggaaaattttatatcaatataatatcatctctgactgtcaacttctgatagttcgctgggccatttcatgggcaatctacaattatacatgtcttcgttcaatttgttcgttactctttgctatcaggaaaattatacccaatattatttagtcggtagatcaagagcttattttgactttgtagtaactcaacattttatataggatattgaaatctatgatnnnnnnnnnnnnnnnnnnnnnnnngaatttcttggttatactatatatacgcatgctaagaatatgagtgatcagatctgctagcaagatgaaagatcaaagtgttaataaacatttgatggttatttaacagataaaatactgggttttccctggaaataaccttaattgatgctatattgtgaatatgcagaacgatgaagcaacgattccattcgtgtaccaagtgaagaacttcaatgacacggtaagccagatggaggctaacctaggccaccagaagttgagcaagctgttggccaaatctttattcctgataagcattggtaccatggatctgtctgtaaatatatggagagtattaagatattccagaaagccatcaccattcaacattccatatacactttcctcctacaaggccataatcatgcagttgtatggcctgggtgcaaggaagtttgggatcatcaacatccagcccttagggtgtcagccatggatgaggaagaacttggaaaacaatgtcgactgcaatgactccatgaacagtctcgctagggaattcaacgatggcctcaagcccctcttttccaatctcagctctcagctgagtggtctctcctactccatcgccgacttctacgcattctcaaatgccaccttcatgaaccctcgggcttacggtaagtcaatcgaaattattgaacactttttttgtggttgggatagaggatcatgagatggactgtaacacaaaccatggaaatgctacttgtccttgtttatctaatgtatttattgtggttatatcttgtatgtgcagggtttgtgaacatcaacagcacatgctgtattcccccctgcacacctgaacatgaaccaccctgccaaaaccgcaagcagtactggttttgggatctttcttacacgactgagcgggctgctaagctagccgcctctgcattttacgatggccctgcccggttcactgcgccggttaacttcaagcgattgataaagatgaaatgattttataataaagatcttttcgtgttgcaagtccattgacgagtagttgatcaggttttcctgggtgtgtatgtgtgctttccttaattttcatcatcttttttgtatgcctctggattggtaatttggtatatatatgtatgaattccatgctaaggaatgtgtcacaataagttgatcgataagaagaataaacccaactatatataatcgacgtttttgtttcagtgagaagattttgtttttttttttccctagactcctggtttccacaagtttgttaccaacctcccatcatgtcatgtgtggcattcacactgtgatttgggtggatagaataatttgagacgcactcccggatgaatgaaccaacactgccacaatagtaacagactcttcaaacaaagaaaattaaaaagaagaagaattagatatagaaaagataaaaagaaaaaaaaatcttgcgaagcagttaatcagccaaccttacctacactcttctaaactaagtcagtttgactttttttcttagttgaactttttaagtttgattatgtttatagaaaaatatagtaatattttttaacacaaaaaaatattattaaaatatattgaatgttatatttaatgaaactaattcgatgttataaatgttactatcttttttaataaatttggttaaatctaaaaatattttactagagaaaaagtcaaagcaactaataaaatgaaacggaagtaggaaaatattatagcaaagatgaaataaaagga

SEQ ID NO: 15119 - DNA, 6476 bp, Oryza sativa
  unsure (1)..(6476): unsure at all n locations
ctttctaggttcagcatttacaagtcagaattcaatataagtaattaataattgactaatattttttgccatattacagtgccaaaatggtcatactctgtgttcaacctgcaaaacccgtgtgcacaaccgctgcccaacctgtcgacaggagcttggtgatattagatgtctagcattggagaaagtggctgaatcgcttgagctaccctgcaaatattactcactaggttgtccagaaatctttccgtactacagcaaactcaagcatgaatcacagtgcaatttcaggccatacaactgcccttatgctggctctgaatgctcagttgtcggggatattcctttcctagttgctcatctgagggatgaccataaagttgacatgcactcagggtgcacattcaaccatcgctatgttaagtcaaaccccagagaggtcgaaaatgctacttggatgttgactgtaagtgtttacctttattgccttctatcacttgcagtctcattaacatatatattggtgtgggtggtacaatttaactgcaagagttttttttatccatgtttaaggtgatatttgatacttatttattatccttttaggtctttcactgctttgggcagtacttctgcttgcatttcgaggccttccaacttggagtggctccggtttacatggccttcctccgttttatgggcgacgaaaatgatgccaggaactatagttatagccttgaggttggcgcgaatggccggaagatgatatgggagggcactccccgcagcataagggacagccaccggaaggttagggacagccatgacggcctcataattcagcggaacatggctctgttcttctcaggcggagagaggaaagagttgaaattgcgggtcaccggccgaatctggaaggaacagcagaatcctgactcgggagcctgcattccaaacctattcagctgaactgaaataacaagagagaaggattcggattcggattcggtttaggtgtatattgggtgatgcgtgtggtgcacctgtgcccgcttctgtaatttgtttgtgttgcttccacttttcttccacgtagccgttgtggcctgccctaaattagttagggctgacgtgtgaggaccatgaaaaaaaaatacggcttgagctttgtgggttctgattgatcacatgataagaaatttctcgatttgtttcttttgcccttgtgccccattttgagatgggaggccattatgctctttcttgcttgtaatttgcaaccattgatcagagcattttctgggtttgtatgttttcatctatgcttgattgggtattcgggtgttaagtatccatccatgacgaaatggtgaaactgtaaaatgttaaaaattcaattacttaatgtcgtttataagataatatgcacatgttcctttctcagaaaaaaaaatgaaagggaattgcaaacccatcatgttcagaaagctctagatatatactcttagtgagacgagaaagtgactaaatacacctaattaccatgcagcaaatatatgttactcttgaacaattaaaagagataacatttaacatttaattacggtattctgcaccctcctggatcttgtatgatgttgatacccttgtgtactctgcgatgatgctgaatgttagccttcactaatctgaagtcttcagaaatttaatttacagctagagtaatctcatcaactgctgttactgaattcaaaagttccaggcgtccagcattgcataatgtacatcacatctaggcctatgaagctaccattgtgctgcgttgcttccaaatatgcaactctttctaactgtattttttcaagggtacgaaaagaaatcatcatcatcatcatcaacaacaactcaaacagttcggggaaaggaattgtctcagaaatagtaaacagattcttataatactgtcccaaaaagatttatgctctgacagcacaattctatcagaatgtagtgaatatcagaaagttaattctatcagaatgtagttcatgaccttaatgtgtttatcccagcgatttcaatcagagcgagaaaccaggatcacacaatgcataatcttccagtttcagctaagccaagataatcccatccaaaaaataactgagcactacgaagcatgaacaaaaagccttagttcaatccagtgtgagtgaaaggcgtgcttcatctccttcgcctccgaagcttccactgctccaggacgtgctgcaaggcctcctgcatgctggccttcctgtcctccttgttgttccacagctctgacaccacgtagctgccgctggcattgtactcgttgatctccagcagcgccgtggtcacggccttgtagacctcgtcaccgagctgctccttcaagcccactagcttctcatcatcttcattgatgatttgctacagaaaagaaaacggatatcgttgtcatgtcagtgatggaagtgtagatcatatatttgtcgggagatcgaatgcgaaaaactgtgccagaagatttcattctgttgagcatacctcagtctttcctcctctggtaacaatcttgaacggatgccaattggcatccttcagattttcttgccactcggagcaaaattcagcagcttttatttcagcttcaccgtcagcagtaccataccttttcttgcaagctgcaaggaagggtttctcatccagctcgcccattctcttgagtccgatggtgctacgagggcctaacaattctgataagccctacaaaacatacgcacaaactcaggtctcagccacaatcatagtataataagattgaatctgaaatgagtccaaataaacacaaatgaaaatatcttcagactctgtcaagcagtagaaaggaaagatcagcatatcatcacattacagaaatcagcgctttcttggcatcttgcagttcatcatttgtcttcctttctttgataatgagagtttgatttgattcaaacctataatatatctcctcaatcttctcatttagttcctcagtcagctcgtcagtacgtttcttcacatcaacaccctctccctccatgtgttggaccaccagcagtcttcctctaagttgttgtatttccagttccagcttttgcttttcatccaattgcttttctaactgcaggattttgttcagagcaatctccttctctttctgtgagatttttacaagccagagtaaattccagagcatgagaaattaaaagaatcttgcataagattaataattggaaacaagagtgcagaccttgtgtttctcaacaagctttagcacatttttatcagacttctgttgctcgattctagccatgtggatggagtcgttttgctcagagttctgtaggggaaatcagtaagacaaacagtcagataagatattctaacaaagatcatcgtaaccagactgtaaatgcggagctaacaggaagtgtaatatagatacatgacaagtatacagaaatcctgtcacccctagaaagattgtcatagctgttcctgaagatagaactctgaagagnaaatgcaaatgctaaccagtaacataaagcaaagagagcaaagctgtggttacattcatacctttttcatctcactctccaattttcttctttctatgtcagtttgagcaacaaacttgcttagttgcttggatctcctctcgatggcattctctttatcatccaactgtttcctcagctgatcagtctcttcaaatattttctgtgaatgttcacgagcagcagattgcatatttcgcatttctgtaacagcaataaaatgaaacaacacaatagatattattattctggcaaattggcaataaaagtagacaacaacatagcaatcatatgcccatggcatgagaattattcatatgaacagtttgtagtatgtaccttcattgtaacttttgtgcagcaagtcagtttcttccattgcccttttaacagagagattcatttgattgcatctgcattccagttccaccaaatacttgctcttagctgtaatctggtgtgacaagttagctatgagagtctcagtcttgcgagacaggtcattttccagaccagacacggtcttcagatcaccatttgctgacaaaaacctaccaactgggtcactagatttgtagtcctcttcttttgccatccatccacagatgtacttctcttgtccaagtgctgcccaatcctttttacccagacgttgtgatttgaagtagttgtggaatgccaaggcgttcgtgaacccaatccaatctttgctgaaaccgacaactgcataaccagtatacctaccctcggagcagagcacagcagtaaactgcaagggattgaaattagctagctgctgcatcagactagctccatcctcctttgttttctcagctggaacatttgcaaggatgcccatccatggccaaacatacgcttcctgatcttgcaatggccttggaggattacttggtccaatggcctgtcgtgatggcaatgagcctgctgcatcagcatagtcgttcttgagaagattggccaaggccatgtggtttgccttcacctttggagcgcgattggatgcgccaaccccaatggcatgctgaagtagctcgttgtaacggtagtcctgcttcttcttccccagacagaatgggcatctgaacttttcattgcctagactcaccaccggcttcccagacttgaggtccatgtagcacttgtcagcatagtcatcaatatctgcatcacttagctctgactcgtcggaggtgaaatccatggcagacctgagtgacacggaaatattcaggtgagaacattgcattgagctcgaaaacagcactggatgcacctttgttacaaccacagttaaaaaaaaatcaagcaaggatgtagtaagtgtgcatatggcattgttcagaacatcagaggaccacacagaacaacagggcaatggtcattcatgattagaataggaattacgattgcatttcaatttgcatttgcatgacacaacattagacagtgttacagattctctaacactaaatgtgcttcagtagaagaattgaaataagtcagcagcaaaataattatgaaacaagcaacacaaaatcctacagttttgaaataactcactgatgtgtgttcattttgcaatctacttcttttttttagcaagaagggcagatcccctcccatttccattaaagaaaccagcacagaacatttcaggaaccactacactcagaacaagtacaggaaaagtatataacctgagaagacctgataggcaatgccatccccatttgcacccctgaactagcctaagcaacaatccagtaaagttccagcaaacaaaactactgccaatgaacagaggtgatgcaatctattgcaattgcatcagaaacagccctatagaagcgaaactcgaaatatctacacagtccaagtataaatgtataatcaagaaaccttttaggcaccctcactaactatcaaagatcagttcagtcggacttagtcgcaccgcagcccatgataacttcccccatgggaataataactatttgccactcttccgagtagttctaaaggatttgccattaaactcacatgtcatagacacataaggacccacatgtcaaatacagcgagtgataaattcttaattgacacatcttaaaagttgcaaataattaaatgtccctctcccatggacaaccagtgctctcaagcaactgagatgtttatgcctttcccttcccccttcttttttcctttttaatccatcttctcaatctcaattctcaaatcgaccaaaaatccggcgccgcctccctccgttgctcaagcggttgctctcccctctcccctctctctctctctctctctcgtgggccagtgaaaggctcctaacgggccatgggcctgactagtgagtgactacacagcccagcaagcatcaaagcatcaaggcagcatctctctctcgtcggcagagcgggcgacggcggccggagatggtgaagaccgccggcgccgccatgccgagagctctgcttctgcttggcttggatgcaggtgcagaaatgtgttatgagcaggcaaagaagcgagatgaacctacaacaacaacaagaaaaggagcacgcagacgtacgcagacttggcatttccgtatggatgggtgagagattccatggagatcgaccaaccaaaccaagtggaaatcattcaatcaatcgaagcaaaatggagaaaaagcaaggaagcgagcagaggaacacatggtatatataaagccactagaaacccatatccttctagtacttggatgtgtgtttccatctactatggagtacgcacgtagagatcgatcgatcaaaacccaccctatagctatat

SEQ ID NO: 15120 - DNA, 4322 bp, Oryza sativa
tttactgctctgctctgtgcaggcctgccaaatctgccatggatggatggatggatggatgctttttgtttggttttgcacggatccggcgttgccgtgttgcacaggatgctttgcttcctcctcctgcatcctgaatgagcatgaacgtgcagatcaagtcgagagattcgagccaaacatggcagtgagaattgaaatggttcacgttttcgtttttcagatatgcgaacatgaatatgaatactagtatccggttgtgtatctcagagttctctactaataaaaaaaaatagaaccccttcattccagttctttctcaaccactgtatttctctcatgtaaaaaagccacatgtcttagttaagaaaaaacctcctacctaaaagaaccggtgtttccacgtaaaaattgacacattgcatattgaaaagaaaaaaaaaatcaaatcctgtcaagccatattgaaaagaaaaatcgcttaatttgtaacatatggacgcacacatagatcgaatatgaaccaattattcgtttacgaataattttgaaaagcatgaaaacctctctagttgtggtcccaaaacaatggatagatgtaactaactcttttatcataaaaagaaatattctcattagttttagcaaccatattactaggacataggcacatgcaaagagccacaaatataggcactttaacaccagcttgcggacatataacatgttaagtaacagatgaacagttcaagcagcaaacgacatgcactctttcttggcaaggactatgtgattaatttggtccaagatttcagaaattttatataggcatatgatgtaaaagcagatactataaaaaaaatctacgatggaaaaaagaaaaaaatcaacttaaatcttaagttttaaaatacaaaatttgatgcatgtatatataaacgtaagtgaaacgagggaaagtgcctgtaacctagtggttacaagagcctcagtagcacctgaggtcctgggttcgactccccataggagcgaattttccaggatttaacggcgttatgctttcagtggtaggcgacgtacccgtcgacagcgaggtgcctgtggtgacttgccggcccagtcttcgaagatgctcataggggtagggtttgcgcgttatgctttcagtggtaggcgacgtacccgtcgacagcgaggtgcctgtggtgacttgccggcccagtcttcgaagatgctcataggggtagggtttgcgtgttgtgagtgactgcgttgtactgcgtaattttaaaaaaaaacgtaagtgaaacgagatggcgctgatatatttgaaggcctagaaacgcccatggcctaatgaagtgacttctaatcaggggattgtgtttttattctttctgcttcatttctctctctctagcttccgggaaattgctcgttttcttctttctctattttcgcttgctgcaggagaggtgctcatttttttcttttattttcgcttcttgtaaaaggaaaacgtgggccgaccaacgcaacaccaaggcaaaaggagctgtgcactctgagtgtgtatcaggcaggctgagtccatgggcagcaaggatggctgccatcttgtctgtttaacacaaaaacggaaggtaagtacacatcagtgacggaccggctgacacgcaaaccaggcgcacctcattttcggaaaaaaaaaagcatcgttatcggcagaaggcatctcccatcgtctctttccctggcaccgactactcatgtgtgtgctaaggtgaagtggataaatattactccctccgtctaaaaaaaggcaaactatggatttccgtgtccaattttaactgtccgttttatatgaattttttttataattcatattttcattgttgctagataataaaacatgattaatattttatgcgtgacttgtctttttaatttttttcataattttttcaaataagacggatggtcaaacgttgggcacggaaaccagggtttgtctttttttaaaacggagggagtaggcatctagtttgattcggtaaaatttgctgcatgatataaaatatcatggtctttgctacgtgacattatctaaagaaagtatgttagttcgtggataccatagaaatatggtaattagtcgtatactcaacgtattattttattatatttgatggaacaaaaagagaaaattcataagaaacaagtttgcccttgtggactcctcttgcccccgccaccaccagtagcggcaccgccccctctcctcccgctaacaaccactcccactaccttttcctcatcaccccagcggccaccgctatagtcctcctgctcgttatactcctgctgcttgtcgcgctgcacttcctgagctaccactgcacgctcatgttctcaccgccgccggaccctgcctgcttcgccaatacttccgtcgcgccactggtggattccacctgtgtagctttgcccgcagtgccgcctcgccggtctacctcaccgcctttccccaacatgtcgctcgtcgttgagagattcctcgattggcccagacggttcgccagcacccgcgtggaggcggccgctctgatcgacaccaagaacctcaccgcgcatctcatgtagatctcggcaataaccatcatgtcctgcgagggaagtaaggcagaggtccatgatagctccaccgccgatgcctattgtcggaagaagaccaggagaagggagaagaagatgagaagggagaagaagatgagggcaaaacaaacattttacatagtttttctctcatcaattgggtggatattgtatttttatgcgctcggtgtcctatggcaaattaccacgctttcgaagtgtcattaggaaaaaatcacattcttacgacgtctaccagcaaagataataagtttttaagtgtcatgtagcaaattttgcattttgattcaacaatatgtagtttacatgtttccactatatatatggtttgcaatatatattttgccagattatgaacttatgtgagacgtgtgtggtaccagtagtgtaattattgatgttctacttgttttcaaggatgagatatgtacctctagaatatatatttatggagttatgcgctttttgaggaccggagtctagttaattatatacatagtcaatgtttcatttagaatcttgaggctttctagttttacctttaggacatcgcaagagtaacattataggggaaaacactattaatgtggtaattagctaatgaacattgtgcctattattttactgtatttgtgctaacaacgtgtgagagggcctattttttgacatagggtgaccaagttggccctaagtgtatcacacattttgacaatttgaccctttaaaaaaactatttttacaaatgaaccgccgccaaacttattttaaaaataacatttttttcagcgccacatcatctggcgctgaacttgacaccttagcgccacgtctactggcgctgaatgccgtgccatcgcggatgggaggctaagtcagcgtgccaacgcacattcagcgccacactatttggcgctgagatgtctaagttcagcgccacatgatttggcgctgaaaaaagggttatttttgaaataagttttggcggaggttcatttgtaaaaatagttttttcaaagggtcaaattgtaaaaattgtgtaagcgtatccggctcaaattgagatggtctggctcaaacatgtctgtcgaggagtgatcctctctagcgggagatcgtgagatccccctttttgagttcagccggggaaaagggttcgcctctcgagatcgtgtatccaccctcagggtttccagatcgcgtatgggcgccaagattatacaggttcgggccgctatagagcgtaatatcctactcctgtgtgtgggatttatgattgagtgttacaagggttccccaactctggagagtgctattggtctgctccctctaaagctcaggcctgctgggagtcgtccccctttttcagcgggcaaggtcctccttttatagttcaaggggataccacatgcgccgctcctacctactcttttatgggagagggacccactttaccttgaccggaccacgatccgtgccttcgcccggaagctaagcggcagttcgtcctttagtgggatccggcgccgccccccgcctgccacgggggacagccctataatttcctcttaaatgagtgaagacttgtggcggtcctcgcgtggagggaaccccagatgacgccccgatgggacgggacataccta

SEQ ID NO: 15121 - DNA, 4058 bp, Oryza sativa
  unsure (1)..(4058): unsure at all n locations
ggccatgcccagaatcgtcacccatgccgcctcgactcccctacctgccaggcatgcgatgggaccgacggcgggcccgcctaatcgcgcccgtgaacatcgcacgccccgcgccgagtgtgccgctgacaggcgcactaaacgcggggcgtgggttcaatgggcgatgtgatgagtggacgcgagaaacgatgaggcaaccgcaggtgtaggaatcgaggaggcaaccgcgagggcgtgaaacgaggaggcgagcgcggtcgaggcggggataaaaggatagggaggcggagatttcgtccccttcctctcgccgactgctcgcccgcacactcgctcctcaagccctaacgcttctctcgctccacgctattccgtacaccaaactcctcgccgtttccccgccggtcatcatggcccaagacgctagtgacgttgtgctcccggtgtcgcgcatcacggcagagaggcaccttagcctcatccgcaagatcatgccggaggacgccgccatgatggtgggggagtcacggccgcggccgcggtacccagagcgatccgtgcacctcctgtccttcgccatggtggggttgatcctgccattctccaggttcttccataaggttttggatttctacgaaattcatgccttgcatctcacacccaacgccgtgatgacactggccatcttcgcgcacttgtgcgagatgttcgtcggggtgcggccgacgatgcggctgttccagtccttcttcgtcccacagctgctgcaaggcgcggtggtgggaggatgctacttccagccctggccaggaacagcggggcagtacattgagagccacctccacaacaagtgggaggattggaagaaggattggttctacaccgcgctgccggatcatccgcgacttcggctcctcgccggccctcccgaacgatccgccgcgtggttagcggtttcggaactaggcgaggagtacgacgctgtgcggtatcgcctcaggggcctgcgaagccagggcctaatgggggcgatggtgttcggcgactacttccgccgtcgcatcgcgcctctccaggagcggtcccacggcgcgtgggagtacattgggcacaacgatcccattcgcacccacgtgggtgagcgttgggactggggcaaggaggaagcgaagacggtgatccggcgggtggtgagcaaacgctgattccggacgggatcctcgccctctgcagcgaccgcgaccgggagagtatcctggttgtgatgtcggccatcggtgctggcaggggtcggtcccgccggggcggcgccggtggtggcggcgatggcgcgggtagctgcggcgcgaccgcaggtctctggcgggggcggcggctccagggcgcccagtccgagccgtggacccgggggggggggcctggccagcaacccgaacgggaagcgaaaggtgtccgaatctcggccgccttctcccctgcgcagagggggcgccgagcgaacggcggaccgaccaccaacgggccacaaacgccccgccacgtccgaggctggatggaagaagaagcggcttcgaaagatagggcaaacggagccgtgccgggggagtttcatcgggcccttgaagtagaccttcaaatgcccccctcgcaggtacgatcgctagcacccgactaggtgctctctatccaccttggcctcttgcttttcccccttcttttctttcttaacgtgatcagggttctccggtagcgggattccttcccagagggtcgcggcgtctgatccctcgcaggggtcaaaattcgagcgaccggatgaccgggacccggccgactcggtgctatggggccttcgcagtaccctggcggggcccacgggccacacgctgggtctggctccgagtccgccacagccgaggtgcagccagccacaggtgatggcagcggcggtggcgcccccccggggggcgatcccgagggcgcgacccacgaggagcgccactcgggagtggaggccaaagcaggtcgtggcccagaggccgaggctgggggcgggcccgaacccgaggccgaggccgagtcagcccgagggctcgaggcgggggggacgggggcaaccgttcccctctgcatctggggcaccctcggggctggccacgtagaagggggccgagagcagcccccagtcccgcgggggtttcaatagcactccgtcatcccgggggcggaccgcgactttttcttctccgactcctgcgagcatggagccactcctgcaggtgctcgctgccgccgactccaccgtccgggaggggctcaatgcccaagttcaagccctggcggacgagcgggcggccctggaggcggagtgggcgcagctcgcggcggaccgcgcgtgggttgacgaggggcgccgcgctgtggacgacatggtggaggtggggcacaaaatgcatcaagcccaactggcggagatccaggcgcgcgaagagacgctggactcagtcatgcgggagatggaggaggagcggcaggcggcgctcatcgcttcgagcgtcctggatgaggtgctgggcgacatccgcctgcagtacgaggcccacgccgaggatctggtgaagagggttgaagacgcccgtggagtcctcgacgcggctgccgcccaagagaggcgggcatcggaggtcgatgccttgttgcgggctcggtcggcggtgctcgaggccgagcgtaaggccttggacgagcgtgcccgctccgcgcaggagttcgaggccacgatccatcgacggatcgaggtcctcgaccgcaaccagcgcgaacaggacgggcgcagctaggaacaggcgcagcgagcccgggggtggaggagcatgctcgggtgctggaggagcgtacccgggcactggaggagtgggcgcccatgctagaccagcgcgagaccactttggccgcccacgagagaacggcggccgaggcggagtcctccctccacctccgtgaggaggccgctgccgagcgcaaccggaccaccctcgccgcagaggcttttggtggctcgttgcgcggaggagctgcggcttcgagaggaggcgtgccgggaacggaacgccgtgcttgccgtacgcgaggctgaggtgaaccgccgcgaggtggcggcacgccggctgggcgagcaactcgcgaagcgcgaggaggccgttgcgggcgcgaagctcggcatctggaaagcgcccgcgctgagcgcgcggcgatggcggcgagggcttccgagctggaggccgcgagaaagagctggtggcaggcgggcagcccagcggcgcggagttggtaagccaactcaccgcggctcaaagcactctcgccgacctggggcgcctggtgcaggaccaagccggggagatcgtggccctccgcctcaccaacgagattagacctggccaactctccgacgccgtcgaacagctggagcgcgcgggatcccgggtaggcatctccgtgcgccaggacagaaagctcccgcctacacagccggcacttgcgttccggctggacgggatggcggcagatttggagaggctggagaaggaggtcggcgagnccgtgaagtcatcgtcggcttctttggcgcgggctacggtggagctggtcctcacgagtcaccaagctcgcgaccccgacttcctcccgtggcacgcgctcgaggactgccccccggggaccaaggcgagggctcaggagcgagtccgggaggcggccgacgcaatcgtctccaacttcgaggggtcggccccttggttcaacctcgtacttgccttgaacgaggagagcgggagaaaggtcgatggtggtgatgacggcggcgaggactgggacgaggtggtcagcggcgccggactcgggggcccgagcactccgtgactatctccgcttttcttcttttattttgttatgtgctcgcggtgaacgcttcaaactttaggccatcgtgccatcctgtttgtaaataaagcttccccttcgctcctttatgttcttgctttctcctttgaatg

SEQ ID NO: 15122 - DNA, 11296 bp, Oryza sativa
cagtgaaaagggaaattcgcgctcgatccgcgggacctaagtggcgaggggcaaggccgtcgccccgagggagctacccagcgggtctggccagaccgaggctacgacgaccgggggtcggggatggccgtgtgtaggcccttctgagcccccagggttcgccgcggcccgtgtttaggctccctttcggcggttttcaggtcacccaacgccacgtaggttctggagtaagcgcaaatcgtcctttgaaccaggacgagccataggaaagagtaagaaaaggcgtgcaacggcctccgcttaagcggaaaaatttattgatggggaggggaaaagatacaacatatttaacagtggtagcccccggccaagccagcacaagccaaaggatgcgcgggggttggcccgagctctaggaaagcaaaagacgcgcaactctatggatagaaacggcggaggtgttcgatattccaggggttaggcaactccgtgccgtcctccgtggttagccgaacggagcccggccggggaacgccgatcactttgtatggccattcccacatcggtgagagcttgctcagccccaagcgcgactgtaagcggtgcaggacgaggtcgtcgacttgcagtgatcgggcttggacatggcgctgatggtagcgccgcaggctttgctggtagggcgccgctcgcagggctgcacgccttctccgctcttccaaatagtcgagatcgtcgcggcgaagatcatcctggttggcctcatcgtacagcgcgacacgatgcgaacccaaggaaagctcggaaggtaggaccgcctcggcaccatacactaggaaaaagggcatttatcccgtggcgcgactcggagttgtccgattcgcccatagtaccgcgggcagttcctcgagccacgaatccccgtgcttctttaggacgttgtatgtcttggtcttgaggcctttgaggattttggcgttggctcgcttgacttggccgttgctcttggggtgggtgggcgaggcgaagcacagcttgatgcccatgtcgtcgcaatagtcgccaaacagctctctagtgaactgggtgccgttatccgtaatgatacggttgggcactccgaatcgggatgtgatgcccctgagaacttgagggcggaatgcttgtcgatcttgacaactgggtaagcctcgggaaacttggtgaacttgtcgatggcgacgtacaggtgctgatacccgcctcgggccgctttgaagggtcctaggatgtctagcccctagaccgtgaaaggccaagagagcgggatgacctgcaaggcctgggccggctagtgggtttgcttggcgtggaactggcacgccttgcatcgcttgacccattcttgggcatcttgcaaggcgatcggccagtaaaaaccttgtcggaaggctttaccaaccaatgtgcgtgaggccgaatgggccccgcactcaccctgatgaacgtcggcaatgagctcgacgcattgctcccgagaaatatacttcaagagtatcccgttggcgccgcgtcggtagagtcccttctacgagcacataccgcttaaagatacgcgcgagcttttcagcttctgcgcgatcctcaggaagagtattatcgtcgagatatgcctggatgtcagtcatccaaacaacctgactaggagggtcgggaccgacccccttgggccccgaggcccatgggtcgtcggggattggggcaaaaaccgtggcgccgggtccctcgggggggggggggggtccaaccgcaacgacagttgtgccagccttttctctaaggtcccccgggagagatgggctcgtgcttattccatgtgtgacaactcctcaacgaatgcgttttcgcgtccggttacattcccgaacttgaacccctccaaatggcatttcatacatctcactttgcggacgtaagcgtccatttgcgggtcggtgcacttgtactcctttgagacttgatttatgaccagctgggaatcgcctaagaccaggaggcggcggatgcccatttcggccgccgccctcaatcccgctaagagtcctttgtattcccccatattgttcgtggctcggaaatcgagccgaacgacgtactggaggacgtccccgcttggcgaggtaagcgtgactccggcccctgcaccttaaaggttgagggagccgtcgaagtgcataacccagtgcccggcgcgaatgttggcgtttgggtctcctccatctccgaggagggggggggcattggatgcaacagggtcgtccaccggggtccactccgtgatgaaatcagccagaacctggctttttatcgcgtgccgtggttcgaagtgaaggtcgaactcagcgagctcgatggcccacttttcgacccgaccagtaccttctcggttgtgcaagatttggctgagagggtaagacatcacgacggaaacccgatgcgcttggaagtagtggcgcagtttccttgaggccattaagactgcgtaaagcatcttctgggcctgtggatatcgtgttttcgcgtttcggagtgcctcgctgacgaagtagacgggccgctgcacctttcggtggggccggtccttgttgttaggagcagccggtccggggtgcccgtgcttaggggcctcgggggtatctcgggccatgtcaggattataggcgtcggggccacccgccagagcctcccttcctcccccgggggcctcggggccctcccggggtttggggggcttcgggcaacgagccgtcgggagacgagggtccatcgccagtcatgggggcccctggtcccttgccatagccgggctcgtgacgcgggtcaccttcgccacgctccactacaagggtggcactcaccgcgtggggggtcgcagccaagtagagtagcaacggttcctctggccctagggccaccaggataggtggggggaagtgaggtaagctttcaactgattgagagcttgctcctcctcctccgtccacacaaatggcctagggcgtttgaggagcttgaataggggcaacgccctctctcccagcgttgatatgaatcgacttagggcgaccatgcatctcgtgacgcactgcacatccctaagtttgctggggggacgcatcctctctatcgtgcgtatttactcgggattagcttctatgcctcaggaggagactagaaaaccgaggagtttgcccgtcggcacaccgaacacacacttttcggggttcagtttcatgcgcgttgacctaaggctgtcgaaagtctcagccaagtcctataataacatctcctggtggcgcgtctttaccaccaggtcatcgacatacgcctctacattgcgccctatttgattactcaaagtaatgcgagtcatgcgctgaaaagtaggacatgcgttcttgagatgaaaaggcatagttgtataacaaaatgtgcctacaggagtaatgaaagcattttttttcctcatcttccctagccatacggatctggtgatacctagagtaggcatccataaaagacaaaaggtcgcaccctgaagtggagtcgactatttgatctatgcgtggtaaagggaagggatccttagggcatgccttgttaaggtccgtgtagtcgatgcacatccggagcttgccgttggccttcgggacaaccaccaggtttgccagccactctaggtggatgacctctcggatgaagccggcctccatgagccgcgtcagctcctctcggatgaaggcttgccgctccggggtttggcgccgtaccttctgccggatgggtcgcgcgtccagccgcacggcgaggtggtgctcgatcacctccctggggaccccgggcatatccgacggcttccacgcgaagacgtcggagtttgcccgcaggaaggagacgagcgcgctttcctatttggcgtccaaggtaccgccaattttggctgtcttggacggatcatcgccaaggggaatctccttgactggcacctcgtcggccgaggtgaggcgcttcttggaggcgcaggacgcggaggcctccgggacctgcggctccatggctgccgccaggttgtcggcgcgctactccgcgcaggcgagagcgaccctgacatcgccgaagacggtgatggggccgctggggcccggcatcttcatctggagttaggcgtagtgggtggcggccatgaacttcaccaaagcaggtctgcccaagaccgcgttgtagggcagattgaggtccgccacatcgaagtcgatccgcttggtgcggaagttagtggagtcgccgaaggttaccgggagctcaacgtgacccagaagccacgtgtgccccgaggttatgccgatgatcggcagtgacggctggagcttcatcccttgggccttgagcgtgtcaaaggcagccggggagatgatgctgaggctagccctcctgtcgaccaggacacgcttcatcttgatgttgtggatggtcggggagaccacgagggccaacttccctccccgagcgagcactgtcggatggtcgctctggtcgaaggtgagcttcacctccaaccagcgcgcctttcgtgttgcctcgtgagtcgggactgcagccagaagctcacgtctcatggccttgaagccacggcgggaggtgtgagcgcaagcacccccgtcgagggtggcgacggtcccctgaggtatctggaattccagatccttgctgtcatcatcgtcatcggcgggggccttcttcttggcctcccctcgccggtcattggcagggctcgcgggggctttgccctcccgttgaccctgccgcttctcctcatcggctttccgaaaccctcggccaagttcttgaccaagcggcagtcggcaaggctgtgccgataagtgttgtgcaccgagcaccacttgtctgccgaccgaccctcgccggatgtagcggtggagctcggcctgtcgccggtggctttttccttgcgcggggcccgtgagggcccatcggccgcaaggacgtggccctcgtcatcagagcggaccggcttccttttccccctcctatctcgccgcttagagtggggagcggactcgggggcagccgcagccgccgcgccggtgccgggggagttccaggcccacacctcctccttccgagccaccttgtctgctagttcgaagagctcggtgatggtcttgggctccttggaggcaattttctccagcatgcggttgtgccgcacgccgttccgaaacgcataaacgaccgcgtgggccggaatgcacgtaatagtgttgcggacctggcagaagcgctgtatatacgagcagagggactcatcgtccttccgctgcacagcatgcaggtccgcctcctctcctgggtgggggtacgtgacctgcaagtttgtaatgaactgctggcacaggtcctcccaggagtgaatggagtcagggggttgggtcatcagctagccgcgcgcttgacccttaagagccatggggaaataattcgccatgacccggtcgtccccccccccccgatgctgccacgatgattgtggtatagatatggaggaactcggagggattgatgctgccattatacttctccgtgaggttggggcgaaacttcgggggccaccggacattcccaagactcgcaacgaaggccctacaactagtccctccaggggtgaacgtggggggcggaccgcctcgcgaggaggaatgcggcactccgaacaaggaggcgccttctcccatgcgggcagcacggcgctcgtcccggcgtcgcttaagcatcctgctccccgtagaggccatcgtgatgcctccgacttcctgaggcccctgacgacgttggggccgtggaccgcctcgaggccgtggccgaccgacgggccctcctccttgctgacgaggagagggtggtgggggtacgcgacgtactagtggtggtgggccggccacctgcggccagctgccgctaggcagtggtgaccaggttggccacgtcgtccaaccatcgctggacgggggtctctggctccgagttcacgggaggatgccgtagaagggctcctgccgcctgaagcgcgcctcggggcgagccaccgtcaccgtatgtcaggcgacgtcgcgctccgatgcgccatggcttccccccgcccgaaggcggggagagggccgagccacccgaccgggtgggatcctccctccgcgaggggtcgcggcggggcggagtccgagagttgcggcggtggtgacggggaccgcggctcccgctagcatcctcactcccggagggagtgggggtgtgcaccaccacttcctcctccaagacctcgaccatgatcgtcgaaggcggaggaaaacttggggcagaagaaaataacttctctttgaagcacgcgaattccccctacctggcgcgccagctgtcgaggaatgatcctctctagcgggagatcgtgagatcctcctttttgagttcagccgggggaaagggttcacctctcgagatcgtgtatccgccctcagggtttctagatcgcgtatgggtgccaagattatacaggttcgggccgctatagagcgtaataccctactcttgtgtgtgggatttatgattgagtgttacaagggttccccaactctggagagtgctcttggtctgctccctctaaagctcaggcctgctgggagttgtccccctttttcggcgggcaaggtcctccttttatagttcaaggggataccacatgcgccgctcctacctactcttttacgggagagggacccactttaccttgaccggaccacgatccgtgccttcgcccggaagctaagcggcagtccgtcctttagtgggatccggcgccgccccccgcctgccacgggggacagccctataattccctcttaaatgagtgaagacttgtggcggtcctcgcgtggagggaaccccagatgacgccccgatgggacgggacatacctacctccactccgccgaatacagaggcgacgtgggggcacggccgcccgtccaatcggacgtggccgacaacaggccggtcacagactggtcacacccgattgacgtgggtcagtctagtggcaccgcacgttcgcccttaccgcattaaacgcggtgagggacagttggggcgccgcgcattgatggtcgttcagcctgggtctcctccccgcttgctccccccaccacatggtagttgggcgagggcctcggggcaaggcagcgcgagggcccgaggggcatgacgtggcaccccgaggccccccggccgcctctgcgactcgcgaggtgcgggggtagggctaggctgtagagccacgcggctggatgtgaaggtaacttcccctcactttgcataccctcgggcccatatctccgacaatgtcctaagccaaaccaatctcgacaactgacgctggccaggcaaatctagccttctaccccattgcaagtacatcaagaaaagaactcaactcaacgaaatcaacaaaccatgcatcccaatcgaatcaaaacaaagaaaaatcgagcctaccctttggacacccattttagattcaccagcttcgtaacagattccacgccctgctctgacaacagtgtagccattgctgcaagccaattccactcctagcacgagatcacccttgcatccctattcctagtgggtcagggatgatgaacgggtcatggtggcaatgtcaaaatagagcatatatatggttggggtggcgacatagggctctaaagggttgacggatccagttagtctaaatatacaataggggtaacttgatcgcgccgtgtcaaaaagtgggccctctcatgtgtcatcagcccgaacacactgaaataatgggagtggtgtccactaggtaattatcacatttagagagtgtaactttactttttacggtgtactatagttaaaaccatgaacttatgtagtaatttgtcttgtttttttttaaaaaatggttgacaggattatgcacatgctatttacagaatttcgaaaattagaagaaacaatagaatgcccacaatttgctggtaagcgttgttaatttggttggacccatatgatgctgtcccgtatagactcctattgactttgtacaagtgtacaactaaccttttattatgtacaaataaccatacgcgtctagatcagtgtcagcttgctagcctaaggtcagttatacattttggtgatacggatcgaaatttgctttgctataaaagtagggataattgcttatttgaccctatctcgaaacgtaactatcaatttgaccctatttttctaggtttgtttatttgatcctttttcaaaaatgaagatcagagttgaccttattccgtgaagtccaactaacggtgttaacttacgggccagatgtcctttttcccttgctcatttgactatgtttatatcaaagttttttaatttgaatctttttaaaacatttataacaaatttgacatagctttgatagatttgagagctccaacagcaaattcatatcctacaaaccactaatattcatgtccctacaacagctccaacaaaccacgaattcatatcatagaaatcatggagtgaggagggagggagaggggcggcacacatgagcagcaaccaccgccgtgccactgccactgctcccaccacgaccaacatcgctcctccttcctctgcacgacaacagcgcccctctgccgtctgcgcagccaccaccgctccttcctctctctctctccgccggcgccatcccaccctccctcctcactccgtgtgcttgcgtcatcgctgttgtccatgaagcaaccaccggcgcgcgccgatacttcctctctctccgcgtcggcgccgcccctccctcccttatcactctgcgcgcttgcgccgccgccactgtccacgcagtagccaccgctactccttctcgcatcaccgtgcgtcggtgccacccctctgttatgcaaaaaaaaacccaagtccagtctatgattaccaaatttagtcggtaacacctcccctccgcctcaatcccgtgcgcgtgcaccgccatcgcgggccgtgcagtagccaccgccgctccttcctctctctctcggtgtaggagccacctctccctcttcctcgctttgcatgcttgcaccgccgctgccgtccgcgcaacaacctctgacgctgcccctcttcgcatagtcgccgccgcttctccttcctttgcgttaatgagttgtgttaggatattgttacgtataatcaagggtattttggttagttcgcgatagcaaatttattttctttatttccctaaccgaaaccctagcgcaccagtgaaaacaggtttagacggtggcttcaattttgaaaaactgggtcaaataagcaaaccttaaaaaaaaggtcaaattggtagttgtgcttcaaaacatggtcaaacaaagcaattgccccataaaagtaacatgctttaccattacaacgtctatttccctatgcatttgggtatcctggtctatatatccaaatgaacccatcgttaaatgaaagaggcataataacataagaaaaaattaaaataatttacagccaataatgcgcttgcttgacatctcactgaaaccatacagtccatacttcatccttgtgcatctgtcaattaacatcatcatcagagctaccgtacgagcttacaaaatcttgggccgggccaatatcaaattaactcttctcccattcgggaaagcaaaaatgtccaactcaactccttcaaaatatttgcatatctaaccgtaaaaccgggtatatcgacccatcctactattaaaccatgtaaaatgactcactggctgtttggagagtggttttcgctatgtggcgtccacgtggtagctcagtcatcacatgaattaaaaataaatgtgggtcgaacatttaaatgatatggaaaagaaacaagtactcatttgaccctattcaccaggctctaccaatctgatctcaccttttcaactatacttatttgatcccatttttaaaaattgaagattaaggctaaccttattttgtgaaggaagataaccgtgctagctaagcggcaaattgttatttttgcccttgctcatttggtcttcttatataaaagccctttttttttataaattacacccatagtacaacaacttggcgggtgggtgcgatatagtgtaagaactcgagaattaaacgttcgagtgcaataatttgacaaatgggtgtgttttagtacaagaacttaataatttaatattttgatacataaacttagctaagcatataagcatatgctaggtgagtttttctcatgatatcaatatgccattaaatagcaatcctatggatattaccttataatattgaattcaatctttaagaattatactgcatatctaattacctttaagaattttgttttcttcaccttcccaaatctcaaccaaaatatattaatttctacctccagtttaattgacttttagttattagttattaggataatataaatatgcttatatacaaatccacgctagtatgttgtcaaaataagtacttaaaaataaaatatgtataaaaaagtgctctaaataattaagttaccgcataacttcttaacttattgtatcaaaatcgtacatatcttgcaagttgttgcatttatgcgatcacttataaagttcttgaactaaattgcacctatctgccaagttgttccactagaacgctcatttctcaagttcttgtatgaaattgcacccacctgccaagttgatgcatcgtggatgcaatttactctaagatctttttgacatatttataataaatttaacatagctattcaaaccgtgcaaaaatgactcactcaattgttttgaggatggttttttgctagcgtggcgtccagatggtagctctgtcatcacatgaactaaaaatagatgtggggcctacatgtaagtgattaaaaaaaagataattgctcattttaccctattctgaaggctaactacccatctataatctcactttttcaactttacttgtttgaccccatttttcaagtttgaagatcaaggttgaccctataccatgaagacaagataactgtgctagctatggggcaaattgttattttttcctcgctcatttgaccatgttatataaaaagtcttttgtt

SEQ ID NO: 15123 - DNA, 2410 bp, Oryza sativa
  unsure (1)..(2410): unsure at all n locations
gggactaaagatctgatctttactcccagttgtttataccacccgggattaaaaatattagaagacttgccacgtcgtgccaaaaaagattatctttagtcccggttagtgttagatcattgcacttttaaaccgggactaaaaatgctttttagtcccgggttttttaaacaaccgggactattgttgtttttgggcaaccaatcaaagatggtttctcccgtagtgattgtacaagtatttttgggcaaaaaaaggcttcgtctggcttaaaaagttaaatgcgtatgcatatgcaattcaaaaggcaaagaagagagagaatatgagtgggattggctgagagcgtccgaaagtattttcctcgtcttcctcgatccacgcttctcgcaagatccgatcgactcgatcgacaatctcagctactgttcgttcgtgcgtgcgtgcaacaggatgtagatcgatctcccgtgcgctgtgagacgcgcgtgcggagatcgatgaggaaggaggagctggactacgtgctgatcccgctggggatggcgctcatggtggggtaccacgcatggctgntcctncgcatacgccgccgcccggagaccaccgtgatcggcgtcaacgccatcaaaccgccgatttggtccgccacatcatggaggttcgtccgtacacttgatctggtttttgtggcgagcgagatgagaatgagatcgccggagtgacggggttccggtggatacaggaggcgtcggggaagcacgcggtgctggcggtgcagacgatccggaacaacatcatggcgtcgacgctgctggcgtccacgggcatcacgctcaggtccctcatcgccatcctcatgtcctccgccggcggcggcggcggcgatgggctcctcccgggcgcgccgctggtggtgggcgccgcgggcgagacggcgctgtcggtgaaattcttcgccatcctggtgtgcttcctggtggcgttcctcctgaacgtgcagtccatccggtactacagccacaccagcaccctcgtgaacgtgccggtgcgcctgatccagcgccgtcgccggccgggcctcgccgtcgactacgtcaccgcgacgctcaaccgcggcagctacttctggtcgctcggcgcgcgcgccttctacttctcctgcccggtcttcctctggctcttcgggcccatccccatgttcgccgcctgcgccgccatggtctgcgcgctctacttcctcgacgtttgcgacgactgggaggaggaacaccaagaccacgacgagcaggatggaagcgggagtgatgagagatcaggagaagcgaaggtctgagcctatgtgtgttaggatgctacgtagataatttttttttaaaaaaaagtacttcctccgtttcaggtaataagacgttaagtcaaaagtcaaactagtttaagtttgactaattttttagaaaaaaataatagtatttttaactcaagactaacatattatgaaaatttatttaattatagatttaataaaagtatgctggtgttgtaaatattactacatttttctatagagttagttaaacttaaagtagttgattttgaccaaagtcaaaacgtattataacctgaaactgaaacagagggagtaatttgaaatggataaccaactcaattttccgcaaaaaataataaaaagttctcttgtatatccacagacactgcacataatcagtcctgtgaaataaccctccctaggatgagcaaaatgcaagaaacaacatatgcaacgatatatcgctgtaacaggcaagcaaatcttacgaatttgtgagtatcaaaatataagtaatctctccatcccagaaaaatataagaatcttcgattagacaagacacttcataaaactacaaatttgaataatctacatgttcagaaatgtcttatccgattctaaactattaaattttagacattttagaccgagggagtactaaataattaaagaaccgcagcatagtaataataatctaggtgtgcaataattaaagtactactagataactagaacagaaccgagtcacattctaccgtaatttacctaatatatcctaatccacaggtataaacagatcagaaaagatgctcatcttgaccccataagtttatcctcgtcgttttcacgctctctccctatttacacaagtagatgcacctgttatcaacatatagatgcataattctctcgatatgtggttgaacgacaaatatgttcactttatttatataatgttagaggaattttataattattaagatgtaccaaaatttagtacaaatttggaaggtcaaatttggtaccttccagtaccggagggagaggtacaaaattttacattgggggctgttcaaatt

SEQ ID NO: 15124 - DNA, 1651 bp, Oryza sativa
caactcgctggtggtgctagagctgcttggggacgtagagttcggcggaggcgatggggcttggggatcaggaactcaagctcgatgaggcggcggcggccggcggatgcagatatggccttgagcttgacctcgtcctcgatcaagcagtggcggcgttccatagaaggactcctccccacgcgtgtggctccggcgaggtccgcctcttccgcgcagggcagcaaggtccaccgctgttgccactctcctcgctggcgactgcgtgcagagcctttcgctggcgactgcctccgcgaccatggcagcgccgccgccctcgcagctccacgctgacgccgcagccaccgccctcgcagctccacgccccgccctcacaaccacacgccgacgccacagcctatgccctcgcagctgcacgccgatgccgcagcctctgccctcatagctccacgccgacgccgcaaccgccgcccttcgcagctccacgtcccgccctcgcagctccatgccgatgccgcagccgccgccctcgcaggtccacgccgccgccgccaacgcgaacagggcagggagggagagagagtgaatatgggcttggcccatattatgttgtggactgacgtggcaagggctgatgtggcatccgacgtgtcaaaaaccaccgtaaaaacagcccgggggattaagcgtccggtattgaaagtttgagggtgtattatattcggttttatagtttggggtgtattttggataagcataagagtttgagggtgtaaaatggacttttccctagaaaatatatgatgtctcccaatatcttcttaataactataaaatcactcataattttaaatatataatatgtatatggcatgtttatcaccagcacgtctagaagacctgatggagcaaggaacttacaacaactaatcaagaaaacagtagatcaaaattaagaagaaaaagtgctttcttgatcaaaatcaataaaacaggagttctgggctagctagttgctaccaaccatgatcagccccactgtcttcttcattgtcaaatcttcgtgctgaagccaagggtggagctcggaggacgtaggagatatgctaccggcgtgaaggctgacatcagtatacaaaggtcaaagggggcaagcgctctggatttttcacaatttggtcctttcaaaaaatcatttcgcaaatagatacctgaaaatacttatcccaaaaatggtcctttttgagcgccagagtcgctggcgccgtcctcctaccaccgtggcaggtcggcgctgaggtggcagggggagcgtgccaatgtggctgccccccccggcccccgcattttttttatttttcttttattattttgatattttttcatggttaggaatataccagaaccaaccatagaaaaaatgaactcaaatggacgaaatacgtgacttgtagaatttttcctctctagtgtagatgagagagatgtgcaacttttttatttttattttattgatatttttttcatacttaggaacccacaagaaccaaccgtagaaaagtttaactcaaatggacgaaatatgtgacctgtaaaattttccaaagctctaccgaaaagcttctcgtcttgaaaacacaatcttgaa

SEQ ID NO: 15125 - DNA, 733 bp, Oryza sativa
ccaagcttcgaaaaaccaagtaatacatgctgtggagaagaaattatgcagcctgacagttcatgaactctttttttgttgacaccaagtggtgtaatttcactctgcaaagtccttatagcacccatgacattgtcatttctcaaaagttcaagaaatttttgttccagtatcagaaatatagcagactttacaatgttttcgtccaaaaggccaaccttcttcaaggtaaccactgcactatcccaattcccatcaagtacctgccttctgaaaagattcactgttggggaatgcagagttattcctgattcttcctcaagaactgctccgcttttttcataaccaaggctatacagagcctttgtgattatcctcacaaattcatccctcttaataacacctttagagccaaccataacttcttttccctgggaaggcaaaggtctagccattgtgcttcccaaaggagcggcaggtttcaagcaagaaaaactatctaacaaacttgctggttctactgaggatgctcttgcgcgtttcgagggtggttcatcgtcttcaaaaccttccatgaaatgttaaaatcagcccatatatatttttgacttctagggagatgatgttatgcagcttccagcggaatgcttgcaatgggtggtgtataacgaaaggacgttgctgcagagaaacagcagttgaaaagtgtaagttctagatgatcaaatgcaga

SEQ ID NO: 15126 - DNA, 11321 bp, Oryza sativa
ttttcttttttatgttaatttcagaaaaaaaaaatccatatatggaatccgggaccgtccggaccgggtcgattttaaaaaaccatggttttccggtcaatcgctcataaaatatagcggaacggtttattttggataaataaaaaaaagttgactatggcaagatgttgaacaagaacaaagtgatctcagagagcctgtatcaaatcatcacgaagaggcctatataaatccaaacgttgacacgacttgtgaaacgaaggtaaggcaaattaaaattctctcgctaatgttactacaacttatcataatactaacgtgaacatgacctaacaggaggacagtaacgagtgcaatcaaagcagcaagaggcttataggtcctacaggaagaatatacaaaccaacaaatcggactgacttcatctacgaatcaaggggtaaaaaggacataatcagaacccaaacaccaacaaaaataacaccaggtactatgctatttcatccttacatatgctcatgattggtactaattttcctcattttcaagcgcgaacggaaaaagaagctatcatgccagacacagacgaattacagggtgaaaagaagagaaaacaaagcaaccaaacactgaagaaaatatctgaatgtatgaactctctacatcatcctaaattttattacttcttttctatgtttgtgtattactgatttgacttacccttttgtagtgtacatcgataaggaggatcttatcaaaaaaacacaaaagcccaccaaagaacgccttacgaggtcaaaagaaaagaaaaacgaacagccagacaccgataaaaaattctaaaggtaatatctaaacattgtacttttctataaatctattatatagattctatgtttacatattaaaaatttgtacgacatttgaagagttgactaaaaaagaagaccctttcattacctacattaataagacaaaggataacaaagtgatggtgcatattgaagaagtgaaggttaatcggaaatcaatgaaagtactaattgaaccagaatacttgaatgatgatgtaagttcgcctatttaacaaacctactttccttttataactatatttttaatgtaactgaactaacctcaaattcaggtcatggatgcatacatccaatgtctccgagataaagagaaaggaatcaggggagatcgcaaggccttcctagagcaggccataaaaacaggtctactcaatgtagagggagcgcatgttgaatctaacaaccctcgtgataaacgatggattagagatatggcatgcgactaactaccatttgacatggtaatacttatttaagctatgtatgtaatggctattacaatttatgaatgtatcttactgttgaacatctgcagattttcctcccaactaatattacagaaacacactggtacctagccattcttaatgccaagcgacgtgaggtgcaaatactagattcgcttgccaagccaatcaatgaacatcgacccgaactagggcgtgtggtaagtgatacacttccacttgcacaattcaaattggttttgccatgttttaaccatactgatgttgcacaaaacttcctacctgctagctatcgagagaggattacacgggacaaagaatgaacacccacagttaaaacatgattggcttgattttgttattaccaaatgggaatacaacaaagtcaaaaaattgctaaagcaaggagacaagtgggtgacccgtaaactcttccacatgatattcacatttttcaattatggtaacttgttaacctaatgactcaattcttgtagcgtctcgtgtggcctatacacccttaagttcatggagcattggagtggatcttatctcccagaaaatcaaatacaggcaactacaataaactctattcatattttgcaccaatgcttcccattatgaaaaccatttaaaatgcactccctttacattagagaaaattcctatatactcctgaaaatttactcaatcccttcaatacccctgaatttgacctcattccttatatacccatgagttttcattttaatcttctctatacccatctccattagttgaccattagttgaccgttaaatattttacaacgactatattacccatcctatacatatgtggtacctactcaataaattttcatatgaaaaaaattaacttatacaaaatacaagcaatataatcatttaatgcccaacttaaaaaataaaacttattattttttattttttaaaaaatatgattaaatccatacattagtttcaccagaaaattaagagcaaaaactaaattttatttaggtttaaatttttgggaagatatacgaaattcatcaaatttgatctgaaatttatttaaaaattttaaatttgttttctaatttgtgacaaactaattacatcccctttattttttcacaacgaatcttttttcactaaatatttgttgaaaagtaattttcaaattttatgcagaactttttttacaataaatcttttttattttaatgaaataatgttttatttttaaaaattcataacaaatatttagtaaattattccttattggttttcacaactcaaataatttacacaaaacgtttctagcttttaacaatataccaatgacaataaagtaatttctacaataactaacggtcaaactaatggtcaactaatggaatgggtacgtaagggatccaaataaaaattcaggggtatataagagatcaaacaaatttcaggggcgtagaagggattgggtgaaattacaggggcatgtagggaattggacctttacattatgcagaaggatatgaaaatatttcgacaggacttagcaggaattttgatcaagtccgaaccgaacaagattaaagactgtccactactacaaaccacgatataattaccttactatgctctcttccacttattacagattttagatactccttgagtatttcattggtcccaaacgttgttgcattttgagttaattttcatagttcagattttgctacgttggggtcacagacagtgaagcacacacataaggctcatgaaatggaaagccacaacaaatccgatagccaaataacaacgatcattctattcatggtcgtaatagtaatgagaaggagcagtatataaaaccttacgcttcgggatgactcatggcagtaagctgtccgcgtcactcacgtgcatctgcttctacgtcgcacctatacaccgagaacccctttgccggcatgcagatccccttcacgcacgccaccgtcttgcatactgaccctgctcctaacaattcaaccaaaataatcaaaaaacaatacaatggtttgaagaacgagcagccattttctgcaataatcgggagaaagagtaggcttttagaggggctcacacgggagatgaaaacttcagggagggccaccattggtcgtcaacgaaaatacgaggagcagctccatagctgctccgccacagccgcataccaccggcgaatcgccacagccacacccgaggtcgctggaggcggaggaggcggatggggcagagggccgtgagggcgctggaggcgatggacgcggcgagggagatggtcgggcgatggaggcgattaatggcgtcgaaggaggcggcgagggtagggtaagaagacggcgggggaggcaagggcatcgaagggggaggagacgccaacggcgtcggaggtggagagggtggggccgacggacggcgacgtagggggcgggaaaggcggtgagggcgggggagacggacagcgacggagggagcggagaatgcggcgagggcgggggaggcggacggcgacggaggggggcagagaaggcgacactggcggaggataggacggcgacggagagggcggagaaggcggcgaggccaagggaggcggcggtgctggaggggacggagacggcgagggagaaggatcggcgatagaggcggtgagggagatggacggcgacggaggcagggatggaggggaacggacgacggaggagagggatggaggggaatggcgtcgattaggataggatagggagagggtgaacagttagataatgacaaattacataataccctacgcgaattattatctctggacaaatatacccctccacatttctactctcattaaatctggtgggagtataactatatctcaacactacgattaaatacgatcaacggttcagattaattttactacaagtataaagcaccggaacgagactcttcccaactatattgtatttctgtgtataactcccaacagatggtttggtttatgtagaaaaggtacatacatatttatggctcggtagagcacggatcgaaggacggaatgtttgactacttacaaatcttgtccaaataaccgcatatgctgaagcatagttgatgccgctgaaacccgcatctacttcgatcaggctattattaagcgacagaaaagctggagggctcatctccaaccccatagcctttgctgcaaccacacaaaaaaaaatcatattaccatgcatgtcttgacacaattaactgatagtttgatacgagatgatatttgtgtcgagggaacatccgtcgttttgtgcctgttgtttaaaacgtcatatttttcttaaaaaaattgacaagatagattaatatgggaatgtatcactttataaacatataattcagcatatataattagagaaaacaacaaatttagcagtgaactgtatgttctatttagagtcaaatttatttttttctacatatataaattgaatttgaatagtgatatatatcaccgatttatttttttaaaacacggtacaaacgcatgcgatatatatcacaatagtgatatatatcaccgatttatttgatatatatcacaacgtgcgcgctcacctctataaatacacacacaaaccctacccttataagtacctccgatatattttgttaatatttcttttgatgattttcatgaatctattctgttaatattttttttgatgatttttaaagcaatacttaaaaatgaagagatgcagatggcggacacagaaaaaaaacaagtgttgggtgtacccacatatgccaattaaaagaaaatatatgtctttatgcatacaaacacaaataagcctcagacgcttatacggagtacataacaaaaattgtcagatagaagatataactgcaactatttatgtaatgaaagatataaattaaagaatttgtcaaaatatagctagaatctgaattctttggtgctcactaaaaataaacactaggcactgctcttgttcacatacctttgcccactcaacttaatttaagaacagaaatcacaaaatagtttcagttttcagtaatttagtttgagggaaactgggactaagagatgaaagtgcaaatatgaataagtggaggatatatagcaattgtgcgcttctgcttgttgagtaaagacagttgcacagcttctcccgcttggcaatacatcatccttctggtcgtcaccggcgctacccctaaaactctgtcggcactcagcagttcaccacgcgcgctcgcacaggcactattacttgttgctactcctggctttaatccttaaaatataaggtaatttgaagagagatgtggcaaatcctagcattataaatctggacagccgcttatatattttaggatggagaaagtacaactttgtttaacgcttacaaccaggtctgacctgctgttctggcatgtgcctaataagctattatatactccctaaacccagccgcttatatattttaggatggagaaagtgcaactttgtttaacgcttacaaccaggtctgacctgctgttctgacatgtgcctaatatgctattatatactccctccgtcataaaaaaacgaatctaataccggatgtgacatattataaaaaacgaatctaataccggatgtgacatactatggtactctctccttacaaaagtctaagtcatttctttttgcaccaagaccaaaaacaattaattcattcacccgagacaaaaccaatgagcatgtaaccgataaacactaagaagctgtttggttgggctgttttcggcccgtatcagataccagcgtgaattgattcccttacatctgtttgttttagatggaccgtaatcggttagcccgcaaacgaatcccagcccaatacaaagttgattacgctccagatcgggcgttacgcgttaccgatacggaggcggagcggagcgaacgtgacctagccttgagcgccgccaccttgcagcgcaccgtcgctggcgccgctccccctgcccggcgtgcgtcgtcgacaccgctgccccctgccccgacgccgctgcccctcccctcgcacgctccatgaccgcccggagattgcccgcctcgacaaggccgacaacccactgctctgctaccttcagtccctcctccatctccctcgagttccacatccctgacgactggatctgcgagaaggacgaggctgttgagcatcaagaaggcatggcagagatcttgaggcacacgaagaaggcaccagccaccaaggaggttcttctgtcgtttccgccgtcgccggtgagaaccctcccctcactgataccaccactctttatgatgatatacttgtgatgctgatgattgatgatctttttcttttcattaacaaatcatgaagtagtttatactagtgaatcatttgtattcttgattggttgcatgtattcctgcctcagttctgtttgctttataagtttacatgagttttgtagaatctgtttttcccgattgcaggaaaaatctggaatagtagttgatggttctttcatatttgttttcgagtgtaggtaagttccgaaattttgtcggaccaactcattttactctctagattttgagaattttgattttcattactgccaggtgatatattattttgcagagtgtgagattggaaaaaaaaaggtttgtcgtgcattgccttttcgacagaattgtcatcttgcacatatataatcaatttacttatgtttcgcagcatggactgttccaaaccaatctactcgctgaatctgagtctactaatctagtagtttcactcatgtcaattgttcatccatatatttcctcagtactttatttagacagatcacaatgtatcctcttgttgtttagttcattgaacttctgaagttctcactcccagcatgggtcttatatttactcttgagtattcggaagctacatctacaagatcttgttcagagatcttccaggatgatgctaggctgatattagatacaaattcaagaaactagctgctttcaaatatttgcatgtcaaaatggatccgatatttactcttgagtattccgaaccaaacaccaccctagcttgagatcgttggatcgagattgaactgttggagttccactgctctcatcgtgatccttccacaaggattcaagtgccaattattgcttatctcatgactgctgcgaaaattagtctcgcggtgcagctatttacttgttggttaactgcctatatatctggtatgtgcataactgtcccatgggcaatttatttctttacttgttatattccaaaaactttgttagcaaatattttttttgcagctgctgttgacattgttcaacaaatatttgctctactttctgattagcatttaattttctcttgtccaggaagttgacttcagatggccctgctttccattttcttttaaaattcactttgcagaagcaaatggagggtaaatttgcaggtgagctaacttatatttcatgaaaagtgtatgattggaaaccatagaaactattccacttgttaccaattgcataagtggaacacatatttttgggtttcgtgctctcctttaaactcacagtggcatcttttatttcttttaatgtagaagtaacattataaattggattccttgcatctttgtttgagcatgagaacatatttacatgcatgtgtgcttcttaactttggagtcaatgccctttttagaatgaagcgaggacctgcccgattattcactttcagtagtttctagatgcatgttgtccaattatatcacttgaattctaaagccacatgaccttttcttgaattattcctgtacatgccctagctagagtgctaccactatccataatttctacttgagattattaaactgatgttcacattttcaagactgtatacacttcccaatgtgtgatagtatcaaacagttgcatgttataaaattgtgaatatttttacatagctttgatgtgctacacgtgtttgagaacactgctgctatgtagcttgtaatgtgccttagctttgagctacgtcacgttctaagcgctccctgcttcggaagcagccgttacccgttaccatgttccatccaaacaatgtaatgcaaacatgagacgttacagcggccaaccaaacaaaacctgtaaagtgatacattttcttcccttactgctgtagctgatcccatttacgtttgcatttcctgacctcaaccaaacaccacctaaaatggcttcttggtacctatcaataatttaatttagcacataatgattacaaataggactaaaatggctttttggaaaaattaaaaaataaaataagtcttagacttttggaaggagggagtactacgaatctagagatactacgaatctaaagacatgtatatccagattcatatactgctagctagaatgtgtcacattcggtactaggttagttttttatgggttagaggaaatagtggacttaggccatagtgctagggagtagctagctgatcctatttttttttcaaatttcttgggtacgccagtgcacacctggcacacctcctgaagaaacgtcatctcgaaagatgaatggactttcctaatttgatacaatgaataatcactagtacaacaacaattttttccatacagcccaaaagtgattttcgcgtacggaactctggcccatctgctttgaagggtctgcataattcactatttttccacgcgtgcgggcaaaatcggatttttgcgtgcgggtacttatatggtttccacgcaaaaaacaaaaattaaaaaaaattgcaaaaaataaccctagccaccgccagatctgggtggcccccgctgccaaatttgagcggggctcatctgcccgctgcgtgatctgtcgctgccgcccgccactcgctatcggcgcacgcccgccgcccgatgcctgtcgcgaggccgacgaaggcggatctgctcgccgcccgcggatccggccgttgagggccctacagcggcggatcaggctatcgcggaccctacggtggcggatcaggccatcgcaggctcggtggaggtggatccgccagccaccgagccgcccactatcgccgatcgctccctccgcctgctgcctgcctcgtgccgctcaccgcctgtctcgtccagtgaggtgagagaggagatgaggtgagagagtggagaggaaataatgaggagagaaggtgagagagaggagtggataaggatgaaaaattttgaagtgtcgagagggaaatgaggatgtaactcagactttagacagatccttaagaagcccgtctacaaaaatatattttcgcatgcagccccttaagaggtctgcctgcaaaaataggcttatttttacgtgcggacccttaagaggtccgcctataaaaatcgattttttatatggtcctcctaaggagccctatacggaaaatagaggttgatttttgtagatgcgaaattaccgtctgcaacgtatgtctcatccagaaaaaaaaaaccatttctgtaggagtgaatacctcgagtagttagtacatatagctagctaggccacatgcatatagtgaaaataagtgaatttagggctggtttgattttaccaatatttggtaatttcaatagtgtttagtgtctatttggtttggagcaaaattttggcatgccaaagaaaatagggcatttcaatagttaacttaggctattttggcttcaatgcaaacacaactttaccttaacaaaattaaccatactaaaatttaccaaactttagctttaaaaaaattggtaaatctaatttaggctacaaaacaaaccagcccttaattaccaatgaaatcggccatggtgtagccgttgctgaccctgccggtggcattgccaccggggaagtcgatgccgtaaaaggggtgatcggcgcggatcgggtctccggcctcggacgacggcaagtattggttgttgccgacgtccagcgcgccgtcgccgaacaggaagatcgccgggaccgacgaccgccgtgtatcgttgcagccgccggcgacgacggcaccaccaagaagcatcacttggaaggttaacgctgccatcgcaaggaaagtgcccatttcatccgatccactgcccaactagcaattgtttataatttctgcagtagcgaagtgttggagctgcctgcccctatagctagctagctacttataagcacaaggtttcaagtgcttcatggatcaagtattcgtgttgatccggctagtttatcctatctattgtggtctcaagagataattaagtcaagtgttgatcgacgccagatgcatataatgattcctcatcacgcatatatatatgcataatgcatccatgatccatgcttgcatggctgatcgatgtacattgcttccaagataaaaagaatatctcctaaaaacttgaatgctaattaagtcgacggcggtcagctcagatctctatccgatccctctctctctctatatacaaaatctcatgcctatagtgtgtatgtctgccaatgaaaggatcgattgatgatatggtcaagatcaattggttatatgtttgattagttatcaaccagccgatgccgatcgattcaagcaatccaggactgcatgctacctgtgcggctacaatcactaataggagaacgatttttctatgcggtcgaatctgattttcgcatgcgggtggtcggcccgcatgcaaccaagggtctgcgtgaatcgcgattttcacgtgtgggtgcttatatcgcccacacggtaaaataaaaatcggaaaaaaaatttcaaaaaaaaccctagaatcggcag

SEQ ID NO: 15127 - DNA, 15290 bp, Oryza sativa
agtgcgtggctgctgcctgccggaatctcactcacgcgcgctgcctggaaaaagagcgacgcgacggccgacggagatggtgggggacgaggtggaggcggagagctacatacgcggccggcgcaggaagaagaagagcgagggaagcgcggccctccccaggctggttggtggctcccccggcggtggcggccgccggccggtccatgacatccccccgccccggtggtggcgaagaactgaagacggcggagagagagaggaggaagctcgacggcggcaactttctttccagcagaatgggccgaaacacagcgacaaagggcttatttagcggcttacggccgtccacaagaaaataaaaaggaaaaagtacacctaaggtccctcaacttgtcatcgagttacaaaatcatccttaaactgcaaaaccggatacaacacatcccccaacttacaaaaccagtgcaaactaggttcctaagtggttttcactccagttttgtctgacgtgacagctgactaagggtggatcctagatgtcagcctctacttcccctcccctctcataattataatactaaattagtttcatcaaatcaataattaaatatattttcataataaatttgtcttgggttaaaaatgttactattttttttctataaacttgattaaaattaaagcagtttaattttgaccaaagttaaaacgtcttataacctaaaacaaagggagtattaacttaaattttttagtaagacgaataatcaaacatgatgtaaaaaagttaacatagtcatatattaaaaacaaaggtagtaagtattattattgttgttgttgctattaatgagctaagtattttagggaaaaaattactactaatgggctaggttcttggaataaaatttcttacttgaaatatacgacttagtagaactaatacagagcatgtagcgctctatttgagctaagtagcatgtattgtaacaactaaaaaaaataccaacttttaaaaatcaacttattttacttttatttcttccaacgctaggcttagttggttgccgtgttttgatcttcagaaaattccatatgtgcccacaagtttttcctcaatcccttctatacctttaaatttttaaattttgcatcatctcatgtacagttgtaccactgaatttttctttttatcccctctttacccattatgttagatttttataaaatgaatatatttccctctcttatacttacgtgcaacttattttaaaaacatcaatgttaatgtgattttttatttataataaaaatcaaacggggtagaattatttaatagcaaatttaaaagaaaaactaaaatgtgatctcgatcatctctgatcagtgtattcccatcaaatttgctattaaatatgtgaaaaattaggagatctcgatcatctccagtgtattcccatcaaccgcttgaagttaagcggcgtggtgaactggcgttctccgtcgtaaaatgcagctgctgccagcttagcggccttctccgtggtgtgccccacgtcccagaaccagtactccctccggttcccacacggcgctccgaactgctcattgcagggccctttgcagcacgcagcatcagtgttcgtaaaccctgtgtacatacgatgacaaactaacattaggaatgcatcatcattaaaaagaaatgcaagaagtaaattgtgacggttcacgaataatctgacagattttgtcaagtaattaaataccattagccgacgggttcatgaaggtggcattggagaagccgtagaaatcggcgacagagtagcggaggccggggagggaggagctcagcccggccatgagagaccccaatccgtcgttgaactccctcgcgagggcgttcatccggtcgtcgcaaccgccgacggggctgtggctgtgcggatgctccgttaccgacggcgcgcacccgatcggaggggcgttgacgacgccgaacctgctcgcgcccagggcgtgcagtggccggacgacgagctcgccgtaggaggcgacgaggtgcgggatgtcggtctcgttgtcgggcggtggcggcgacagcgacggcgagtcgagtatgttggcgatgcggtagaggtcggaggtgcccgcggagatgaggaagagggacttggagagaagctcggttagctcgtgctcggtcacggtgccgttcagctcctccacggtgatggagaagtatcgcacttgtctcggcagtgatactgattctgcgtcgtcctgtatggtgtttgggaaaatcaggcgactgataaatagtaaaatggtaaatatttatgaaattaacatgagattcgactcgttttacctccatggaaatatttcccaactgtattgtttatgtaagaaaaggtcgtatatgtaagaaaatgtttggtttatgtaagaaaatgtatatatggcttaggctatgttcaggaggaggaggagtcctctttggcacgcaaaataaagcacatattattacataattaattagtattaactaatttattttttaaaaatagataaatatgaatttttaaaacaactctcatatataacttttttttaagaaaaacatacctttagcaatttgaaaaaagtgtgcacacggaaaacgaggaaggtgagttaggaaagttggaaaaagaactgagccagtagaacacggatcgaaggacggaatgtttgactacttacaaatctttccaaataaccgcatatgctgaagcatagttgatgccgctgaaacccgcatccacttcgatcaggctattattaagcgacagaaaagctggagggctcatctctaaccccatagcctttgctccaaccacacacaaaacaatatcatattaccatgcatctcttgacacaattagtttatagtttgataggagatgatgtttgtgtcgagggaacgccccatcgttttgtgcatgttgtttaaaacgtcattttttttaaaaaaaataggtaagcttgatcaatatacgatatatcataaacatataactttaaattcagcctatataattagagacaacaaatttagcagtgaatttttatgttctgttcagagtcaaatttgctattttgtttctacatatataaattgaatttgaacaatgatatatcaacaatctatttatttttaagaaacacagtacaaatacaggcgctcacaacgtgcacacactcacgtctatgaacacacatgcgaatcctaccactatgagcacctccgatctattttattaatatttattttggtgattatcacgaatctattctgttaatatttttttgatgatttttaggctataagtaaaaatgaagagacgcaattgtggacacaggaaaaactagtgttgggtgtgcccgcacatgtcaattaaaagaaaatatataagtctttatgcatacaaatacaaataagcctcagacgcttatacataattaacaaaaattgtcagatagaagatataactgcaactatgtaatgaaagatataaattaaagaatttgtcaaagtatagctagaatctgaattctttggtgatcactaaaaataaacactaggcactgctcttgttcacatatgtttgctcactcaacttaatttaagaacagaaatcacaaaatagttttagttttcagtaattcagtttgagggaaactgggaccgagaggaaattgcaaatatgaataagtggatgatatatagcaattgtgcgctttgtgcttgttgagcaaggccctgttctattcttcaactccaaactctaacttactcatttttcatatatagcacgtttttcaaactgttaaatggtgtgtttttaaaaaaaaatctatataaaagttattataaaagcaaataaatttatttcttaaatttataatagttaatacttaattaattaattaatcagcttctcccgcttgtgaatacatcatccttctggccatcatcggcgctaccccaaaacccgtgtcggcactcaacagttcagcacgcgcgctcacacatgtactgctacttgttgctactccaggcttccgttccaaaatataaaagattttgggtagatatgataaatcctaatactgtgaatatagacagagaagctgtctagattcatattactatgatttgtcacacatctacccaaaatcccttatattttgagatagagagagtacaactctgtttaacacttaacacttacaacaggcctgacatgctgttctggcatgtgcctaatctgctatattggctgtgtttagttcctcctctaaattttttttgacgtatacatacgcacatttgaagtattaaacgtaaactaataacgaaacaaattagagattccgcctgtaaattgcgagacgaatttattaagcctaattaatccatcattagcaaatatttactgtagcaccacattgtcaaatcatggcgtaattaggctcaaaagattcgtcttgcaatttacatgtaaactatacatttttttcacatttaatgctccatacatgtgtctaaatatttgatgtgacggaatttttaaaagtttgaagagaactaaacagaaccattatctactggacttaggccatagtgctaaggagtaggtgatccaaattttttttttcaaatttcttgggtatgccagtgcacactacacccttgggtccgctccctgaagagatgtcatatctagagatgaacagactttcccaatttgatactccctccgttccattttaattacaaccatgagtttccgtgtctaactttaatcgtctgtcttatttagttttttaaaaaaaaattaaaaaacataagtcatacatagattactgttcatgttttgtcatctaataatagtaaaaatattaatcataaaaaaatcaaataagacagacgatcaaagttaaacattagaaactcctgaccgtgcttaaaatggaacgaagggattataatgaataataccactggtagttagtacgtatagctagttagctaggccacatgcatatagagaaaaaggaaatgaatttaattaccaatgaagtcggccatggtgtagccgttgctgaccctgccggtggcattgccgccggggaagtcgatgccgtaaaaggggtgatcggcgcggatcgggtctccggcctcggacgacggcaagtattggttgttgccgacgtccagcgcgccgtcgccgaacaggaagatcgccgggaccgacgaccgccgtgtatcgttgcagccgccggcgacgacggcaccaccaagaagcatcacttggaaggttaacgctgccatcgcaaggaaagtgcccattgcatccgatccactagccattttttacacttttctgcagtagcaaggtgttggagctgcccctatagctagctagctacttataagcacacaaggtttcaagtgcttcatgcatgcttgatcggctactttatcctagctatatattgtggcctcaagagataattaagtcaagtgttgagatgccagatgcatataatgcttcctcatcacgcatatatgcataatgcatccatgatccatgcatgcttgcatggcagatcgatgtacattgcttccaagataaaaagaatatctcctaaaaacttgaatgctaattaagtcgacggcggtcaactcagatctctatctctctctctctatatataaaatctcatgcctatagtgtgtatatgcatgcttatatatccagtgaaaggttcgattgatgatatggtcaaggtcaattggttatgtttgattagttgtcaatcagccgatgccgatagattcaagcaatccaggactgcatgctacgtgtgcggctacaatatgttgaaattataagcgcataatgatttaatttattccataaataaatcatgacattgcagatgtaaactagattgaacgcatcattagatctacacatgtaaactaagcagtaaaacatgagcagatcaaatatgcgcaacatgtcgaacacgtaccgaggtggcggaaagaccggttgctcggcaggaactactcgcggttgcggacgtcaacgaaggcgcgcagcacacgagcagagaggaaggcaagccgtcacggacgaacagggagcagtcgcgcgaagcatttcccaaaaaccttattgccgccttctcccggtgcaggacgtcgaaggcagaggttccggagacctgctctcccgatcaccggtgcatgccggcgagcgggatggagtagtctacgagtgacggcgcagtacagagtaggaggcaaaccctagattgatttcgcgtgtgttgcgtgaaggcggcggctcggtttatatagaaataggtcgcttgatcggggcgcccgcgtaaccaaaccggataagtcgcgcgtaacttatccggactccacgccgttttcacgcaccggatttttcggaatgtttcaaaacaaaacaaatccgaatttcctgcagcaaaacaaaactgcaaaaggagactacatctgcgcaagggtgaggagccaattttgcggaccatttgacgtgtacgtcgtgcacgcgcgccgcctgccttgccaagccaggcgaggtgagcgagcgcgcgtgtttcccctcttctctccaccacacatgcttcaagtggctaggagggcatcctcccttttaaggaggtccccctctcatagaaaaagcaaggtggtactaaacttcacatgcatgccatcccatgaggtgggcttttgtgattttcaaaagaattaatcttcgaatgggccttagcccatctattaattccaacaatcccccaccaaatctcaaaatcccactgagatttgccttttccaatgtactgtttatataccagcggttcgatggagaccgattaaggttaaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctagatctttagtaagattcctagaagattcacccaaaatctctatagactgcgaccaacagtcaagcttacaaaggtgagttctttcaagaatgctctgcaggacatcatcttcgctaattaaagccaacagaactcattaaggcatagccaacctgccttgcagctcacgagagtacatgcatcttcacttagagagggtatagattggtactctcctctagtttactaatggtttgttcttcccaggttctaattcacgggatctccgatcacatagactgggttaccaccatagtataactcacatgggtctcaaacctatctcctacgatgcattgtctatcacatttcgtgatagtcccttcgtgaagggatctgccaggtttctagctgtttggatgtaatccaacgttataactccggagtttctcaatttcctgacagacttcaatcgtcttttcacatgtctagacgatttcttattatccttagaactattcactttgacaattaccgtttgattgtcatagttcataaggacagccggcaccggtttttcaacaataggaagatccattaatagatcacgcagtcattctgcctcaacagtagcagtatccagtaccgtcagctctgcttccatggttgacctcgtcaaaatggtctgtttgcaagacctccacgaaacagcaccaccacccagtgtgaagacatatccactagtggcttttatctcatccacatcagagatccacttagaatcactatatccctccagtaccgcaggatacctagaatagtgaagccccaattccatagtatctttcagatagcgcattactcgctcaagcgcacgccagtaatcatctcctggattagaggtaaaccggctcaacttgctcacaacaaaggagatatcaggcctagttgcactagctaggtacatcagcgagccaatgatttgggagtattccagttgattcctagcaattctcttgttcttgcgaagcaacaattgtcgacctccgattttggaaatcggaaatctcctatgtttatcagtaccaatccctggatcagtagttggtacacacatacatagccgaatcacaacatatcatgaatgaattcaggctaaaagagttaaatgcttacattagggcctggcaggccaacaactatcagagaaacaacagcggaagacaaaataatacaggggcccggttgacataccacaagcagtcgactgggaaacgagacctagaatggaattaaactccgatcatcttgttaggtacgcaagcgcactaacaagggcttctcttcaacactctgctaaaagatatatatagagcaacaatgagtacaaaagtactcagcaagccaccacacaaaatgtagtaatgtacaggataatacaaggagtggctatggttactttgcgtaaagctgagttttcaaatatcatttcacaaacctaagacctagcataaactgatcaagttttaactccattgttcattaaacagcgacggttctatccaccatccattgtgttcccaaggatagcttcccgccactggccatcatggttttctggggtctaccccttctcgcctctcgagaagttgatccactagtacaaaatcatgatgcatatcccatcccaatcagattaagaaattagagtctagccaagtgtaatacatgtcccggtgctcaataaccgcgagcacggctattcgaatagatttgttttactcacactgcagtggatgtacactttacccgtactccgcaactgcccaacacatgagcctcgtcccaacacatgagacgcgtcacggcaaagcctttcaataacctcacattggcagtacccgctccatgaacttaagtcctcatgcactctaggcgtcataagtttctagcagtgagaggagttctggcgctcccgaggaagaaaactcacgcaagtctaacatcgcatcctgtagttgaacccaatctatgctgtcctcttttgggtatctccttgtagtcttgtagtcttgacaagtcagtctctggccatccgtatcgggtatccgccatctggccatccgtatcgggtatccgccaacagactgcttgttcatccacacacctaagtgaaaccactatgcaggggtactgcctccgctcggctatctactccgctaggtctatacccattcgagaagtacggttgtattggggtcgtttcatgcttagcttcatggctctgtccttaactgaccagggatggcactagcctttaccggacaccacccaaatcatccagccgccccagtcgaaaacatttgtttagttttaattttctttcacaaatcatctcatcaatgccatggcaatgtggcactcatgtctctacatgccgtatctcaactaccctccccaaggtagttgcccaagcataaagcatttgataaatatgagaatgcatgaatctaaattagcattactcagcatttgtcacaagtgactatggactcatacgtaattatgggtacaagggaataatgagataagcaataatcaaaggcatggcataataacaagtaggatattcatcattgcatgcaattttatttgtaaacaaaacaatttcgcaattgggatcaacatgctcaaggggtggggtgatgacttgcatgctcaggatagttcttattcttgatataatcttgatcaaccttcacctcctggaagctgcatacgttgcctcacgactaaccgatatacaaattctataatacgcgagaaaaaccaatattcaatcaaatatgcacaagcaaaatatagttgttggggtcgattcgtgtttgcaaacggataatctcttaatcattcctattgtcatggcggcttgtttaggatctaatcatcataatataaatgggatacacatttcattaaatcagagttgatctatcgagttatggtaggagtatgaccacatatgcttctaattagtttacatgggttttacagtgataaagcatggtaaagagaattatcctcacacctagtttactgtacaataatcaattttatttattagcatatttttaagttgatcataatctaatcatttgatattaattatgtaacaattataaatatattttactaaacagtgagttacataccattggaaagcttatgaatttagataaatttaggttcaagtttcactcgaatcggagctaaaatgaataagttatactagtttaaagattcaatttcgaattaatccgagaaattgtgaaaagttactgttcctaatagatttgttcttaatccgaaatcctatccacaactacattgactgtcatgtgggaccccgggtttattccttttccaccggattaatttttgctaggggaaatataggagtgggcccggcctgtcagtggctcgaatggaggtcgtcttcaacctccagccgggcagaggcagccgtgccatgcgcgctgggcacagccgggatggcgcgaggccggcacggcggcggctgcggaaagtacggagaggctccggcgacctcccaccaccgtcagcgacgcgcggcggagtgagggcgagtggcgcagcatggctgagctcgggcagctaggtgctagggcgatagggagggtttccgaccaaactggtgagggcgtgagcgtctacggcgtatggggattcgatttcatcagctagatggagaggggagctcccggatggcttgtccacggcgagctcgccggcagtgcaatggcggccaggccggtacggccacgggtgctatttggcgaaattggagccgatgctagctattagagagttagaggatgctatggggtcgagggattacgctaggatggagagacggcgaagggcggcgacgcgtggtgcggtgcagacaaagcagaggtggctagcggtcggcgatgcccgaaagtgttcgacgcgtggttcccggtgtccagcggtcctcagctccctcaatggcgacggcggcagcacggctcttcctccactccctccaacctccagctccggccggggagcctcgcaatgctgatctctagcggtggtgagagagtgatcgcaaggtgctcgatgaaatgtattcgggaagaaagctgagaggaatggggatttttgttgggggcttagcttaggatgtaaggaaaccatggggataagatcgccggcacatggcctggatgagctagagctctaatggcaatcggataaggaatatgaggtgcacgccgcggataagggtttatctccttctccattaaggttctgtggcttaatcatcgcatctataacctatgtactgcaggtctaggcgctagctggaggaagggcattgttttgtccagcgggcgcggtagggatgcgcagttttaaccgatggacgcagagcggcatggtgacgatggcgatgctccgtgtttcttggagggaaacgggagagcggttggaggccgggattcacggcggaagagcggcttggcgtggctcgagtttggcgtggtgcggcacatggaaacggtgcgacgcgggtgcggcgcggtgcatgggaggggtggatgcggcacatggcacaacgcgagcgcgggagtggcgcaggtgcggaggcatggcgcggcgcggcgtcgggtggtagcgagatcgatgcgatgcacgcggcacacgggagcagtgctgcaagggttgggaacgggatggatgcgttcctgatctgctgggctgggcctatgtcgaacaggtgtcgggcaatgaacagtggcggctaggaaaagagagaaaaggaagaaaagcgaaaggaaggaaagggaggggctaatctgcaaaagtgaatgggattggaatttgaattgagatgtaatatatatattttggttttgggaattcaaatatgtatttgaatatttacttatttccaaatgaatttgcattatattgggttactctataattaacttaaataattgctggctgtgatatagaattaatatatttccatagaatacattataagggtggtggtatatttactcaatttatttacatgaccaaatattttatatgagtgaatctattccatgagagactcaatgaacattataaatattaatataaatattccagtggaacgctcctttatatagggtcatcgtagtggcgattatttcatggttgcttagatgtcctgacacttgtcaacatggttcaagtatttaacattcaatttgtagtctgcattatagaaattaataattgacttgtactttattcggcttgctatcatgtgcacaaatatttataggattaataataattatcttattctaattactacttagttgtacagctttagcttaatcttcaatcgtgaaaattaatagtttggcaagcaatagcaaccataacatctagcatgatgcaaaagttctaaaaagtttaaaattttagtgatttttattgtcagaaattttcagggtgttacaacaatctactccttccgtccaaaaaaaggcaaaccctgggtttccgtgtctaactttaactgtccgtcttatatgaaatttttttataattcatatttttattgttgttagatgataaaacatgattaatactttgtgcgtgacttgtctttttaatttttttcataattttttcaaataagacgaacggtcaaacgttgggcacggaaaccagggtttgtctttttttgggacggagggagtaggatcataaggtgttggagaaggcttactatcaatgtagccaaagcgattcaagatcttctccacataatgggactgcaagaatgtaatcacattctcacctctaattagcttaatgtttaagataacatcagctactcccaaatccttcatatcaaaattttgagacaataatgatttaacctcatttatcacctcaaggtttgtcccaaatatcagtatgtcatcaacatacaagcacagaataactccctcacccccaccatagcgatagtacacacatttatctgcctcattgactgcaaagcctgaagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatctagctctccattaagaaaagctgtcttaacgtccatttgatgaacgagaagaccatgtgtggctgctagggaaagtagcacatgaactgtggtcaatctagcaacaggtgagtaagtgtcaatgaaatcttcgccttctttctgattatagcccttagcaacaagccgagccttgtacttttcaatagtaccgtcaggcctaagcttcttcttgaacacccacttgcaccccacaggtttacacccatagggtcgatttgtcacctcccaagtcccgttagcgataatggaatccatttcactacggacagtctccttccagtagtctgcatcaggagatgcatatgcttctgaaattgacttaggagtgtcatccacgaggtacacagtgaaatcatcaccaaaggacttagccgtcctttgtctcttactccttcgaggagcttcactgacatcctcctcaatgacatgtttatgtgtatgttcagtttgttctggttgtgtgattgaacggggaattacttcagagggttggctcgaactactatgtgtatccttcattgggaaaaagctctcaaagaaggtagcatcacgagactccataattgtaccaacatgcatgtcaggtacctcagatttaactattaaaaatctataggtaatgctgtaatgagcatatcccagaaagacacagtccacagtcttaggtcccaatttgcgcttcttcgttattggtatattgactttcgccaagcaccctcatgtgcttggtgaaagtgatggttttctcccaatccatatctcatatggtgttttgtccttatttctgttaggaactctatttaacaaatgattcgaggtcaacaatgcctcccccaccatgccttaggtagtcccgtggtgtccaacatgtcattcaccaagtcagtcagtgtgcggttattcctttcagcaatcccattagactcgggagaatagggaggcgtcctcttatgtatgatgtcatgttcctcacagaataagtcaaactcgtttgagaaaaactctccaccacgatcaaacctaagcctttttatctttttgtcaagttgattttcaacttctgccttataaattttcaaatagtctagagcctcgtctttcgttttcaacaagtacacatagcaaaatatagtagcatcatcaatcaacgtcatgaaatatcattttccacacttcgtcaacaccccattcatttcacaaagatctgaatgtaggagttctagtggtgccaagtttctctcctcgacagccttgtgaggcttgcgaggttgcttcgattgcacacaactatggcacttagaacctttgacagtgaagaacttaggaattaaacacatgctggaaagccgagacatcaagtcaaaattaatatgacataaacatgagtgccaaacattagcctcatcatccacactgccacaaatatggttcacagacttattgcagaaatcagaaagggaaaagcggaacagtcctccgcactcataacctttaccaataaaatatccatgtttagacacgactactttattacactcaaaaaccaacttaaattcgtctctagtctgacgggagccactaacaagattcctatcgatagaagggacatgctgcacgttcttcagctgcacgatctttcccgaagtaaacttcagatctaccgtgccaacaccatgaaaagaagcatgtgacccattccccattaggacgatggaaccccgtgcgacctgataagaagaaaacaataagatgtcagcacaaacatgtacattggccctagtatcaacccaccaattagtagactgattaactaaaaaaacagtaggtaaattactatacccgcctccatctccagtgttgc

SEQ ID NO: 15128 - DNA, 1408 bp, Oryza sativa
  unsure (1)..(1408): unsure at all n locations
ctcggcagaaacaactcacggttgcgggcgtcgatgaaggtgcgcagcacacgagcggagagtaaggcgagccgtcgcggacgaacagggagcagtcgcgtgaagcgtttcccaaaaaccttattaccgccttctcccggtgcaggacgtcgaaggcaaaggttccggagacctactctcccgatcgccggtgcacgccggcgagcgggatggagtagtctatgagcgacggcgcagtacagagtaagaggcaaaccctagattgatttcgcgtgtgttgcgtgaaggcggatcagggcgcccgcgtaaccgaaccggataagtcacgcgtaacttatccggactccacgccgttttcacgcaccggatttttcggaatccgaatttcccgcagcaaaacaaaactgcaaaaggaggctgcatctgcgcaagggtgaggatgccaattttgtggacaattcaacacgtatgtcgtgcacgcgcgccgcctgccaggccagcgagcgcgtgtgtatttcccttcttctctccaccacacatgcttcaagtggctaggagggtatcctcccttttaaggagatccccctctcctagaataagcaaggtggtactaaactccacatgcatgccatccgatgaggtgggcttttgtgatttttcaaagaattaatcttcgaatgggccttagcccatctattaattccaacacaataatgtactccctccttcccataattaagggattttagagggatgtcatatttcctaatctatgaatatagagataagcctatccagaatcatagtactggaaagtgttgcatccctccaaaatctaatatatttaataattaatattgcatgtttaacatattcacccatttagctattcaacatagaggaagatgagccgtgatggacgaatgtcgcaccgtgctttttcaaaaaccttattcacattctctaggttgtaggatcacaattacaacggattctagggacctattttcccaactaccagtgcaagccagcaagcgagaattccagcagcttgattaattatcaagtcaacacagcacatcacctatcgtgcgcgctctaataaaatgcaccattagcagatttatgttttttggtttcccacaagctagtttaattgggatatatcatagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15129 - DNA, 3225 bp, Oryza sativa
acagcaccggatcacgcgattccaccccaccgacgacgactcccttgcggtgagaggagatcctagtagtagaaagaaaccgcaagaaccccaagaatggcggacctggtggatgggcgggtacatggagttggtgcagacggggcactcgagcagctcgtggacgctcgtcgccggggggacggcgggggccccggccacgaccccgacccctcctcctcctccccccgcgccccctccgctgcccgcggagacgacgaccacgttgacggcggcggcggcggaggagggcttgacgaggatggggcgtggcaggtgggagacgccgccgacgccgacgccatcgtcgtcgtcgtcatccatgctgtcggagtaggagacgcactcgatgctcgccatgtccatggccacagatcgaacccgaattcagctctcagctcagccccccgcccgccggccgcgagcccgccggggcagggggagtcgatcgggtcgaaccctcgtcggaggcggagggtgatccgccgcgattccgattagcggcggcggatggggatttggaattggatttggagaggaggggattgttgcgttagcgtttgggttgcggggtggtgtggtttggtggtgggggcggtcgattgacgggtgtaatggtggtgtggtggtgcgggggaattgggtgggggtggcttgtaattacgtttttcttttgcttgtgcgcttttttagcgacgaggggaggggattcgattttatataaccaaacaaacaacaaaaaagcgtggtgatgatgcggggggagtgcggatgaggtgggggtgcggcgaatgttcaaattttaaactgacgagggaggggagcggtggcgttggcgtggtggcaaggctggccggctccgtatgctgctttgctgctggctgcaaatgcgatgctactacttctggtacatgtggcattcattcaaagcctgcagcagcattcgattctcgtgctactttgacagtctctgagtactagtacggcactactagtaaaaaagaaggaaatatatactgtcacggtccttcaacaatcgaactattcgtcctaaaagggatcaatttgtactaggaccggccttcttcaacccattttacgtttgaccactcgtcttatttaaatttttttttacaaatataaaaaacgaaaagttacgcttaaagtactgtagataataaagtaagttacaaataaaataaataataattttaaaaaaaattgaataagacgagtggtcaaatgttacaagtaaaaactcaaaatccattatattatgggacagagggagtagcaatcaaacattcaaacctcttctctgctctttgcactgaggtaagcattcaaatttttgtttagttccaaaataattcttcaaccttcctaactttttcagcacaatttttttacacacacaaactttcaactttttgtcgtatcattccaatttcaaccaaacttttaaaattttgatgtgaactaaacacagcctaggaatgaaaagggatcaatttgtattaggaataaatatgaatgaaggagtacgtgccgagagatggagtgcagatgataccaggattctacgagtatatgcggagaacatgaacaagcgaaggtctctcttctcttcttttctggtctgtcaccggcacattgctcacccacgagagccgtggtcgggtgagcgtgcctacacgtttaccagaataacaggcgggcgtggaccaaccatactgtacaagagattacccctagaaaaaaaaatatggttattatcaactttacaaagagaccaagaaaccggtaccgtcgtcattaccagaccaggtatggcggccagtttctttcaatgattttcctttttccaaatgatcaggactttttcgacataaaatgatgagaactttgaacacatgcttgctgcttaacctcccctgccaaagatgcaataacactagtaactgcacctgatcagtgtcccgacaatatattgccagtaatcataatgcatcgctcgacaggttccttccaggaaatgaacaggaggcttggaacttcatcatggccatgagaatctattcccctttaccttttctttttaaaaaaatgtcacagaaagggaaggttttgatcgccaagagaaattgcacccccgacatggaccttatacatgaatgtatgaggaggatgactttacatttgaattggctacagttacatggccgataacaagttatatacataattactgttgtcaggaatccctacatgctggccactctagaaggggcttctgtatcaatgtcaggttctccatccaccttctccgaccgtcgtagctgaaacgtaaatcttttaggagcgtacaaataagtgaagatggagaccaaccagaaatacaaaggctggtcttactaattaaacaatacgacacataccatgataagtgatgcaactgtttgcttgttctcccaaaaaatatactatatacatatcaatcgttgtctctactgaaaaatcaggagtgatgaagaaaactgataaacatgatgtattaaatattacttgaataagttcatcaccactagcatgtaaggctcaaggggaatgtaacgactgattggttctttaacattttcaacgtatatttctaccagtaactagaagtcatctttaggtattctgaggtgaacaggccagcaggggaattcacaaaataaactagccaataaaaactgctgaattagcatgcctctaatgtctgcaaccccatgtctagccactgaaatataacaggagcaacattaaatgctgcatcccatatctaaataatagtgctaaacggtcaagtgcacataagaaagacttttgaggtaacatcgtgtatggaaaaatgatgatgatgctcaccgttgattctttattatgttcatccaagtaaaggtccaatgctccttctccacaaagaatcttggctccagaaccatgctgatttgtagatccaacagagtcttcgtcaacaacaaccgcgtctattttgtcttttccagttcgtatttctggaatctgtaaaaaaaataatgttcattacaatggtttaagtaacaacaggacttttgacatagtaaaactgaaaaaaaaaacctactcaaacaatgtaatggaaccaacggacaaccaaaagtg

SEQ ID NO: 15130 - DNA, 2103 bp, Oryza sativa
agtataaggaaataaacttgaatgttgccaagtaaacttgaacctgcagtgaataaatgtattaagaaagtacaattaatttatgtacgtaggacctattatatatcgcacttcacagacagataatgcctaatggagtatatagccagtgtttttcaaaatcaagctgtatggacaatgtgcaaaacttttgcggtcacaaggcaaaaatacagtgattgtattttggtaaaaccataaaacaaagtcaactaactggccagtaactgaagtatgtctcatcaactgaaaattatggcagcatgcgaaccaatttttgtttgtggcagatgatggcacatcttacccgaaaattatggtagagttgataaaaaaaatatgcatgacaccaagaaccaatctgaacatactactaaaatacttcttggataaatgcttaaaaggtacgcagaaaccttgaagaaagcaggatagccaataaaaattggcagtctgtgattggaacaataataaataataaattgaagcaacatgtgccctttgacagaaagaacaattaaagagacacagcacatgcatgcatcgcaagttacctcaacaagttggtcttcactaagggaagatagactaacaagaatgggaaatctaccaacaaattctgggatcaatccatatgcaatgagatcaccactttcaacctgcatatatttcgacaaagtaagaaccctaaatatttcaaaggattctaagcatgacaagtcacaaaaccaagtatatgcattcttctacttgatcactcactgattcgagtaacgaggatgtgatctcagcatttatcacacccccagtccgcatatttgaacgaattggtgcttggaaaccaatggaagaatcatgtctcctattaaagattcgggtgaaacatataataagaaaactcgaaagactttcagcgtaaaacataaatgatgcaggatattgaaacctttccgaaatagtcttctccaaatcaacaaaagcaccaccacaaatgaagagaatgttttttgtatcaatctgcattgcaaaacaaaacagcataaaaccatattaaatagtttaacaagaacatatgaaggttctagttgtgcaaaagccaactggttgacactattttaggtatgtaaataaatattttcgtttacatgacatagttaaaaggggcaatgagaatttccattattatattgcactgcattaaacatggagggcaaaagtgttgctcgaaaagatgttcatagtagtaaagtgaagaaaactaataaaaacaaagcatcttttctacagattgcagagcaagcacacaaggtatcaaaaaacaaatggtctatttccagacaacagataattcaactcagggaattcactatcttctactagatgcaaggaataaaacagaggttctctgatgtcagacaaatatgaaatagatagcaatatggcaaaattggttcataggatacctggatattgtcaccccttgggtgccttctagcccctttctcaggaacactaacgacctatcttgacagcataaaagcaattgtaagaagatcagtaattaaaaaccttatgcgtcatcagtttttaaaaatactaaaataatcaagggtgctatcccataaataactaacatggtaacacttagattttcaaagagattaatctatgcctatcagcaaaattgaaggaaagagcagctttacgaactctatgacagatacaatgaggaggccaagaacagtttattgaccagtaagtatgctgatctttgtggcttaatccatgttgaactacggaattgtatggtcaacattttcataaactagcaaaataacttagctagagtaagtgataacgataaaaattttaaaaagaagcgcaagaaaaccccttaaatagacttctggttactccatttaaattaaatatattgatactggcgctcgcaatagattttacatgatcagaggcaaataagttattgcctcaatggtttggattggacaatttaatgtgttttgcaggttccacccatgcatacatggctggagaatcaaaagg

SEQ ID NO: 15131 - DNA, 2140 bp, Oryza sativa
ctgttagctaagtcacaacacacatgaaatctttcttagagaactaaaaggacataaatatcttatctgagtacatccagttctatggtcaataaaacacaaaatttagaattttcaggcaacggtgtcattacaacttttcttaattaccataactgccaacattaaaaaaatagtcatatccaaatttctatcttacaatttgcatttccccccagggtcagggcgaccttgtttaactcatttcaccctttttgtaccataagagcttgtgacttggaggcaaattcgaatgtcgaatatgggttgtctccactttgaaatatcatattgttatagtggctttcaagattttttatagttttgtttcaattcttcacatatttaggcactcagtagagaataagagggataaattatatgtcttaacagtttaacacttgcgctaatggtagaagaaaaatcataaggttctctaagcaactattgcaatacatgcaagtgaaaaggaaagactatataggccacaatgtcagtacacagaaattaaccataccgctaggagcttatacaggatagattcaacatcctcgccaacatatccagcctacaattggaaaaacatggttaaagaaaaggtgaactcctgagcaccagcatgagcacttattaaatcaagctgctatacgacgctctcaaacaaaagcattgcattttccagactacgattaagtactctattggtctatttaaaatatgccacctaagaacacagcacccataataaaaagtaatgttacagcaaaaagaatctttagaacacatgtatggctatgagtatactaagcactttatgcccaagaaagtaatgaaaacgtgtacaatacaataattacataaaagagtataaagcacatatcatatatacatggatccaactggtaccataattttgggaaatcttatgatattgctcccccttacagtaaagccaggaatggataaaaattggatgctatatcaggagaagaggaaaaatgcaaaagttaatgaattgataaattaagataattcatctaacctgagtgagggttgttgcatcagctataacaaatggcacattcacaaaccttgcaagggtttttgccagcaatgttttccctgactttgggaaaagattttagaatcatataagtaaaacattcatttgataagaaataaataatatctaccatcatcttattcgttgaatagaaaatggtctacatgagagagataaagtacagatgtaatactattgcatggtctgtaaaagaaagaagtgatgattcaaatgaaaaaccaaccatcaactagtgctatattaagaagtttccaaatgcggtctcatgtgctggcacctggcaatttggtgtgatcggaagtgtttctacaatatattaaagtttataccatatcattattaataatatgcatgcctactattgatcataaaaaatactagtattcatttagacaagaatatttttatagtgcacacgagttctccattgagacaatttttcattatgtgttacaaatattgcagcatacagcactaatagattgaatgattggagcatgtacccgagcctgtcggacccatcacaaggatgttgcttttctcaagctccactccatcagtatcactcgcgcaagaatcagtctcgctacaatctccagcagacctacagtttgaatccaatttaccacctgaaactacccatacgcaggacgcagcaagtctggcaaaactggtatttacacaacaccaacctgctggagagtaactcgcagtgtatccttttatagtggttataaactgctacagacagtacctgccaaaagacaaaaacaagtttattgtttcgatttaccggacaaaagcacataagagtcactacaatcgcataagtgtaaggctataagcagcgacgacgtaaacctctagcctacaaaactagaataagaaatcccattaggcacaaactacacccacccatacactatcaacactgttttgcagtaccaagtgaggctgaatccctaatccaaattaagacaactccactcagagtggaacgcacagagaaacagcata

SEQ ID NO: 15132 - DNA, 9084 bp, Oryza sativa
tatcgatcaataaacatatgatagaacttataaaaatcatattcatccacatcaatatttatgaaaagtttgtagctattttactttacatgtaagagtattagctttttctgacggtgagaaattggcttgtgggaatctgccaacttctgagttctaattaattttctatatttttctcagaatttaactgataatttaaactatgtagggaaacttgagattttaggagaacctccagtgtatggttaaaatcaaaccgtgcataaaaaaaatcgaacagaccatgctgtgaaagtcggctggtaagtgtccggaggaaaacatgttctttaaagagaagccgaacacaaccagttaaaaaaatatttgttgcgcacggctatcagactgtgattcttttttcgcatgggtcccacaatcgatttttacactgtgatggttaaagagaacttttgttcggctttcatggaagtgctagtcgaactaaacactataggtgccctaacagaaggtgaagctgttagagccgatataataggatgttttagcggcgatactgtatgtatcctaccaaatatgctgagttggctgagaattagcagagagagaaagagagtgtgtgtgagccggcgactaatttgtcgctgactacacacacgctccaagacaatggatgcagcaccatgactgcttctactggaacacgcaagcaagcacatgggcgatttcgatgttcgacggcaaaaggggcggagcgacgggcgaaatgatgcagcgggaggaaagctcgatggcgacgcgattgagagctaacagagaagtgagttcgttggcggcaatgccgacggaagccgggaggtcgaggatagggacagctttgttggcgatgacgccgacgaaagccgcgagcccgagtacggcaacaacgttggtgacgcgagtggcgacgggagctatgagcttgagggcgatgaccagagggacgatagttctacgttctccatgctccatggagcaagcggctcaatgcagctgcctgttgtcccaccccgcccgcactccacgcttttgctacgattcgctcgctggcagtcatctagccatggcaccagctctatgtccatccatctttgctagctgcttgcaacctgcatatctccataacaatagatagatcaaataagaggtggaaactagaaagggagttgtagcaagctagaagatggattggacatgaagatcgatgggaactgtgtacggttagggcagtagcagtgcgtcccacaaaagtgaggagcccatatgtccacataggagaaaaccccggaaaaaggagtcgaagcacctctcttcacagtgcgggcacgcgtagtgtagctttaggtggaccccatcaatttattttcctgaggccgaccccaccacgacgtttctcttcatcttcccggatcaatctctcctgcaccaaaccaacctccgctccttcccctctctctcttcctctccctccctgaactggcacatgacatcaactcccctccccctactctcctcgtcagggtggaatttgtggacgtgggtgcctccctccccctaccgtgacggacacttggcgacgacgaacttggcgctccgggtggctcaaatcgagagccggcgtgggcggcgaggtccgggtggctcggatcaaggggcggcgcggccaacgagctccaggcggctcagatcaagaggcgcggccaacgagctctccggccccacgccgcttttcctccgccgcaccatttctccctcctccccatccgacggcgcatcgatgcagacagagctggacgggagcaatgattctagcgcgggaacaaagatgcagagcgagggagcagaggattgaagctacgacctccacagcgcagacgcgaggtgattccctgtgtcacgcgtcctcctttcgacgagaaaactcattgcccagatagggggtgggcgactaaacagagtaccatgcttcgtcaccacatatgcgcgggtccgacgtggtgtgcgagataacgctccagctcaccacactgaaaaggccttagaagaatactccatccgtttcagattataagacattttgactttgttcaaagttaaactattttaagtttgacgaagtttatagacaaatacagtaatatttaaaataccaaattagtttcattaaatcaataattgaatatgttttcataataatttgtcttaggttgaaaatgttatttttttctacaaatttaatttaatttaaagcaatttgactttagttaaagtcaaaatgtcttataaatgtaacagagggagtatatgcttactatatgaactagcaaaatgtccgtgcttcgctacggtattaaccaaagttattttcacactgttttggtactttttcttgctagaaaaagtctcaaatgatatagagaaatatagtagctcataataaattattgaatgtttgcttgctataaaaaatctcaaatgatacatagaaatatagtagctcataataaattattattcaatagtgcgttgcaacgggaaaaaactaatgttattaagttagtaaatttatagaaaaaagagcatccacgttagctcttatggtctagaaattctcatattaattggagtaaaatataaaaaataaggagaacttattgtagacaaggactctttcattttttttaaaaaaaatcgcgttgtccaatcataaataatattggatgaggagtctagaatattctccaaaagcgcctagagtgcatataggaatacaatttagaaaaaaaaaattaaaattcaaaataaaaaatattgaaagaagagtttaaagtccatatagaaaactaattagaacaataaaaaataggaatattggaagaagaatagagttcatatagaattaaaaataattgaaattatttaattttagtctaaatttaaattctatatcatgagaaataaataattgcatttttagttgaaaaataaatagaaaaatctagccaaatttttagtttattgaatttagttggaattaaattaataagcagtcataaacaattaaaatggtattaatgctatttcttaaaatagaaagatgcttaaaattactgagagagaaaacattgattttaattgtgggctatttggaggcccaataatgcggaggcccaatagtccggtggtccgatgcgggagaagccggagtcgttctatcgaatggactgtccagattgaaccaatataaatatatgcagcaaaaccctaaccctaaaattcttcccccctccccacttccaatctcctttctctctctctatctctctctctctcttgatcgaaaacttacggcaacagcggtgacctccgccaccgaacagcgacggcggcgccctcctcccccccacccacgagcggctgcggtgcgctcttccctccttcccacgagcggcggaggcggcggctccctctgtcccgtctcgcctccctcgccggcagccgctccctccgccctgtctcgcctccctcgcccctcctcctctccatctcgcctccctcctgtggtggatacggcggtgatggcggcgggttggcagtggccgcgagcggattcgagggtggtggcggcggatccctccaccccctctagcctccctcccgtggcatatccgccggcgatggccgcgggcggatccagcggtggcggctccctccccctacccgccttcctcctgcggcagatccggtgtcggtggcgtccgtggtcggataaggagcggcggctccctccgccgcaactcttctccctccggcgacggtagcggggttggcggcggccgaagatggatccggcggcggtggcaacggccgagggcggatccggcggcaggcgagtgaagttttgtgatgtatattgttgttcttctttttgatgtatatttttgtgaagttttgtgatgtattttgtgatgagtgtggttgattttttttttgcaaagagtggttgagttttggttgtgccgattttgggaagtgtttccatgtttctgattctaagagcgattgggattcgggggctacgaaggcgcaccgccgacggacgaagacaccttcgtccgtcttgtgatgaacggaaaattacgaatattttaattagttaagatatactccctccgtttctaaatatttaacaccgttgactttttagcacatatttgaccgttcgtcttattaaaaacttttgtaaaatatgtaaaactataagtatacatataaatatatttaaaaatgaatcaaatgatagaaaaaaatgcgtcagatatttagaaatggagggactatatacacagcaagcagactgcagaagcagaggagacgtgtgtagatccctctccctgatggcttcatcaaagtccgtgtgtaggccgccctggacaaaacggagtccgcgacgtgcgtggcccacgcgacgttccacctgggcctcgatctgtatgtgtgggccttcatatgttgagcccattaatttgtttttgcttgggctcagttgcctgaagaacactcggatgaatcggagagcgcacgaggaaaaattagcgcgattaatgacggacgaaagcacgcaatcacagatgtgacgaaaggaattatatgaatcatttaatttaattagttaaaattggtagtttttaacgctacctataataagctgatgtgccaatcttggagccagttgcactatctcgctcttaaaaccgagcggccgagcgtaaactagcctcaaacaaaccgacctggacacgtcgacacgatcacatggtccatcatcctgggcccacaagtcatagagccaacgaacttcaattcagccatccccaacaaatcgcatcgttactcctcttcctctgcctgccgcccccaatcgccggcgatgccgcgccccgccgcctcctcctccagccgccctccgccggaaggcgagccggcctcgagccgcgcgacctcctctgcggagtcctccatcgcgtccctcatcgaccgcgccacctccaccacctccccctccgtcgacccggccctcctccgcgccatcaagtccgccgcccgcgcctccgacggcgccatccgcgacgccttccggatcctcctctccctcatgtccaagccccacgcccacgtgagtaagctcctccctgctggtttgattcccttgccgaattcgcccaaaccctaactcgcccaatcttcaggtgcggctgctcgcgttcatcatcgccgacgagctcttcatgcgctcgaagctcttccgctccctgctgaccgacgtgctggacggcttcctcccgctcgccgtcggcttccgccgcgcccacccgctcccgccgcccgctgcctccgcgaccctgctccgcaaggccgccgtccaggcgctcgagcgctggcaccacctgttcggcgcgcactaccgccagctccgcctcgccgtcgagtacctcaaggagtccgcccgggtccagttccccggcctccgtgccgccgtcgaggctcgtgccgcgcgggaggctcgcacgcaggagatcttaactgcaaaggtcgagcagttgcgccgaaacctggcagcgattaaggctgaaatccgctccgcgattgatgagatccgcaatgggttggatatcattcgcatcgagagtgaaaaatttaacaattatgcaaatgatgaggatgaggagcaggagattgcctctttggcgatgcggagtattaggatggcttctttgatggctggggagtgggttcctgagactcaggagaatgaagcagttttcgacgcgttgagggagtcatatcggctccttgtgtcaaagcatttggtcacagttcaggaatggatatctgtgctggttagggtcaatctcgcagataatcgtttcagagattctgctttgaaggaattcattgatgttaagaatgaaatacgagcggtgagaaatcggtgtagtgagcttggtcttaatcttgacaatgtccataggcggaagggtgttcaggaggaagaggatgatgacttttgggttgaggggaatattgaggttcctagccctggtagagtaggtaccagtgcagatgttgcaagtagcagcaaggacactagaaagggaaagaagccagtaggtggcacggatactgatgatggcaaggcacctaatgctggcaatagtcctcaagagctggatccagagagggcaaagctgcatgcagaagcccctgtgctgccatggagctctgttttggatcgttggggttctaacagggatgcacttgtaaaccaaaggggacttgagctcgagagccattggggaagggtggataatgatgctgttatacctgctgcaaagattgcagaattaaatgttcatagttcaatatatagagaagatccagttgagattctaccatgccttgcacctctgaagaaaggaggcctttgccagagaagagatctcaagatatgcccgtttcatgggcctattgttccacgagatgccgaaggaaatccaattcatcagagtgatggccattgtgatgcagaaggaaatccagttgggcagactgatggccattatgatgcagcagtaagtcctattgatccgaatgaagacagttctgatgtaagagaaaatatgattatgccagatggaagcagtgatggtgaatgtatttatgagtcctctccttcaagaacggcaaacataaataatgacattagcgacagcgatgtaggtcatgacctcggtaaaattacagtggagcagttggcgagacaggcagtgcagaatgtccggaaaagagacagggatgacaaaaaagctctggaaaaagcccaacgagcgagaattcgtcagcataatcaagatgttttgcgggaagcggctcttgcttcaacctcgcgctcagcggcagactatgacctcccttcgccagcagtgtctcgacggggacgccgaggtaagacaaagggaccaacactggcatcgatgctgaagaagaaagttacttccaaagatagaattgcagagaggcttctgaatgctcgagctagggatgcgacaataagagaagtttcacatactgaagatatgagctacagagaagcattcccaaatcaatggtagtataagaagcctaatttttgctgaataggttggtgaatcgtcatgataagagtgaatcaataattctttctgtgcgcagttttcagttaaccacatgtcttcttgagttgcccagatacaagtaaaattgtaggttttcattgtgaagtttagtttttgtacagtacagtagattgaataagtttcttttatttcttttgcatgttcattttccctttgtaaacatgtatatgtaccactccatacttgctggattaataactatatacgctgaggctgcagttcaaattgtgttattttatctgagtaatattgtggattaattaatattgcggttttatatggttcaagacttcaagttgctggtgcaactcgtgacctcaggttttacagaaaaaacaaggaacgaccgttgttgcataatagatgtaacatgttattttcacccatacatgttagcatatattcgctacttcctctcatagaaatacgatttgttgtactagattgtgttatattcttacttaaattgtttttttttttggacggaggaagaacagaaaaccgtttggaaagattagaaagcgctcttctgatcaatcagcacacctatctctaaaagcatacagagagtaattccactccacagtgcacttatgcctcgaatggaacagcgcaaagcaacgatgaacctctgcacatactcactccgcttcataatgtaaaactttctagcattgcccatgttcttatttgacacatatatataacatagttgctaacacattgcacaatgttattatttttcacacattactaacctaattagtacatagttatatacacattcacttacagaaatacacatatacacagttgctaagtacatcacatggttcagatcgataaacagaaattacctgtgttcagaacgattagaaacgctcttatctgaaccaggcacacgtaaccaaagctaagaacttgcagagatttccattccagagagccgcttatgcctcgaatggaatttaacaaacacaaatctagcaaaagcaatatacacctgcacatcatcatcacatacacaaattaacctaccaaactggacacacacacacacacacacacacacacacacacacacacacacacacacacacatatatatatatatatatatatatatatatatatatatatatatatatatatatatatatatatatctatctatgtaaccccagattcaaatccaacgtctcgttcgagccgccgtcttggaggttcttacgcgccaatggaggcggcaggttcaggttgaggtccagcgcggtggcggcggtcgccggcgccggcggaggtgatgccgacgtggtagtggtactactgctgccggcggtggagacggcgagcatcgatatcgcctgatcggcacaggaacgatccggccagtggcaccgcttgtggccgccgagcgcctggccggtggcgaacccgcggtggcagacggcgcacttgtggtcggcgcaggttgccggggaatgatgaggagcagcggcggcggcgggggcgagaaggcgcttcttgcccttgcccttgccggcgccggagcgggcggggtgagcgccggacagcatgaggaggctggcggcgacctcgcgctccctgagcgtgaactggctggcggcggtagacgacgccgcgcctgcgccgccaccgccagggggcgtgatcccgcgccagtggcgctcggggtggcagcgcatgtggccgaacagcgccttccacgagaggaactgcctgccgcactcggtgcacggcggcgcgtccccggtcggcgacgagcacttggcccgcgccaccatgg

SEQ ID NO: 15133 - DNA, 4733 bp, Oryza sativa
tgctgtgtaactgtgttgtgactcacatgctcgtttagatcaggctgtgtttatttcacactaaaattggagtagaagtttggttgaaattggaacgatgtgatgaaaaagttagaagtttgtgtgtgtaggaaagttttgaagtgatgaaaaagttgaaagtttgaagaaaaattttgcaactaaacacgggcttagtactccctccctttattcgttttgattttgattaaaatcaaattgctttaaatttaattaagtttgtattaaaaaaataaatgttttcatcccaaaatatatttaattactagaaaaaatacccgtgcgttgcaacgggtgaatgctattttagtcttattattgttatacggtttagctatgatgaaatttaatgtgggaatttgcttgtatattcttttttaagaaaatcatgagctacaattagaagtccgactttcatctcaagttttatgtaagtttttttaaaagaatatttccaaaagcaaatgaagttaaaatccaactcatacacgaatcttaaaccgtatgaaccgttggatctgcatttccaaaagcaaacgaacttaaaaaatcaactcaaatacggatgacataccaaaaagtaaaacctcttcaatttttataatagtagagatagctttaataaaacaaaaagtaaattgcatcgtcggtacacaaacttgtcaggtgggtgcaatctagtacacaaacttgtaaaattctcgtctttgtgcatgaacttgtctattgcgtgcggaggaaggcgaaaaagacactatatggataatcttattgatttagggcatatatttgagaaggttgctattagagatgtacctcttcaataaaaaaaatagaataggatatagtgatagcagaaaaagattaaaagacgagcaatgatataaatgttagaaatatatgaaattcatcatttccatgatgaaggatacaatatagaccaaatttataaatattgaatgtcttatgcatactcactacacgtatgcacgtcacatcctaatcaacgtcaacttcgtaaaattaacattgccaacatattttggtcctcattcgcacaaactagacaagtttatatactgaaacgagcattttacaagtttatgtactgaattgcacccaccaaaatagtttgtgtaccaccaatacaatttactcaaatttagatcaaaatcaaaacgactttgtaatccgaaacagatggttgtaatctgaaacggattgagtaatacctaatcagcctaaaaggctggggggccggcccttcagattcttctctcgtgatgggccgtagtaggcctgatgggacacatgcccaatcttttcggataggcccaatctgatttgtatctttttggttaatttttttcagtttatcacttgatgaattcataaatcagaaggttaaattggatccgtgaaaagaagaaaacaaaagtgaaagcgaatgtatttttgtagtcgaaaatcgtttctatatttgcatatcaaatttgggttgcgtgttcatggagggacaccggacacgcgatgaaatcatctgcgcatcctgtactttcaatttttcctgtgtcatccaataaaaaaaactaattcaaacaaggaaaaccaagtgttgaaacatggtaaatgatttaccgttggatcgaccgatcccgttctctcacttcaacagccatatatattatattaggcccatccacgaacaaatcgaaccgtcgaagtgactctgtagccccgtaactggaaatgaattcatattcagatttgctagtcctcacggccgcacgctctcgcatcctcgcgtttcatcctcctgtccgtgctgtggatggactcaatgtttttgttcattgtttctcggtaaaatttctgcaattttgtttgagaattcaaattttgtttgaaaattttcgtgatttcgctgacccccgaaatttttcccatttccgataggttgaaccattttgatcttcaagactccaactcgtactcggtttgtagcccatctccgactcggattacacgtaggcgcgcgcctatttatagctgctgccctgcccgtctccttactccattagcttgctagcgcgcggcacaagagcagtaagcgaggcgcgcatggcggcgcgcgccggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggcgctgaggtcgccgcgccgccgccgccgccgtgtacgggagcctcccgagatcgtctcggcggcgccggcggttgactgctggcatgagcccgatcagatcgaggaggaagaagaagatgacgatgatgcccgggaggagcgcagagcgaggataagggagagggcgctgctcctgaggcagcatgaggaggagcagcttcttcttcatcatcatcaccagcggcatcaggaggatgaggcggcgtctgagtccgacgagacggcggcggaatcggactcggacgacgagcagatggccgtcgtctacatggccgcgcccctgttcgtccccaagtcacagcgcgacaccatccggctcagggaggaagaacagcatcggcagcgccggcggcttgagctggagctggacaagaagaggctcgaggacaggaaggctcagacgaggcggatcctgctccaagagatcatcaaagaagagctcctcgccgccaccacagcttcggccgaagccgaagccgccatcgacggcgtggacaccgacgacgaggtggaccaagccgaggagcacgagtcgtggcggcgccgggaggcggcgagggtcaagaggagcagggaggagagcggcatcgacgagaacccggtcgctgatgatcgtcccaagaagatgacgatcaagaagcagatgaggttcatgcggaggtactaccacaagggttgcttcttccaagacgacgccgacggcgcggcgcagacggccgccggagcatgcgaaatctaccggcgagatttctccgggccgactgggttggacaagatggacgtgagcgtcttgcccaaggtgatgcaggttaagcactttgggcggcgtgggggaagaaagtggacgcatctagttaacgaggacaccacgtacaggaactatagctagcctagagtagactgattttaaggttccttagaagatgggtactccctccgtttcacatctattcattaacatcaatacgaaagtgggaaatgttaaaataacttacattgtgaaacggagtaagtagtatttatccccacaattttgtgaagatgtgagcagtggcaagtttgttttttttctttgctccttgcagtgtaaattgttttggcttgtctatgctttgtattgcatttgcattcataaatcaaacatgaaaagttggtatatctaagcaatgttcagaataataagaactactccagtagtaaaaaatttctagttaacctagatatctcacttgaacttatcactaagtttactaccttaattaaattggtcacaatggtcagatttaaattaaattaaattaaacagcagctgcacataattttcagtgttaaaccttttatagtagtgcataaattgcagtacccaccaaagaaaaaaacataggattgaacaacattggttcaaagggagtgttcacctaagatagttgcgctatctctagcgagttttcctaaccgtagttgctacaaaccaatccttcacttcaaacaatccgttgattgcctcattttactcgtagtattatcatcagaggcacaagtcctcccaggtgtgtatattgggaattgaagcaaacttgacagtaaattgtaaaacacgaacgaattctatggcaagaaaaaaaatatcattcagaatttcatatgagccctaaaacacgtgtagcaggtttgcagagtgacagaacagaagggtaaaatttccagtactaatttcccgttaagagaagcttgattgcttcatctgtgcctccccacttttgcacgcaggttgaaacacgtgtggcctgcaaatggcagaatgaagatgagcgaggtttagatttaggtgcccacgaaaactaggcaggtcgaaacaaattagtaacagagtatggtattgaccattcacttacaaaactgaaaaaagttcgatgacaaagtaatttacatttaatttataaccatagtataaatgctttgcaatgtaatacctggtggcagtgacatgattttgcagtgtcctagataaaagtcacgaaactagagtgctcggttgcaattttttttggcctaaaagtatctatgtacgaggatcctgagacattttgatttaatgactaactaaaagcaaaggtattatgacagtgtttcacttccaggactaactgagctatctgttttatttccatatccgagttatctgtttttcatttttgtatccaaagaaaaataaaaattgaaattgtgacaaaaaaaaaaactaagcaatctgttttatttccatatccaagctatctgcttttctatgtgtaagtgcagactataccaggattcacaattttcgaatgccaaaagaaaaaaaatcagggcactgaaattcagaaattt

SEQ ID NO: 15134 - DNA, 5338 bp, Oryza sativa
  unsure (1)..(5338): unsure at all n locations
atcacttggatttgactagttgatgacctaggcaccgcctaggcgtcaattagacattaggcgccacccagccgctgagccgcctgactaaagcccaccaccttcttgagccatggggaaatgtttactgtccagatttatttctgaacaaagagattctcataacagttcaccggttccaatctattcagataaaacaatgcatcgtgcgtataccaaaaatatgcatttatcctattgacttctcacaataatcaggtaagagatgtcttgaaatacagatatgtacaagctgttatctagttctccagcagccctgctccagttaatttattgtatctccaccaagcatgagagttttttttcccttgtaacaaagtcatgacaatgatgactaacaaaaatgcgagtgagtttctctagtgatttagatatgctgatgccaaaatattttttgttgtggtgattgtaacagacagtaaagcatcaaaatctgacaaattaactatcatttctagctaaagtccctcaagaatggacatttatataggtgaaccatattagtgcattgttccctactagctacataaatgggattttaacttcacatcgattgttccactagtgcttgagggtgggatgcaaattttgcctatcatcattgaaacagtagcataggctgggattacgtatttttagaaaagacatgcgacttatgattatggcattgaaaagaagacctttggtttaaacagtatgggcaatcatgaggtaaatcaacttggatatcaaacttttcatcaattttattttgtacaattacctcactacagaagtagcagaatcatcatatatcatcacttgattatgcaaatcatctcgagggaaaccttgtcgaatcactctggttcatgtgttttgatcaatgctgggaagattggtggccaaaccatcatgaaggggtatatctcaaatagaaaatcatccttcattgccatctcatacaccttctccactgtcctgctgataatatccatgcaaaagacctcaccatccacctccaagaacacaaactcagcgttgtccccagacccaggcagactaatgcgtgaatcccctgactcccaactaggcttcacaagatgaccaaacacctcgcgcaaacaaatagtatttactagattccaatcggcagagctgtttccatctgttccgtgaagccaaacatggatcttaaacccctccacatggatcagataaagcccagatttctccgcttgcgacagcttaacgctcagctgaaagctttcagggcagtcatctcgcacggcatcggggacctcgatgaagaacaagctcatggacaccaattccaatccaagaatgtaccctgttgtgcccaacatatacagcttgccattgacaagaaaaccccggctcaatgatctcctccagtgcgccggtagctcaatgggcgccgaggtttgcgcgacgtcccagaccccagctcgcaagatcttctccaccttggcgaagacctcccgctcgctgctcaccagggtcaccacggtgcacgccacggcatcgccatcgccatcgccaccgtcctcggggaggaggatataccgcgtgtggcgctggttgggcgggagagggcgaggcggcgtgcggaaggtggagatgaccgccccgtcgctcgccggatggagcgggcggcggagctggagcgtggactcgccgccgcccctgtggcacacgaggaggcggccgttccggcagcagtagatccccgtgccgaggtggaagtggaggtcggcggcggtgcccaggtcgaagctgccgcggcggacgacggcggcgagctcgggcgggtgggggaggggcaccaagcgcgggcgcgggaggctggcgctgtcgacgtaaaaacccaagaaggcggggcgggtggaggacggccaagcggcggaggaaggcccggtcggaggcgtggcggagccagcgcctgcagacgagcgcggcgcggacgaggaaggtggggtgggcgaggcggaggaggatctcgcggaggaggtccccgtcgtcgagcaccgaggaggaggaggaggaggcggcggaggaggccaccggcggcggcggcgacggctggggagggcgcgggcgcttgcgatccatgtggacgcggttttgggtggatcgtggggtaattaccaacaaatggagacttgggagacctcccgttcatttggggatgtaaatcgaaatcttgatttgtcctttcgatggaaaatccatcatcatttaccccatccagagtgctaaggttagtctattcggagcattgcggtaccaaataaaagtattttactttgttctaaaataaaaaaaaagaagtaaaataattatttttccttagagattgctattatatgatatctcatcccaggtcggtatggtaccatctgggtactgaagttatgtatgttatggtatagtgtcattaccagacctgatttgaaagagggagagatcgactctccaactcggtggctaccctcctatccgacgacagcgtctccctacctacctgtagccaccatcgtcaaatccagccaagcctagatcatcgaagtcgagtctaggctaagacagacaacgacgagatctggcatccttgagtttgggacgtaccaaattcggtggctagaaagtttgggttgtagatccatcacggattggcaacagagagggcgtgatgttaggggcttcggccaccttcgggatgtgcaggggcccaggtggagtggagctttgagacggcaacgcagttcactgatcggctaagaagccatggcacacacaggtctagtcaagtttaccttcccacaacacacacgcagcactaaggttcctgtggcaactgaactaggattcaaagccaggatgagtggatctaccactccaagccctttcctattcttatactaatatatgtaagttccttgcatttagaactagaacgtgaggcatagtaatggcgcatgtgtgatattttattgatcatatttaggctgctttaggaaagcagtcaagcgggaatggaaaaaatgtcttctactgctatcttatgtgctaaaatggaaaaaatcttctcttcttctctatgtcactcatcacagtcggagagacccatgagactttcttttctcccggtaggctctagcgctacaatgcttatggctgcaatccaaatagcaatggtcctcgcggatttatgtgcacccaatccattaaggattcctggtagtgagattcctctagtcaagtctaaggattaaatatgagggatttcatccagtccattgcggaatgtatggttacaaaatagactcatccccctgcttatagtatgtagcttggaaggccttggattcacacgtctggtgctgccctgtcttctccacatcaaagagtaaagtatgttgttgaggtggtaaaaagtcgactttgtttgtcactaaacctgcagcattctcgtatattgaagccgctgaagactagggcctaagtattgcttttatccgaggcgctacctgcgactctgcatgggagaagagggctgaattgcaaacttttgtgttctggcttctattattgaatcaggcttctattattcaatgtttagttaccatgggaaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgcccttgcggctgctgacgcagctattgtatatccattctttcttccatccatccctttccttcattcgggtcggtcacttttccgggctgggatcgagaagtggaagtcataaaaaacatttatttatgctatttgtaccggtcaccgttttatggatgagtgctattggcgtagtcggcctgactctgaacctacatgcctatgacttcgtttcccaggaaatcagtttatcaattctcgagtcgtcaatgattggtgaaccagcacattcgtttgcaactcctatgggagtctgggttgattctcggatatgaagatatcaaatagaatacatcaaactcgcatgttccgtgactcatgtgtggtatttgaaaggtctttctagttatatcacgcatattttagataaaccccatnnnnnnnnnnnnnnnnnnnnnnnnnnnnnnnnnnnnnnnnnnnnnnnnnnnnnnnnnnnnnnnnnnnnnnnnnnnnnnnnnnnnnttatgagtttggaaccctgaacagaccgccggtgttaagccggaggaaggagaggatgagagcttttcctagaattgttggcactacctggtagatgctttcaacacttcgagttggtctgccataatatacaggaaatgttgggagctctgtgtgataaatagaacattgttgaattggaaatgctatttgtgccggtgaatcgacgaaactatgtcctatgcagttttttgcgcaatgtcatgtcgtaaaaaaatgttggacataatattttaaatcttttctataagatatatttctctcaaaatggtgacatgataacatttttggtatctatagttttcggctcatacatttttgtattttttggtaacatttttgtatttttggtatctagagtcctagcctcacaaatccaccaaaaggcaaaatcgcatcctcacatatctgtcatacatgtgttctacttagtgttcttagattaaacacgttgaatatgtagaaaccctaataatctgtcgtatgttgcattgactcttaaggggtatatataaagtacataggaaatagagatttgaagtacaagacaaagttagagtagattatctctaggattttatctctctagtttgtattcgattcttatctttaatcatatatgtacttctaacaaccttattgtcttacattaattatatgtgaactaaaccattgttttagtttgaaaaccatgggcatagtgaattctccaaccaacacacaacgccaaaggaaagttattaaaggatagcttgtcgatttatataactgaagtgtggatttgtgctcataaaaagcttgttagaaaaagccatctatttgtttgggcttagactttgtcataaaagctaatagctaatagtatatttgcggctatgaaatttccaaagcatgattaaaaagccaatagcttatttatttagcctctacatttt

SEQ ID NO: 15135 - DNA, 626 bp, Oryza sativa
gagtgttgccccatcccacgtggcatttgaggggtaccctgcgttggccatgcccttagggtgtgtttgctactggaggttcccaaccaggaacagtgtgcgtggaaaacggagcggtacattagcacgtgattaattaagtattagctatttttttcaaaaatgaattaatatgattttttaagcaactttcatatagaaacattttagaaaaaacgtaccgtttagcaatttgaaaagcatgcgcgcggcaaacgagaggggaaagtgccgaacacacctgcttcaccgaattattaaaagcatcgatccctgacatcatcacacatgacgctccattttctccatctccacttccacgccggcggggcggtgccgcttcctcccttctcccaacctcttcatgccggcgcgattgtggctcctcccctctactcccttcccccatcctccacgctaatgttggcgcctgccctagaatttttacaatttagtacttttgaaaaacttattttacaaataaactcctggaaaaacttatcccataaatggttcttttcagggcaccagagtagatggcgccaacctcctgccaccgtggtggggcggcgctgaggtggcagggg

SEQ ID NO: 15136 - DNA, 11313 bp, Oryza sativa
aattgttggaggctttcacatggattttacttattcttcgcacaatttcgaggatgtatttaagagtcgatttggcacgcgacaaacctatcccccttaaacggaatctcgaccccgagattcggaagaactgtcgaagaggtcgggatgggctgccttcagctcgtcttcgcgctcccaggtagcttcttcttcggcgtggttgctccactggaccttgcaaaaacggattacccggttcctggtcctgcgctccatggtgtccaggatcttcactggcctctccacgtaggtcaagtcttcgcgaacttcaatttgctctgagtcggcctgctcggatggcactagaaggcatttcttgagttgcgacacatggaacacatcatgcacgttgcccaaggaggcgggcagctccaactggtaagcgacttctccgcgtcgagcaacgatacggaaaggacccacataccgaggtgcgagcttcccctttgtctgaaacctgtgtacaccccgcaatggcgtgacccgaaggtacacaaaatcatccactgcgaattccaggtcacggcgacggttatctgcataacttttctgctgggactgtgccacctttagattatccctaatggttctgactttcgcttcagcttctctcaggatatcagtcccgaacacttggctttccccaacttggtcccacaggagcggtgtccggcatttgcgcccatacaacgcttcataaggcgccatttgtatgctggcttggtagctgttattgtaggagaactcggcataggggagactcttatcccaggtcttcccgaaatctaggacacatgcgcgaagcatatcttctaggatctgatttagacgctcggtctgcccatctgtctgcgggtgatacgcggtgctgaagtttaatcgggtacccagctcttcttggagcttcttccaaaagtgagaggtgaattggcttcccctatcagatacgattttcttgggaacgccatggagacttacgatcctagcgaagtagagctcggctagtttgttccctccataggtggtcttcacaggaatgaatcgagctaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtgctgccagggtggatggaataaggactttcgtgagcttcctgaagtatcaactgtttaagttctctgttatctggaacgcatactcgatttccgttccatagggttccgtgttcatcctctgtgaaaccagcggctttaccctgtttcatattcttgaggagtccatgcatgtctggatcattcttctgagcctcgcggatttgatcgagcaaggtgggcttggcttccaacgtagtcaagaatccgcgaccaactatgcttaggttcagggcttccatctgttgattaagttcgagtggaatgccacggacgttaagagtgttgcagtggcttttccgacttagagcgtcggcaaccacgttggccttaccaggatgatagtgaattcccacatcataatctttgatgagttctaaccatctcctttgccgaagattcagatccgactgggtgaagatgtatttcaaactcttatgatcagtatatatttcacagcgattcccaatgagataatgccgccagatttttagagcatgaaccaccgctgctaactccaaatcatgggtagggtagttgccttcatgaggccgtagctggcgtgaggcataggccaccacatgaccatcctgcatgagtacgcaccccaatccttggcgcgaagcgtcacaatacaccatgaagtccttgcgagtatccggcaagattaacactggcgaggaaaccaacttttctttgagagtttgaaacgccttctcgcattgcgggctccacacaaatttctcttctttcttcaacaactgtgtcatgggtcgagcgattttggagaagttctcgatgaacctccggtagtatcctgccaaacctaagaaactgcgaacttgagtgactgtcttgggttgcttccaatcggtgacggcggtcactgtttcggggtccacagcaactcctttagcagatatcacgtgccctaagaatttgacttcggacaaccagaactcacacttgctaagtttggcatataattgatgttcccgcaactttcccaataccagacggagatggtgctgatggtcttcctctgattgtgagtatatcagaatgtcatcaatgaaaaccaccacaaacttatccaagtattccatgaacactttgttcattaagttcatgaagaaggcaggggcattggttaaaccgaacgacatcaccgtgaattcaaacagtccgtatcgcgtggtgaatgcggtcttcggaatatcttcttcgcgaatacgtaattggtgatatccggaacgaagatcaatcttggagaatacagtggcacctttaagctgatcgaacagatcgtcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcagctcttccaactgtttcttaactccggccagttcatttgctgccatacggtagggtcgcttgtacagaggagtggttcctggagcaagatctatccggaactcaatctctcgtttaggcggcataccaggtagttcttccggaaacacgtctccgaactctctgacgatggggatttctgacagtcctatctgatgaagttctgaacttctgactgaggttgggggtgcaaagaaaacaaccggttgttccggccctcggtacagagtgacagtgcgtctcgcgcaatccactactccttggaattgagccaaccaattcatcccaaggatcacatccaaaatcttggtgtctagcaggatcagatccgagggaaaaggaatcccctgaatttctatagggacggcagggctataatactttgctggcataacccctccacgggtggtagatgagcagagggtttctaagacattgtacccccaactgatttctccccacgaatggcacagatataaacgagtgggaagctccagagacgaacaaaatggtagcagggatggaatgaatgaggaacgtaccaacgatgacgtctggagttgtcagcacgtcctcggccgtcacatggttcacacgaccccgactgacgtccttaccaccgttgttggggcggggaggcgcttggccttgctgacgccttggcttcgggcatttatccgcaaagtgcccgggctcgaagcagttgaagcacagacgctgcggacctgaagcgtccctgcggccttgaccaggctgcacagttggcgtaggaggacggggcgctcgagtcccttgttgattctgttgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggatagtccccagagactagacggacggacagctcagggtccattcctgccaggaacttttcttgcttctcctcatctttccgcacatcctccggagtgtaacgggccaggttgttgaactcgtgcaaatactccatcacggagcggttgccttgcttcaactctcggaattctcttttcttaagggccacgactccggcgggcacatgggttctccggaaagcggcggtgaagcgggcccaagtaacaggctgtccctccggctgcatagcctggaaatggtcccaccatagagatgcgggtccatgcagctggtgggcggcgaagatgactttctcctcatcgctgcactgcacagtgtctagctttttccccacggcatgcaaccaatccaacgcatccacggggttgttggagctagagaaggtaggtgggcggatacggagaaactcggcgagtttagagtgttgtgggggtggtggtggaggattaagttgtggcggattttggaggtggtggaggaaagcagtcatcatgttggcctgctgggcgaggatttgggtgagaatggcgttggtatctggtggtgggggtggaggcgggggaggaggtggaggtgggttgccctgatggttgtggttgctgccttcaggttggttgccatcaccggtgttagcatttctcctggtcatcaccatctgaaaaccccacacagaaccagcaaacagagagagctgacaattaaagctaaccacccacgactaccataattcttaaatttattactgctattaaatgggttcattaaagttcaagttgcttaggcgaataaataaagacaggctccgacacagttacaccacacaccggcataaccgtgccccacacaacccaagaagacaaacgagaaagaacacacgcgcaagcctactaactgctcgtctaccgctgcgacgggccaggacggaaggtgagcaacagcgcatcctccgtgctaccaacgccggaggcttccccctcctggggaaccacgggcgcgggctcggcacgaggggtctcgacgaagcaagtccacgccagggactaacgaacaagctcaggcctggaggtgctcttgcgggcggtgatcttctggctgcggcagacgcggcgacgcttggggcggcagatctctccctgggcgatcttgagctgatgcagctgcgcctccaccgcgtctaggtccttcttgagctgcaggttctcctgacgcagctccaggatcttcaagttgttctcgaccatcccacggcgcaccatctgatggaagtcgatacgagccgcgtcgtacgcctccaccatgcgcgccaagtgcacgatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaggcggcggggaaagagtctccacccgcggtgactgtcagcgaagtccgctcgggagagccagcgaggatcactgcagtgacctcccaagcagcgtggggctctgcatcgtccccctcctgctccggaagcggcctggcctggtagtccactccatgtggataccccaggaccacgcacatgccccgcagctccaagacgaaaccagtcatgtccaaaccacgacgggtgacgctgccggccatctacaaacaaaaacaaaaagaaaagcaacattttaaaggttagatttttggcgataaatgaagcagcaagacagagagagactagaggattttcacaaataagaagggattttatttttgaaaatattgctaaggcttgggatctacggctcgtcctagggtcaaggggggctctgataccaacttgtcacgaccggaaataacccaacgggcattccttacgtgcgtgcattaatccttgtcccaggaggcaaggtacaccaaaagttgatacaattcagagtttaacaagcggaagcgtaattagataacttattacatgggcagcgaaggcccagcacacacaaagacaaacgagaaacagcggaagactagggcgacgaccacaggcacttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggccccagctcgtcccaagccaacccaggccaaccattccatattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtatccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctactatcaaaaccatgcaccccgagcccagcctaaaaccacttttggggattttgaatagagggggcggtgtgaatccaattccacaatactccaacaattccacagtgtccaggtgatatgaatattcccaaggtctagagttgtaaaaccacctaatgttacctaattaaatagcgaagcatctacctaaaatcatactagtggtaccatgagtagagtgttcactagttggggttttgttggttctagggtgaacaaggtaataataacaataacaataataaggtcgtaacaaaggtaaataggcatggctaaataaaacagtgataacgcgggaatttaaataaataggcggccataggcacggcggagcggcggccgagagaggggagggaagggggaaacgaaatggcggtcctcggctcaccccgggttgacggcgacgacgggaacggcgaccgaagcggagagaggcggcggcgcggctcgggtcgacgaggacgatggtgctccggcggtcggcgggcgaaacggaggagtggacgaggtcgacgagaacgcggcgaagccgaaggaggcgacgccgaagcgggaggaggtccggggcgacgacggcggcgaaccggagctcggcggcgacggcggagagagaggacgacggcgcgagctcgaatccgacggggagagcgagcggcggacggcggaaacggaggagggaggcacggggagcgtttaaatagggttgggagtgagagagggcggccggaggggaaggaaatcggtgcggcgatctcgggctccattgatgcgccggcgaagatttcgggagagtaaatctgaacgaatccgagggagagagagagggaaaagaggggggaaagagagagggaatcacggggagtgatttccccctctttattgcgcgcggggacggcgggatgcggcggaatccgcggcggcggcggcgctagggcacgggcgaggcggcgggcgcggcgcgaggtaggggatgacgggtgggccctacccgtcagcgagggtggcgggcgggcccgcccgtcagcggcacgcgcggggaggaggctgatgggccgcgggggagaggagagagagggagggagttgggccgagccggcccaagagaggaagggggggaaaaggacttttagggatttttctttttataaaacccttttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattcttcgcacaatttcgaggatgtattttagagtcgatttgggacgcgacaccagagtaggcatctagaaaacacaaaaggtcgcaccccgcagtggagtcgactatctgatctatgcgtggtaaagggaagggatctttagggcatgccttgttgaggtccgtgtagtcaatgcacatccggagcttaccgttggccttcgggacgaccaccgggttcgccaaccactccggatggataacctcgcggataaagtcagcctccaggagccgcgccacttcctctcggatgaaggcctgccgctccggggcttgacaccgcactttttgccggacgggtcgcgcatccagccgcatggcgaggcggtgctcgatcacctccctagggaccccgggcatgtccgacggcttccattcgaagacgtcggagtttgcccgcaggaaggagacgagcgcgctttcctatttggcgtgcagggtcccgccaattttggcggtcttggacggatcatcgccaagggggatctccttgacgggcacctcgtcagccgaggtgaggcgcttcttggaggcgtgggacgcggaggcctccggggcctgtggctccgtggccactgccaggttgtcggcgcgctgctccgcgcaggcgagggtgactttgacatcgccaaagacggtgatgggaccactagggcccggtatcttcatctggaggtaggcgtagtgggtggcggccatgaacttcaccaacgcaggtctgcccaggaccgcgttgtagggcagattgaggtccgccacatcgaagtcgatccgctcggtacggaagttggtggagtcgccgaaggttatcgggagctcgacgtggccgaggggccacgtgtgtcccggagtcacgccgatgatcggcagcgacggctggagcttcatccccggggccttgagcgcattgaaggcggctggggagatgatgctcaagctggcccccccgtcaaccaggactcgcttcatcctaacgttgtgaatggtcggggagaccacgagggccaacttcccacctcgagcgagcactgtcaaatggtcgctctggtcaaaggtgagcttcacctccgaccagtgcgccttccgagccgcttcgtgggttgggacggtggctagaagctctcgccttatggccttgaagcctcggcgggaggtgtgagcgcaagccccccctccccccaggtcgagcgtggcgacggttccctgaggtatctggaactccagatcctcgctgttatcaccatcatcggtgggggccttcttcttcgcttcccctcgtcggtcatcggctggggtcgcgggggctttgccctctcgtcgaccctaccgcttctcctcatcggcttcccggaaccgctcggccaaaattcttgactgagcggcagtcggcgagactgtgctgataagtgttgtgcaccaagcaccacttgtctgccgaccggccctcaccggatggagcagtggagcttggcttatcgccggtggcctttcccttgcacggggcccatgagggcccatcagctgcaaggacatggccctcatcatcggagcgggccggtttccttttgcccctcctatctcaccgcttagagcggggaacagactgggggggtagccgcagccgccgcaccggtgccgggggagttccaggcccacgcctccttccaagccaccttgtccgccagctcgaacagctcggcggtggtcttgggctccttggaggcgatcttctccagcatgcggttatgccgcatgccattccaaaacgcataaacgactgcgtgggccggaatgcatggaatagtgttgcggacctggcagaagcgctgtatgtacgagcggagggactcgtcgtccttccaccgcacagcgtgtaggtccgcctcttctcctgggcggggatatgtgccctgaaagttcgtgacgaactgctggcacaggtcctcccaggagtggatgaagtcggggggctgggtcatcagccagccgcgcgcctgacccttgagggccatttggaaataattcgccatgacccggtcgtcgccccctgccgccacgatgatcgtggtgtagatctggaggaactcggagggattgatgctgccatcatacttctccgtgaggttggggcgaaacttcgggggccaccggacattccgaagactcgccacgaatgccctacaaccagtccctccagggctgagcgtggggggagggccgtctcgtggggaggaacgcggcactccagatgaggaggcgccttccccatgcgggcagctcggcgctcgtcccggcgtcgctcgatattgattcgagcgtcctgctccccgtagagaccgtcgggacgcctccggcttcccgaggcccccgacgatgttggagccgtggaccgcctcaaggccgtggccgatcgatgggccctcctcctcgctgacgaggagagggcaatgggggtatgcgacgtaccggtgacggcggctcggccgcccgcggctaactgccgctgggcagtggtgaccaagttggccacgtcgttcaaccagcgctggacaggggtctccggctccgagttcacggggggatgccgcagaaggacacccgccgcctgaagcgcgcctcggggcgagccgccgtcaccgtaagtgaggcggcgtcgtgccccgacgcgtcgtggcctccctccgcccgggggcgggtgtcacaccctgaagttctccttccaagcctaaatttaatttataaatgatcctaagaaaataccggtgcaaagtaagagtaaaccccttttaaatcaatgcaaataataatcggaattggcatgtggaatttttcttgagttctacaggtcgaaattcactaacaggattttaagtggaattttcagagccctaaaaataattttaaccaattaaaattgagcaagcaatattttaattctaggg

SEQ ID NO: 15137 - DNA, 20075 bp, Oryza sativa
  unsure (1)..(20075): unsure at all n locations
ctatattgcaaatgctctattgttttccttcaaatactgcatcgttttataatgttactatgggatgtttacctattgtcatagccatgctattgttgtaccatgtccctttgtcagcttggggtcataacatgactagagattggactagggattgcttagccatgcttagttcaactagttcacaatggggaaaatcctattaatgtttagactgttggttctaatggttttgttggattagtgccaccgctttggtgttggttaattaaaataaatcacatggtgggctgtgggtgcatggttttgctggtcgcacccatggcagttaaggaccggttcgcgggatgccctggaagaacctatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttagttagagggggttatacgaagggtcctgtcacggcctctttccggtatgtcgtggtggcatgtcggcgcacggaaacgtgtcgtggggctgtgtcttgtgggtacagttgtacacctctgatcagaataaaactattcgaatagccgtgcccgcggttatgggcggtaaaccagtttcaccgtgattagtcttaccctagtgtaatcttttgaaattggatagtttaggtggatggttgggcctgttgcaacgtgggatagcgttggacagtggatagttaatattaattaattattacaactgtttaaatctttcaacttctgtttataaatgctcgctttatgcaaatgaaccactccagctcttctttgataattccctgcatcatacccctattccggtatgacttgctgagtacagtgggtagtactcagtcttgctctattttttcccaaccccagagctcaagtatgtgtcagatgaaggtttctccgaggagtaggcttcgtccgtgccgtcgaggatgcctgtggagtggtgttcccgctgcagttctagtcaaggcttagctcctgttgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcgggaatttttaggcgtgacagcggggagagggccgaaccacccgaacgggtggggtcctccctccgcgagggatcacggcggggaggagttggagagttgcggcggcggtgacgagggtcgtggctctcgctagcatcctcactcccagacggagtgggggtgaacaccaccaccttctccttcaggacctcgaccatgatcgtcgagggtcatgggaaacttgggacggaaggcgacgacttctctttaaagcgcgcgacttccccctacctggcgcgccagctgtcgaggggtgatcctctctagcgggagatcgtgtgacccccccctttcgtgagttcggccgggggaagaagctcgcctctagaaatcgcgtatccgtcccgaaggctcctagctagctcgcagacaaccaaattatacaggttcgggcgctatcaagcgtaataccctactcctgtgtatgggatttagactaagagttacaagggttcttgaactcgggagaacacttttacttccctcctccacaagctcaggttttctgagagtcatcctctttctcggtgggcaaggtcctccttttatacctcaaggggataccacatgcacccgctctacctactcttctataaagtggggacccaccttatcttgactggaactcgaccgtgccttcacctggaagctaaaaccacagcttgtcctttagcggggcccagtgtcgtccctcgcctgacacgaaggacagccctgtcattccctcattaataggtgaagacttgtggtggccgccgtccgaatgagcccccgatgggacgggtcatacctacctccactccgccggaagcagatgcgacgtgggagcacggttgtccgtccagtcagacgtgaccggcgtcaggccggtcatagaccggtcattcttgaccatcgcgcgtcagtttagcacgccgcacatctgccccactgcattaaatgcgacagggggcagttggggcgctgcgcgtattaaaggaagtttagcctaggcccccctcctcgcttgctccccccgccaaacggcggctgggcgagggcctcagggcaaagtagtgcaagggcccgaggggcatgacgtggcaccccgaggccctgaccccccggccgctcctgcggttcgcggaatacggggataggaccaggctgtagggcacgtggcatgatgggaaggtagattcccctcactttacatacccccaggcccatatctccgacaggaacgatgtgactaaaaagttgtgtgtgtatgaaaggtttgatgggatggacagttggaagtttggaaaaaaaaaactttggaactaaacagagccataaacttccaactttttttccaaacttccaacttaaaacttccaactttttttaggaactaaacatagccgaaaacggaaacaaacgatctggcgttatatatgggggcttgcaagcgtgagggtgggatggagttgagattaactcgtatacaaaccgtcttacgtgcgtatcggacaacgacttggatactaatgacgtacgaaagatttagcaaaaacatcttcaattattataatagtagagataaaaaaaattgttcgtacgttgcactatggaaaaatttgtccataacgggttatgacattggctcgcgtggctggctattgcctcatgtttgcttcatcctgttcataaaaatcgatttatcctatatataaatatcggaacatttgaaatcatcggattattaaaaagaaagaaagaaagaaagaaagaaagaaagaaagaagaagaagaagaagaagaagaagaagaagaagaagaagaagaagaagaagatgatgatgatgatgatgatgatgatgatgatgatagtacaattgagcagtgtcgtcgttgtcagctcctgtgagctaggcggcgttgagtgggcggccggctgaccggccggatagtccgttgctcgtacaactaggtactaggtaggtactagctagctactaggtcaagataggtagctagccatcacaggctagcttggagtagctagcagcattcgtcaaccttgggatcgatcaggagtcgtctctgatctcgataggtgacgacattgtgagacagacaaggacatcatttgtgtactgtacgagcaagtttaatagcatagtccattgctagctccaaatcatctgtagtcaatataatagttaattcatactacaatagttgcttactatattattaataactggtccacctgtcatacacacattacgtcttgaagtctgtgctacagctggctacagatagcccgctgcttatctctctcttcctttatctttttaaaatatgtttatagctggcttatagcctgccactgtacctgctctactggtgctcgcgatcatctcgcgttatctccactaactgcaattaattacaaaagaaacacagccgatggatcgatctagttgtaccaggaaatcaactatcagtcgtctctcgcatgatcaagaacataataaaataggagtgaattcaattgacgattaattgggatgccttctcaacactaaaatcaaaaagactaaaatgtcttccacttaatcaaatcctattataattacccccactttatctagttgcaatacatctatttcacatttttacaaacttcaatacaatagttgttgaaaagattaagttattaaaagacctgtttgaatctgatgaagattcagattaaatgcgggcacgtaaaacgagatagctattagcgtataattaattaagttttaattattataaaattaaaaaatagattaatctgatattttagaacaacttccgtatagaaaattttcacacgaaatacaccgtttagtaatttgaaaaacgtgccacaataatttgaatctcatcctctcctttcaggagattcgaacgggaaaagtgtttttttaacggagagaatagttgtagttgcattacaactgtagccagcacaaattaaagtgaagaacttaggtagctagtacaattacgacagctccaattcttcacctcaattagtttcaatagtaaatatactatcaagaaaaagaaaattaaggtgacaaagaattaatgagaagagagagaaaaaagatgattgaagagtccatttcgcatgtaaaagaccactgcctctggttacttatccttttggataaggacacaatcttcaaaaagtaactttagccattattttatattataatatatataaaaatataaaaaatgattttattgaagtgtttttaagactaatctatatatacacatccagttacccatatttctaagataaatattttgaaaattattcatagttaaagattttaaagttcgacatcacccttatccaaaatggcaggtattatcagtccggaggattagttttacacataaaccaataatgaaaaaagggaataggtggataatgggatgtttagattcaggggtgtaaagttttagcgtgtcacatcgaatattatatagggtgtcttatggggtgttcaggcactaataaaaaaactaattacagaatccgtcaataaaccgcgagataaatttattaagcttaattaatctgtcattagcaaatgtttactgtagcaccatattgtcgaatcatagagcaattgggcttaaaagattcatctcgcaaattagtcgcaatatgtgcaattattttttttttgcctatatttaatacttcatgcaggtgttcaaatattcgatgtgacggtgtataaaattttggttgatttgacaagccctaaagggagagagatcacagatgattagatgaatttattttgaagaaactagtggcggagcttgaaggaaaaataagaggggacttttattttaagctggggctattattgtcgacgtttgatgtctcgactacggtatttggacagtatggggatcgtcggtgctaggatatacgcgagactgaggtaaaagagatgaagacatggatttttatacaggttcgggcccctgagctatcaggtaatacccctacatcctgttggccggagccgatgttgctttttattcaccataatcacaccagtataatatgtggggtagcctatctaactgttgtcgacatggcggtctgaaggtctgactcgtagtcaacaacagggtagccttcctcctcgagctcgcgcccgacggaatcagagacagtgctagatccctacggccggcctctgaaggtcccggatagggtcgatccaggcgtatctctgatgtcgatatccggcggcttgtcttggcgtatgtaggcttctatgttgattgtgttgggagttgattgtctcgtggtgggcgtgtgtgtccccctgtcctcctagggaggcttgtatttatacccataggtgtccccttgtctaagtagaactagggaaactaatatggatacaatccgagtagtccttgtcgtttccatgtagaactctggttgtctttccttatccggaactccctcctatatccgtaggttgtttccgtataggacatggtatgtggtgggtcctgccgagattgagtcaactactattaggtatgtggtatccataaccatgacagtagcccctgactttaatgcaaatgaacgaattcatattctcaatcacgcgcagactttggaataactattatcgagctcatgtgaacgttttcggtgagttcagagataacgttagacttcctttgtcagcctcgtgcgggcaccgaaagggtttgtctaagtcaatctctgatgtcgaccgagaaagtatagagcgtacgactaagtctcctgtcttgctgtaatagaaaatttggattgaagtcaagaaattttatctcggcgggtacaccatctcttcattccgtattccttatcgagattcaccaaccgttctcgagtgattgagaaggcgcagaatctacgacggagccttgtcaacatttgtcgtactcgccttagtcgatcttggtgtagaaccatagagacatggagtcttcgtcaatgtcgaatagaattttcctgaaatcaacactcaaaaaagaatatcagatagaaatagcccccgagcgaacgctcaaagggtgacatgttataatatatatggaaactaaaaatgaaataaatttacagaccaatgttttgtgtatgagcgtcttctctcttaccgacttcgatcagtcaatttgtagagtcatacactctccctagcccccagccttgtcgtcggagaatcgttctcgaaggataaggctcttggacccttgacctgcgttggttgaataagcactgatcctagcccccagccgtgaagttggaaagttaatttccgattacacggcttggttaatacgcacggcgagaactcttacatgaccagatcttacatggtctttcgtctctacaggatccgacaaggccttatcggctctaggcgtccccagccgaagatcccttaggttcctcggaggccttgtcaagacggcgtaaagggacagtaggataggtttcagcgctaggtgtcatctgggtaagggatctctgggtaaaacccttggcgatcttgtgtacctgacatcaactttgttgaagtaggggtaatgggagaatcgctacatcgctggtcgaggactaggcagtagtcgtaactcgaccacttgaagtggaaatagtgggagaaacgctacatcgctagtcgaggaccaggcagtagtcataactcgaccacttaaagtggaagtagccggagaaacgctacatcgctggtcggggaccaggcagtagtcgtaactcgaccactgaaagtagaagtagtgggagaaacgctacgccgctggtcgaggaccaggcagtagtcgtaactcgaccacttaaagtgaggcgagagagatcattacattttactggttcgagaaccaggagtaggagtctcttaattacctataggggcgttaaagttggtttattatatgtgcatattatgtggccagcatgactcacatacccaacttatagcatatccggatgtccgttcgcaatcatgtcgggtgatcaagccgacggcgttagcgaggaattatccgttaacaaacttttctcgagtagtccagcgatggccggagctatgagataggtcgtcggtcttcgttggtaggttgggcgcgacgactctgcatttgtcgagatcgttctcgataatgcggtgtactcgactacaacctactcgagtgctcaattgtttctgaaaattattttctagaagacaagatatatagcaggggatatcgagtatgtactcaaaaactgcgtggatcttctagtattatcaggatataacgagcagattaaatatcaggcattatgtaacccgtaaacaagcatgatttatacagaagagaacagagcgagcccccagcgttagaccgtagttggtttaacgtcggaaacatccgcgcaatagatattgtataaaaaacatgctctaggtaaacataataaattatagatctgacaatattgtatgatctgaataggtacgataaattgcatataaaatattgcgtacctttgtagatacatgccggctgtatctacgaaattagtagatcaatttgaaaaaccaatctaccaattaccttattgtgtactcgttggacataatatgatctgacatattttggtacgccgcgtatcttgaggcttggatgatctcgatagaccaagttgtcgatgacgatgatggttccgatctggtcggaagatgtacttcagttgggttagatctcctcacagccgaagtcatcgagtagcttgttgtcggagagtccatatcttaaacgcatctcgtcgaaatcctgaagcaccaaaatccccctacctgtcgcgccactgtcgacgtttgatgtctcgactacggtatttggacagtatgtggatcatcggtgctaggatatacgcgagactgaggtaaaagagatgaagacatggatttttatacaggttcgggcccctgagctatcaggtaatagccctacatcttgttggccggagccgatgttgctttttattcaccataatcacaccagtacaatatgtagggtagcctatctaactgttgtcgacatggcggtctgaaggtctgactcgtagtcgacaacagggtagccttcctcctcgagctcgcacccgacggaatcagagacagtgctagatccctacggccggcctctgaaggtaccagatagggtcgatccaggcgtatctctgatgtcgatatccggcggcttgtcttggtgtatgtaggcttctatgttgattgtgttgggagttgattgtctcgtggtgggcgtgtgtgtccccctgtcctcctagggaggcttgtatttatacccataggtgtccccttgtccaagtagaactagggaaatcaatatggatacaatccgagtagtccttgtcgtttccatgtagaactctggttgtctttccttatccggaactccctcctatatccgtaggttgtttccgtataggacattgacggagcgtggggctcctcaccgggagaccgcgcgggcccccctttgccggttcggccgggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctcactcctcttttctccagtcccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgagcctccgatgggatgggtcataccaacctccactccgccggaagcaggtgcaacgtggaagcacggttgtttgctgatgacgtgaccggcgtcagaccagtcacaaaccggtcattcttgtctaccacgtgtcagtttagcatgccacacgtcagcccttcttcataaaatgacttccttgtaatggttgcgatgaagcctggtatgaatctagccgggaccgacgtgctaactccaggagttcccacgccggctccatctagggacaagtgcctagaggctctcatcattccgacgggacggggcgaggcgtgcgaaaggccgcctgttgccacctaactcgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccgacccctcggggagatagagggaggggcggtctcatcaccctcgggcccgacccccccgagggggtcaggccacgtgggtgaccgcggctgccccaaacctctagtcaagatatccccggtcccatgtcaccgacagtagcccccggggttatgccagggcgatcaccctcctcgaggaaaacgctcgggcgtgacgccactcctcaggcctggtgacaggtggggccggtctctaaaagcggacaggaatccagtggtcgcaaatcgcgcgcatcggcaagggaaaaaccgaccgacaataatgagcggctttcttcaagaccgctacattactcgagtagcgcgcgaattgggacgagccggttcgtttcgcctggagatgtgatgatggtgcatcggtcggcgagcgtagttaacgcgcgcacgatatgtcccatctcgactgccacggccgcacatccgcctcgtgcgccgcaaacgggcgagcgggattagtggaggagttggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgttatggcacggggctccgcaccgctcgacggtagcgtgctgctgccttctcgcatcgtgagcgagaggcaggccgggctgccgcgccgattcatgccggaatctgccaccggccgggaggtggttgcgctgggtgagggacgcccggcgccacactacccggggcggtccgtattcttcctttccttcgcaatggcagggctggtcccgccattctcttctttcttcatggatgttctggagctttatgatctccagatggcgcacctcacccccaatgcagtaatgacgttggccatcttcgcgcacctgtgcgagatgttcatcggggtgcgcccatctctctggttgttccggtggttcttcaccgtacagccggtgtcgccaccgtcggtagtcggtggctgctacttccagccgcgggggccggtgctgaaccgctatattccctgcgtccttcgcaagaagtgggatcactggaagagcgactggttctacacccctctcgccgacgaagcgcgcctccgacttccgagccagcccccagcgcaggcctccagctggcgggcgccggtagatctgggagacggctacgacgccgttcttgaccgcctggctggtttgcgatcccaggggctcacgggggccatggtgttcggcgactaccttcgtcgccggatcgcgccgctccagcggcacgcccggggcgcctgggagtacaccgggcccgaggacatcatgaggacccaccaggggcgcaaatgggactgggaccctgaggacttcaggatagtggtccaacgggtgctgaatctcagctccgtggaggcatccctcatccctcaaggggtccttcccctctgctgcgatccagagcgcgccaacatcctgaccatcatgcaggaggtcggggcgtcgggggagcgggccccccgaggccacgatggcgcgggcgggagccgcaggggggaacaatctaccccgggagggggtcgtgcttctgggccccgtgacgggggcccggggggcagccgccctaccgacgcccgggggaagaggaaacaggaggataccccctccccatctcctccccgagggggcggggcggtgcgtgccagcagcaggcgcccgaagggtgctgtgccgacgtcgcagcccgagggggagcgaaaaaagaagcggctccgcaagatgggggggaccgaaccatgccggggaaacctcatctcccccccaaggtggtcgtttagccgacctcctcgcaggttcgtccctgcgcccactgcggccgtattcattctcacatctcccaaggcaagttttcactcacccgtttttcgtcttctggtttttcttctgcctcagcgagatcccgtcgcgcccttcccgccattccaagtccggccggtctgaggccgaggagacggcgaccgcggaggcccggaggcgggaagctgaccggcgagaagccgcaaaccgcctccgggaagccgaggaagctgcccaggaggctgtccgggctcgccaggctgaggaagccgcttgggaggaggccagactccaccgggccgaggagtccgtccgggagacggaggcggcgcgcgcacgccgggcggcctgccaagcccccgacccgactccgcccgaggcgacgacgacttccgaggccacccacgacgaggtcgcgggcgcaccgctcgggcccgacccctcgggcgacgctcaggacgagccagcttcgggggacgtccccgagtccggcacgtcgatcggcgggccgagccgtgcggcatccttaccgaggcggctctcccccatgccttccgctgccccactgagcgctgagccccttctgcaggccttggccaccgcgaacaccacggtgttggacgggttaagtgcccagatggaggtcctgcaggcagagcgggcggagctcgacgcggcgtgggcgcgtgtcgaagaggggcgacgctcggtggaggccatggtggaggcgggccgcaaggcacaccgccggcacgcctcagagctcgaggcccgtcgtagggacctggcggagatcgccagggaggtggaggaggagcgggagactgccctcattgccaccgccgtgtttaacgcggcgcgggacgacctctgcctccaatacgggagccggggggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccacgaggacgagctcactgagcgggagcgagctctcgaggaggccgaggccgcggcgcagctgcgggaggagcaggcgcgcctcaatctggaaggcgcccgcgccgagagggccgcactggatcagcgggccgctgaattcgaggcgcgggcgaaggagctggacacgagagcgcgcagcggcggggcggccgcgggtgacggcgacctagccgcccgcctcgcagccgccgaacacaccatcgccgagctgcagggcgcgctggactcgtccgccggggaggtcgaggccctccgcttggcaggtgaggtagggcccggcatgcttcgggacgccgtctcccgtctagaccgcgccgggcggcaggcgagcctctggggcgggcggaccgcgaaatatgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctactaggccagggaccctgacttctccccgtgggcaacgctggacgagttccctcctggaaccgaggatggcgcgcgcgcacaggtccgggacgccgccgaccacatcgtccacagcttcgagggtacggcccctcggctcgcgttcgccctcgactccgacgaggagggcggtgacggtggtgcggacgacagcgacgacgaggccggcgacccgggcgcgtcggcgtgagcccccaggcccccgccaatcttaaatagctttttctttcttcttctgaggccttcgggcccccttcttgtataaactaattcaatctgcaatcaaataaagaggaaatttttgtgtcagctctgtttgttgtgtgtatgagacgaggatggtctatgccgcagtccttctgtgtcttggcttgaacgagggctcgtgcccaggtcctagcctcaaatggcgcgggtcggggctagtgcctggggagatccgcgtgtcgagactggccaggccgggaacgtggtgaccgagggttatggatgacccgattgtgggcctttgccgattcccccccggagttcaccacgccccggggcacggctcggttctgggccccgtttggcgattttagccggcccgggccaccgagggcaggatcgagcacgagcgtgctaattcaagccaagattcttcgaaaggaaacaatggcacagacacagtccttaggaaatcgaaaatgcttttattgaaatacggaagagaaaaaatataagcttatgcatgtggtggcccgaggggacctcagggtgagctcggatgggagaaccgcctccgcgccgtagacgacgaagaaaggcgtttccccggttgctcggcttggcgtggttcggttcgcccagagcaccgctggcaactcctcgatccacgagtcgccgtgcttcttgaggatattgaaggttttggttttgaggcccttgaggatttctgcgttggcgcgctccacttggccattgcttctggggtgggcgggagaggcgaagcagagcttgatgcccatatcttcgcagtagtcaccgaagagttcactagtgaactgggtgccgttatccgtaatgatacgattaggcatcccaaaccgagcagtaatgcccctgatgaatttaagcgcggagtgcttatcgatcttgatgaccgggtaagcctcgggccacttagtgaacttgtcgacagcgacatacagatactcgaacccgcccggggcccgcctaaacggacccaggatatcgagcccccagacagcaaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatgcgctggatgcgttcactcccttcgcagtcctcgggtagagtcttatctgtgaggtacgcctggatctcagtgatccaagcaatcaatctaagggagctgggagcactcccctcgggtcccgaggcctggactccgacaggcctcgggggccgttcaggcgcgtccgtctcccctagggggtcgggccgcgccgacagctgggcaagcctttcttaaaaggcgcccggtggggtctgggctcgcgaggaagcgagccttgaaagttcgtcggcgaccgcgttatcccgtctgggcacgtgccgaagctctatcccgtcaaaatggcgctccatacgccgcacttggcgcacgtaagcgtccatctgcgggtcagagcactggtactccttacagacctggttaacgaccagctgggagtcgcctaacaccaggaggcgacggatccccagtccagctgccaccctgagtcccgcaaggagtccctcgtactccgccatattattggtcgcccgaaagtcgaggcgaaccaagtatctgaggacgtctccgtttggcgaggtcaacgtgacccccgcaccggcgccctgaagagatagggagccgtcgaactgcatcacccagtangcggtgtgaggcagctgcgaggggcccgagcttgcctcggngacggagatgggcttcaggggccgggtccactctgccacaaagtcggcgagggcctggctcttgattgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctgaaaataatggcgcaacttcctcgaagccatcagaatagcgtaaagcatcttctgggcctgagggtatcaggtcttagcgtcctggagggcctcgctaacgaagtagacaggccgctgcacctttcggcggggccgatcttcttcactaggggccgcatctccagggcgctcttcgtccgagaggccgcgcggggcgcactcggcttctgtgccgacgacctcggggtcggagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctccctgctctctcccgggtcgagtcgacacagggtggggatgcgcggggtgagggttgtcctcgtcgcgctccacaaccaacgccgcgctgaccacctgcggggttgctgctaggtaaagtagcagcggctcatctggctccggggcgaccaggactgggggagaactgaggtacgccttcaactgagtgaaggcccgctcagcctcctccgtccagataaacggcccggagtgtttgaggagcttaaataggggtagtgccttctctcccagcctcgatatgaaccgacttagggcggccatgcagccggtgaagcactgcacatccctaagcttgctgggggggcgcatccgctctatagctcgtatcttcttggggttggcttcgatgcctcgggcagagaccaagaacccaagaagcttgcccgcaggcacgccgaacacgcacttatcggggttcagctttatgcgggcggagcggaggctttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgtattctttaacccgaaaggcattgtcgtataacaataagttccaatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgtttcggggcctgccgccgcactttctgccggaccggccttgcgcccggccgcacggcaagacggtgctcaatcacctccctggggaccccgggcatgtccgccggtctccaggcgaagacgtcggcgtttgcccgcaggaaggagacgagcgcgtcttcctatttgccgtccagaagaccaccgattcatgtggtcttggacgggccgtcgcccagggcaacctctttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgtgactttgaggtcgccatggacagagatggggccaccggggcccggcatcttcatctggaggtaggcgtagtggaccgccaccatgaacttcaccaacgcgggcctccctaggaccgcgttgtagggcagactgaggtccgccacatcgaagttcacccgctccgtgcggaagttggcggatccaccgaaggtgaccgggaggtcgatatgacctagcggccaagtgtgcccctgcgtcacacctacaatcggctgggacggccgaagcaccatccccggggccttgatggcgtcaaaggctgcgggggaaaggatgttgagggctgcacccccatctatgaggacacgccccaacttcacgttgctaacggtgggggaaaccaccatcgcgatctgtcctccccgggcaacgcacggcgggtggttggtctggtcgaaggtgagggcaacctccgaccaccgcgcccgccgcgtcgcctcatgggtaggggccgcggccagaagctctcgcttcatggccttgaggctccgacgagaagcgtgagcgcatgctcccccatcgacggtggcgatggtggccccaggctcctggaaccctaggtcatcgtcgccatcgtcgatgtcctcggcgggggccttctgcttggcctcactttgccggttgccggagggagccgccggggccttgccctcacggcgctcctgcctcctctcctcctcccacttcctcgtccactcagccaaacttttgaccgcgcggcagtccgcgaggtcgtggagggaggtgttgtgcacggtgcaccacttgccggtcgggcgctccctgctgggagcgccggcctccttctttttgtcgctcgcaggccttccctttcaggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccaggcctctttcttgcgagccacacggtccgcgagctgaaaaagctccgcggtggtctggggctccttggaggcgatcttttcgagcatgcggttgtgccgcacgccccccctgaacgcgtagattaccgcgtgtgcggggatgcatggtatggtgttccggacttgacagaaccgctgaatgtacgagcgaagagactcatcgtcccttcgctgtaccgcatgcaagtccgcttcttcacctgggcgcggatatgtgccttggaagttcatggtgaactgctagcacaaatcctcccaagagtggaccgacgcgggcggcaagttcattagccaaccccgcgcctgtcctttcagggccatggggaagaaattcgccatgaccctgtcgtcacccccggcggcctcgatcccggtcatgtagacctggagaaactcggcggggttgacgcttccgtcatatttttcggtgatggtgggccggaaccttgggggccaacggacgttccgaaggctcgccacaaaggctcgacagccgacaccaccaatcgggggcacggggggctggcccccgcgcccgaaccgaagtggcgctccggacgaggaagcgccttccgttgcgtgggaagcgtgacgaccattgcgccagcgctcgatactgaggcgggcatccagccccctacgcacatcttcttgggtcggaggcgttgatgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccataggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgtacagatctaactccaaaccaggagctaagcaaattattaccagttattaacatccataattattgtgaaaggtgtgagactaatcacgaaa

SEQ ID NO: 15138 - DNA, 4336 bp, Oryza sativa
caactggggtataaagcaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagttttaatcaacactgaacagcacacccatgctgtacaggcccaaccatcctgaacaaccatacccggctgaacagatctaactccaaaccaggagctaagcaaattattaccagttattacatccataattattgtgaaaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcaaccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcgatcttcaattaaccttcttgatcacttccgacgcactcacgaaccttcgcaacgacggaaacgacaagctaacacgcaaaacgaagaaaaagactaataaaaaccaaataaacagtacataaaaagtaaaaaaacatgtagatcataattttagatgaattatgagacttgaacggcctcattccgacttcaaatgaatttattatgaattttacaagattaaatctaattaaagtccatttaaaaagacttaaataaatttaattcaatttatggacaattttaatatgtagatctttattttagaaaaatttagcaacttgaaccacctgaaacggatctatggttatttagttatgattttccgaagatttcatctattagaaaaaaggaaaaaaaaagaaaggatgatgatgtcagcatgacatcacccacggaggccggctagggttggcgacctcgccggagctagggaccttggccgggtgattggaggacacctacgcgtagaggacgacgaggcgaacccaacggtactcaccacaacgacaaacgacgaacgatgatggccggcgacgaagaggacggcggcggcggctcggcttgacggcgacggcggagctccggtggtcggcggcgaagggggacgggcggccgaggttctcctcaccacggcgcacctaacggcggcggcggcaagcggcggcgacgacgcaagcgacggcgcggcgtggctgaagacggccggcggcggcggcgaactaagtgcgcgcggcggcgactctacggagcacgggagaccacgggagatggggcaaacgaaagaggggaactagggggtcctatttatagccttggattgaagagatcggactcctcccgcaagaaatcgatccgagaaaatcaaaactcggttttggagataaactcgaaaacgagtttgattcgggcaagatactcaaccatttgctccgattattgaggggaaagatagaggaggacgagaggataaaatcccctcaaaaacccggaagaaaaagagccggattggagcggatttgagggagaaaaggggcggctcgggcgacggcttgggctcggccggccggctgctagaggaagaagaagggcctgacatgtgggccccacatgtcggtgcctagagggaaagggtttttgaactttttcaattaaaaaataattcgtgaaatgatgtttcatttattaaaaatacttcccttgctcaaacaattcccagaaaattctagaaaatagaggaacaagcaaagtatttaataaaattttatctaacccaattttatattgagatttagcacattaaaattagatcttctcttttaagcttttaaaatcatttctaataattccttttaaacaacaatttataatttaaggattttaaacaagaaaagcacttaacaattataattagatcattattgatcaaataattactgaactgttctctgtatcatttacatttaggaattgagctccgaaaaatccgagaaaattccagagagtataattaaccatggagaatttaataaaaattaaatccacccatgctttatatttaggaaattttatttcccacatttaacttcacttgtaaattaatgaacatttcatataaattctattaataatttattaaataatttataaatcctaacacgaaaatcagggtgtgacaaatctaccccccttacaaagaatctcgtcccgagattcggaacggctagaaagaaaaaggaaataggtaaactgcagtctatcttattccataactccgataattattctgaggctttaaagaaaactactgccgctttgaaactggtggctgagttgtaacacttgaagacacaactcttgaagacgcaactggcactgcattggctcctgtgacgacaatgttgttgacttgaccttgcggctgctgacgcttcggcttcggacactctcttgcaaagtgacctggcttgtaacatttgaaacacacccgctgttcccttgctggttctgcatttgttgcactaacatgttgatcaattgggtctgttgagccagcacttgagcaagggttgggttctcttcattgttattgtttccacttccactagcgtgagtgttcaccatctgttgcagattagaaaggatagaaggagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccttaagtagacctcattggtgtcttcaagtttcaaccactagtttcagaactactcaagttgaacgagagaagagagtagacaatgaaacaatttgcaaagagttctagataaggaagaaaggaaaattttcacaaattatgttttcggaaaaatagtccttaaggtttgaccatttggcttatcctacagtcgagatggctctgataccaacttgtcacgcccggaaattcactaataatttccgaactaatttgtgcatgaaatcctcgtccaggaatcagccgaggtacacaaactgacaatttaatatacaaatccatcataataataacgttacatacttacaaaagaaaagaaaaacagcagcggaattaacggtctagcgatggcttcagctccactcccataggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcgaaagcagcatttagcaaagagttaagagtagtaaaacagtagattaattaatcagaagtttaatcaac

SEQ ID NO: 15139 - DNA, 1614 bp, Oryza sativa
taagcttttaaaatcatttctaataattccttttaaacaacaatttataatttaaggattttaaacaagaaaagcacttaacaattataattagatcattattgatcaaataattactgaactgttctctgtatcatttacatttaggaattgagctccgaaaaatccgagaaaattccagagagtataattaaccatggagaatttaataaaaattaaatccacccatgctttatatttaggaaattttatttcccacatttaacttcacttgtaaattaatgaacatttcatataaattctattaataatttattaaataatttataaatcctaacacgaaaatcagggtgtgacagttgacgagggaatggcagacgaacggcgggtaacggctgccgctcgccgcgccctccgcctcgacgacacggagccgggggtagcagcgccagaggccttggtggcggaggaccgcccaccggcgcctaggcgctgctgcgccgtcatgaccaagtcggccacgtcatccagccaacatcgggctggagtctctggatcggggacaacgggcgggtgacgcaagagcgcgcccgcagcttggagcgcgccctggggcgtgctgccatcgccgtagacgaggaggcgacgctccccgtctcgccgtccttctccatcgctcgtgggcggcgaagttgcggatctttcgaccccctcgagcgcctcctcccgcctaagacttcggcgagaggggggcggtggagtacgagctcgacgacgcgggttctgctcactgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggccaccctttgccggttcggccgggggcgctgggtgaggttctaagcccttgatctgtggaatggttcgcgagagagcaaatgcgcaagacacgggcgatgtagacaggttcgggccgctgagaagcgtagtaccctactcctgtgttctggtggatctgtgtatgaaggagttacaaagagctggagagcaagagagttcaaactctagagaccctctcactcctcttttctccagtcccccctcttggtaggcatggtcctccttttatatctcaaggggataccacatacaccatttctacctacccttcttttgggtggggacccatcctactttgaccaaaacttggctcgtaccttcgcctgacaccgggataaccctgtcctccctcattaatgggcggagatttgcaatggctgctgtccgaatgaccctccgatgggatgggtcataccaacctccactccgccggaagcaagtgcaacgtggaagcacggttgtttgctgatgacgtgaccggcatcagaccagtcacaaaccggtcattcttgtctaccacgtgtcagtttagcatgccacacgtcagcccttcttcataaaatgacttccttataatggttgcgatgaagcctggtatgaatct

SEQ ID NO: 15140 - DNA, 3967 bp, Oryza sativa
attcgtctcgcagttttcaggcagaatctgtaatttattttattatttatctatatttaatattttaaatatatacccgtatactaataaaatttggcatacgaagtaaccactgccgagatctaggaacaaaggggaaatggacatccggccggagattacgtgtgtgcatgcgcatgcgtgtgctgtcagctgccaatctggagtactccagctacaaacatgacaagttcatcatccatgacttgacgtacaacatgcacgcgcatgcatgtcagtctgtcgccaccaaattaccaggagactattttagcgattgcagtaaaaataaaccttggtgtgtttaattcacgctaaaattaaaaatttatttgaaattgaaacgatgtgacagaaaagttgaaagtttatgtgtagaaaagttttgatgtgataaaaaagttagaagtttgaagaaaaaatttgaaactaaacaagggccttatctaattttagcgatttcaaaattttaatataaattaataatattatcaaattttaacgagatttatcaaagttcagtaaaaatactaaatatatgtatatctttaatagccttgcttaaaaaaagatatgatttaaaatggcatcaatcttaataaccttaataacctctaggagtacgatagatcaactgtttatacagaagtatcgccatcgccgttggaacacgcacacgggcggccatcgcatcgcaacgacggtatcgcagcatggcaggtaacggtgtactccctcatgtttttttcttaaaaagaaaaagtaaaagtaaaatcttagggacaaatctatacacacatagacacacgtgtatctaaaaattatctataggatttaagttattttttaaacagagggagtaagtggcaaactcacaaaatctatttatatagactaaaataaatcacgaacccactactttgatctataaataagtttacaagttaatcatttaggccatatttagattacaccctaaaattttacgccctgtcacatcgaacgtttgaacacctgcatgaagtattaaatataggataaaaacaactaattgcacagattacgactaatttgcgagacgaatcttttaagcttaatttctgcataatttgacaatgtggtactacagtaaatatttggtaataacggattaattaggtttaataaattcgtttcgcggtttacttgatgaattctgtaattagtttttttattagtgcccaaacaccccatacaacactctatataatacccgatatgacacgtcaaaattttacacccctgatctaaacaaccccttacacgtacagcaagacgcattaaccagtgcgagtaccgagtattacttctgtttaaaataaaaaaaaatctaacacataaacttaattttacaacgagaggagtacgtttgtaggacgtgtgtagtatacgtatgtgttcaatccaaatggacaacggacgtttgctgggcttgttttgtattgtggcttgcatagcacagcacacaacacagccgccaaatggaacgcgtaaacggaagccttcgcggcaaagcaagaactacgaagcctctagatcgccggatcgatcgatccatcgcagccgtcggatcggatcggacgtgtccccctcctccttggccttgctggttacgccgcgctgtcgtccgcgtgacgacaccctccacgcaaaacggcgttcgccccccacggccccacccaccccacccttccttggaccccaccaccgcatcccctatgaacccatcaactctgtggccatcttaggatgtgttcatcacttccctaccatttttaactatacatattttcttttgtatttttaaaatttagtaagctatcaatcccaaacatatcataaactctctacaatatcttgccataacaatatttggtgatccagtctgtgtatttgtctaattacataacttggatcctctttactatatttatgaatggcgatataatagacaatacatattatatttttaaaataaaaatattaatgtgcaccatcgctagtcacatgctttaaagtaacgcttaggatatcgatatacctttcgatgaatatatttaatcattactcgcatagcatagccacatatattaggcgtgttcggaaggccaggccacatttgtggcagcagcagccacatgttagtctgatgcttgcagcactgttgccgttggttacgctacaacgcagccacggttgccgaacatgcccattatcaaaaccatttttgatttaattattttgggtcaacttttattacccaaagttaatatcactttgtgttatgtttttttaatcttttgttgtacttttgactaacgcttttgttttgtatagccagatccaatctctccccggagaagatatgagctttgcctgtaaataggggtgatagttggcataattgtgtggtctttgtaaaattgataaaaaaaactagcccaaagtaaaaaaaattagataaaggatggtccaaaataaaacctaggtaagaaaaggtagaacaaaatggaaatcactcaaaccatatttttagaagcatttactaactaaaattctaatgtctaatgctagtatgtacttaaaagaaaatctttaataaacatttactaactaatatttcaaccgatagattttacggtcttatttaacatgactcaaaattgctaaatttaactttctagtagcatactctaaagtggagtgacttgaatcctgcttcatctctttaattaatcatcacccttttaggtgaggttgaaaccattttgttagccgttagctcttaaacagattaaccgtaaaagagatcctaagtagaaacagtaaaacaattagaaatagaaagggtttaccacatcactcactgtaaagatgtttgtaaacaagtttcttattacgtgtatcgaaatctacaaataaacaagtttgactattgtgttgtgtgcattccatctctagaggctagacgggcatgaggtcatacccagaatccaaggaccgtagtactagaccgcagaagatccagatctgggaagaaaagcagtgggaaagcaagccgtttccgcgttgaaacagatttcctcctctcctcttctctttcctctctctcctctccgcccaacccttgacttcccattctattccatctctctctctctctctctctctctctctctctcgatcgtcttctccacttcctcctcgcatttcccactagtgaggcggaggccatagccatggatcccttccaccacctcaactcctccttctccaacccctaccacccactcctcgcctccccgccccaccaattagcccccgacccactccccccacctcctcctccgccgccgccgccgctgctccccgccgacccgccgtcgctcgagcgggagcgcctcccgcagtggtcccacgccgagaccgccgccttcctcgccatccgcgccgacctcgaccactccttcctctccaccaagcgcaacaaggcgctctgggaggccgcctcggcgcgcctccacgccctcggcttcgccaggacccccgatcagtgcaagtccaagtggaagaatctcgtcacccggttcaagggcaccgagggcgccgccgccgtcgccgccgcggggacggatcagatgcagggggggcagggcggtggtgcggcggcgagggggtcgtcgtcgtcgttcccgttccatgatgagttgaggaggattttcgacgccagggttgagagggcgcgcgcattggagaggaagaaggttaaggggaaggatcctgatgatgaccacgacggtggtggtgatggggatgaggatgatgaggaggaggcggatcaccacgtcgacgaggaggacgacggggcgttcggggacacgacgagggc

SEQ ID NO: 15141 - DNA, 5820 bp, Oryza sativa
ccgccatggtcgcgctcggcgaggagcgcctcgcgctcgtccgacgctggcgcgagcgcgaggacgcgtggcgcgcgcgcgccgaggagcgcgaggagcgccgccaccagctcgtcgccgcactcctcgccaagctcggcgccggcgacgcgtccgcctgagatcgatcgatccctccccccattgttccatccgcaccgcaccgccgccggtacgaaccaaatcccctaccacctcctcctcatcaacagcatctgcatcatgtactgcaactgcttgatgatgatcttgttgtgttcttccaaatggagatcgaatcgatcataattcttggattattcttcattgctcaggacgatgcactgccgcgaagcgcgcgcgccacgcccggcccgatacatttgctatttatgttagatcagtcgtttcgtttctagtgatcgatcaatcagtccatggtctttctctcatctcatcttttgttagggtttcccttttctctgtagaagacaatgagaggttggtcaagaaattataagggttttgcaactgagatgcatcaaacatcttcctagtaattctttagtttctctactagctatctatccagcccatgccatctgcaagctctggtcttatcaagcttcaggaggaagctgaagctagctgctagcttttccaacgcatggatggagatgcatttatgcatgcctttgcatgatcaatcgatgtgctatctatctatctatctatctatctatctatctaactatctttctttcctctcttctcaccatgagtccaccatgaccaccactagctcttcttttgaagatgatcggtagaatctctgcagggaaaaaaatggtggtggtgtgtgtagtgtgtacgtgctccccttaattatgtctgcttttcagaggagatcgatatctctctctgtgcgcaggcagaggtgtagcttttgggcgacatggtctcgctagatctttcctgcttttcagttgcatggtaaagagatttgcgtctgaaaagtttctctcttggtgagagaagaaaaaagatgtgtggatggagctaagctagccataggatatatatatatatatatatatatatatatatatatatatatatatatatatatatatatatatgatatatatgtctagacatataatgcatatatgcatgcatgatgggggtgcagtgtgcagtctttggggttgggttgggttgggtttgctttgctttgcttatcatggaggaagggaattgatgccctgcatgaaaatatgcctatgtatgcaggacctccatgtgtgtggtgagaggagagatagattgaggtgtagaagccataattaacagccactagaacaacaatataatgctgagtaatgcgccatgcatatgttggtgacgctaattgcctgcctgattagtttaagacaggctcgctaatgatgtcaaatgcgcgtcatagtatgcatcatggtcatgcatggcatgcccctagtaaagggtgcgtcatgcatggtatgaaaccatggaccagctgctgcacagtgtgtacgggtagaaaagtagagtatgaatgcaagtttatacatgtacacattcattttttgtcaagaaattgcaagccaatattatttgtgcagtttagccgcttgattaagtagttttaagtttttttagtcagcatatatattagctaactatctgtttggatatatttgtaccgcttaatttgtagtgcttgcatgagattctgtaattatcatttatcaaaaattaatatatattcttgcctaaaaagtagtactatctaagatagagaaatcatatatacataaaaatacacagtagttaagctcatactgctactatatatgtatgtgaaatcttcaagtgaaagccacatcaattacgtgttagactgctctgccacccctagctgttaattactttagtgcatgtgatagtagcttccagcatactcaatcgtgcgtggtcagtaacgacaacattttgttgtgggaaggacggtcgttttgtgatcatgcatgcagggtctgtaactaacatttggtaagatatatatatatatatatatatatatatatagacaacaacaaataattagtatttattttaaaactaacatgcatgcttagtccatctgcacttgattccttgattgtgctcgagggtaaaaacttgctttctagtccctttaaactctatcttgtcatgcatgccatcatcaatttaattaattaagtactcaatcctatgaattttgctccgtcagcgtatcatcagtctagccattatatctaagatatgcacaaattgcctagttggtacgtttcagctttcttgacatgtcctgctcactgttcacttttggtgcgtgtgaccttgagtgttcacaatggcaacaagcaatcagactagtgagatgatgactagcaagatgttttcatggattccaaatgtttgtttggctctagcctcaataatatgtatggtcaataagtgatgattcgatatttggttttttattaatatatagttaataatttgaagctatttgatgtatatatagtcactaattactcagctactagaggcattatttcggtgcgtatatatatctctctctcccatgcatatgcactactatacgaatatatttcgtgtgaatgttgtcaaactttatgcaagctatttaagatttgaaattttgcgccatgctgctatagatgcatgaattttatgaaaattttgtgagattatcaaaattttatgaattttattattatctctacacaatatttgaaaatatcgtaccactcggtatatatgcacctattaatgtgggtagaaaaatattgaaatgttgaaataaacggtgcatgtattttcccacagttgccaccagtatatattacatatataaatactgaaataaacagcttagcatccaggcatctttcatctttggctctttggtgatagactactgcttcattattcaatttcatttcatataatatatagtacttgcatgttgattagaagatcttcttcttgttgcttctgttgtttcttgtaaatatgcatgacttctttttttgtttgttttcatacttgggcatcaattatttttctattattatagtgctcacagattatgacgatttcatcacgtcaatctgatatcattcggttctcactagatcttcccagctggaagtagaaaatgcacactttgttatcttttactaagaaattactggttggcaatacatgtcaaagatttatcttgaccttgctactagggtaattcaatttgcaataatccgtagaataatttaactccctaatatataggtttgcattggatgggaagaaaatgactgccgaatctatgatggagtaagcaaaaattaacaagaatttatatgatcgatacaaggacaatcgatctcggctggcccacaaatttcaggtgtgaagtcatcagtcgcatgtttagccaaaatctggagagaccacttgacacacgcaattaatatattccccagtacagtctaaagaaccaatatatattatttgatacatatgttaatatatatactgatgtgactgacaaatagacaaacgagattaaattgtgggttttacaatacctgaatcatccttaagaagcaaaggattatacagcagtgactgatggtgattgattcaacggtgacttttggcgatatgttctgattaaggtcgtccatgcatcaatatcgtatcctgacaagtacgtgtatcacataattcttcactagcttgatttttttatgttgttacttagtaatatactacatctttttctaatatataataccgtttaccttttagcgttcgtttgatcattcatctttcttatcatgaatattcacaaacataaaaaatataagtcatatttaaagaaaccttaattgtaaatcaaatcacaacaaaataaatattaattacatatttttttatataagtaaggttaaaaaatcgattgtatttttaaaagttaacaatatcatatattaaaaattatagtcggagtaatataagctagccccatatatatatatatatatatatatatatatatatatatatatatatatagagagagagagagagagagagagagagagagagagagagacgcatgccataagccaccatcagtaattcaatgtaaaagttaggccctgtttagttctattttacgctgtcatatcgaatatttggacacatatatggagtattaaatgtagaaaaaaaatcaattacacagattgcgtgttgcgagacgaattttttaagcctaattgtgtcaacaatatagtgctacactaaacatttgctaataatagattaattaggcttaataaatttgtctcgcagttttcggtggaatctgtaatttgtttttttattagactacatttaatacttcaaatgtgtgtccgtatatccaatgtgacaaccaaatctaaacaatattccttcgtttgtcaatgccatagctagctagtactagctttttcatgaatagttatatattgtcttgcgtgtgtccttcaagatcgcaacaagcgaacaattgtcgtgctgacacgttactgccaactaattttgtcgctgcatcgcatggcctttgctgccaagttggttgcattattttgaaatcgcgcgttttcatgatttggatccaagttgcagctggcaactcggttaaacaagcatgcatgcgtgacgctacaaacttaattcgatgggctatttggatgggcacagcaaaatatattttgataaagtatatcgtgtcgttattggtaataaagtgttgaccacaattctaacaggtagtgtgactgaaatatgtatatatgtggcaactatattggccagctacgttaattgctaatctccattaattccataggaaatcaaagttcccatgttacaaattttggaccttccgaccaactttgaaatttctataccatgacctcctttttcggcgagctcgttagtctccgggaacggtgggcggcgactttcggctaagtatcgggattgagagagtacagggagggataggaggggaggggtggctctggcggcttagagggatggcaatgggcaagtaaacagcgaagcggcgagacaagacagaggcgttataccaaaaatacggggttagctgccagtggtggcccgatgttagcgttaggggtgatggtggaatttctggtggcaagaaaccgtcaaagatgggtaatatatatggctgcgcaagggaacctctccaactcaccttggagaggaaaggtgggaaaggggaaggaggaggtccgatgggcctgctaccattgttgacgccttccggcatcgaccagacctggtggtgcgacggtggcaacaggggaatcggcgacgcacgagcagtggcggacgcaggattaaaataaagatggggtgaggatgctcgtctcaataagaacaactaaacggaaaaaataccatatttatgttgtaatcatataaacatatagtataatcaataaattaaggcaaacaaaaaacaaaaatgatattaaaataaagtaataattttgcaccatacataattcatcatacataaaaagatactagtaaacatatcaatttgcaaatatgagtcaattcataaaacatggttgatagatatcttttaaaaaataactatatgagaagatatcgcatacc

SEQ ID NO: 15142 - DNA, 11882 bp, Oryza sativa
  unsure (1)..(11882): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttgattcagagatcggacggctgaggtgcctcgatggggtggagggcgcggatcttgatgtcgtagcgcggcggcggcggcgaggacgacggcggcgagcgggcggcgcggtcgtcgtaggcgaagccgacgtgggcgccgcacttgcggcagaggaggcgcgtccgccgcgtgaagaggcggcgcgcgcgcacgtccacgcaccggaactcgtccacgtgcccgaacctcgcgtcgtcgatggcgccgaacctcaccaccccccgccgcctccggtatcccccgccgccgccggcgacgaccatccccgccgtgtccctcgccgacgagctcagcttcaggtcgtacccgcacgccccgcagctgacaacacatacacatttcatccattcgtaagctactccttactaattaatcctacttaattaataccgtatattaattaatctgccaagctagcttggatcaagaaagaagatgatgatcgtaatcagagactgaccagtaggagacagtggagaggctactgggaagatcaagagctggctgatctggcttcttcatcgccattgacgagctgatcgagctcagctgctgcttcttcttcttcttcttcttcttcttcttcttcttccaagtcgtagttagcacactactccttaattaactaactagattctgctggatgggttggtagttgatgatgttgtgttcaccaatcgacgagctcatcgagaaatgggggagtttatatatggttcaatgcgtgtggaattcagaggaaagctggggcggctaatgattttgcgaggaaattgggcgggagaacgtgtgggtcaggaccgaccacggcaggtacgacgagccaagattgatactcctaccatatcatatgcactatgcagagctcctaactaattgtactgattagtgatattaatgcaggttagtacagtatgattcattgatgtggccggtgctcccagcgccacggcgtcgatcgatcgatcattccatcgcacgttccaaccaacccaatcaatcatcgaccctggaatctggataagcactaataatagtattatcatcgactcttttttttttcttatcttgatgatacaaaactgagagaatcacagtgcacatgtaggagtgctacaacttttaaagtaaacaacaatgatttaattaagtatttgttttgtgtactctagccaagagaaaagaaatagtaaaggaaaagggagaagtcaacgcctaaagaagtctccatttcagtaatatgatttcagtacagtactactgattactagtactgtacgtagttcattagttctgaccttccaaaatgggcgttgaactaaactgggctggaagcttgaaagcctaacagactaaatgaggcccaatttcaatttcaaagagactgatcgatctgggctaagaggccggtgaataagtttgtgtccggcctctctttgtatatcttgataatataggaataagttcacttcgtgaccctcaaagtgatcgagatctaacccgtgaccctaaaccacaaaaccggatatctcgacccccaactcttaaaaccagtgcaatttgactccctcggcggttttggagggcggtttcgctgacgtggcgcatacgtgacaatattgactcggtcttctgtccacgtggcgttgacgtggcacttacgtgtcattagaaataaaaaatatgggtgggacccatttgtcattcaccaaaagtacaggtgggacccactgacatgtggggcctacataaatcatatcctccccctctctttctcttcgtgagcgttggacgggagctagcggcggtggccggcgcctcctccaactccatccacagcctcctcctcccctttcccgcggcgtcgttgctggcggcggcggtgcatcagcccgcaagcggcggagacccgggagtggcactggagcggcgacagcgacgtgcgcgcgagggccatagcggcggcggcggcggagatcgaggccgccgtggaaggttggctgttggaaggaagaaaacgagccatgagaacggccgcgtcctcgccaccctcggccccgccaccgcactatccaccgctgcgctcgacgccctctctgccggccacgacgcacctgcctccgcagttctcccgccgtgcccacgaacacgtaagggccgcctgcgtctcgccaccgcgactcacgtcggcatcctctcgaagatggcggcattcggcggtggcttcttctgcacctgcggcggcagcgttgaaggtgggaggagcagcgcgggtgagggaggcggcggtaccaccgatggacgtggtcagcatgccgagccggccgacaacggcactgttggaaataaaccttacacgatgtatctagtagtagctagttttacgttcctttctgttcctgcatgcatgttagtttttctgttgttgcatgcgcgactggcctggacaacgggacgtgaacgcgtctctcggatcgcggggatggacgcgaaagaaccgggacgtgggatcgaatcctaagtctgttatttgcataataaaaggagaagaaaaaaaccgaaaaggtgcagcttcatcgcaccacaaaactcagcgtgtttcctcgtgttcgcgtgtgttttccacagcttgtttgtcgataacttagggaaacctgacaaaccttacacaatgtatctagtagtagctagttttacgttcctttctgttgctgcatgcatgttagtttttctgttgttgcatgcgcgactggcctggacaacgggacgtgaacgcgtctctcggatcgcggggatggacgcgaaagaaccgggacgtgggatcgaatcctaagtctgttatttgcataataaaaggagaagaaaaaaaccgaaaaggtgcagcttcatcgcaccacaaaactcagcgtgtttcctcgtgttcgcgtgtgttttccacagcttgtttgtcgatcacttagggaaacctgacaagtggtatcagagctcggttcagagcgtggacgcgagatcgcgctcttgagggtgtcttcatgcctcgaggacgcacgcactccccgcgccggcggtcggcgtcaccgtccgtgcatgtttcaggttccggcggccgcgcctcgggcagcggcgggagcgaccgcgggctggtgatccaccgcgtggtcaaggaagcaggaggtgcagcgaactacccgctgttgacaagaaccaactacaacgattggtctttgctgatgaagatcaaactgcaagcccggtgcctgtggggcgccatcgatccaggcggcgtcgagcttcatgaggataggatggcgcttgacgccatttgcagcgcggtgccccccgagatgatctcgaccttggccaccaaggcctcggccaaggaggcatgggattgcatcaggatcctgcgagtcggcgacgaccgaattcgcaaagcaagcgcacagaaggtgcgcatggagtacgagtcgctcgtccttcgcgacggtgagaccgtggaggacttcgccatgcgcctgacctccaccgtcaatcaactcgcgacgctcggcgatcccgagccggcagacaaggtcgtcgagaagtacctgcgcgtcgcccgtcccaggttcacccaactcgtcctttccattgaaactctccttgatatctctacactgtccctggaggaggtgaccggcagactcaaggcagctgaggacgccatgccattgccatcttcgtcctcagacaacgccggcaagctctacctcaccgaggaagaatggctagagcgccacaataaaaaggagcaggaggcaaagaagaactcaggcagcccaagcaaccgtggcaagcggcgaggcggcaaaggccgcaacggcggcggcgctggagtcggcggcgcgaagaatacgaactccggagcggcccgtcgtgaagacaaatgccgcaactgtggcaaatacggccactgggccaaggattgcaggagcaagcccaagcgggatgaacaggcccacgtggcacaagacgacgagcccaccttgcttctcctcacaggaggagtaatcacacatgcatgtgaacaggagcatgcaccagcgccgtctgcgccaactccgtcatccgatcccatctacctggaggaaaagaagctgttcgcggcgctcgacgacgccgcgaagcgtgatccgggccgctggattgtggactccggcgcctccaaccacatgaccggctgccggacggccttctccgacattgacacaggcatcaccggcaacgtccgactaggagacggctccgtcgtccgaatcgaagggcgaggcaccgtgctcttctcctgtaagaatggggagcatcgaaccctctccaacacctacctcattccacgcctcgctgctaacatcattagtgtcgggcagctagacgagaccggtttcaaggtggaggccgaggatggcgttatgcggatatgggatgagcagcggcgcctgcttgcccgtattcaccgcaatcctggacgtctctacgtcctcgacgtcgagctcgcgcgcccggtctgccttacggcacgcatcggcgacgaagcatggaagtggcatgcacggttcggccacattaacttcactgcgctgcggaaaatgggcagagagcagctagtgcgcggtcttccggctgtgtcgcaagttgaccagctttgcgaggcttgcctcgccggcaagcaccgtcggacgccgttcccacagcaggctcaacagcgctccctggagccgctccaactactccacggcgacctctgcggcccgatctcgccaccaactccgagcgacaaccggtactttctccttctcgtcgatgattacagctgtttcatgtggttgtcactgctcccctccaaggatggggcggcggcagccatcaagcgcatccaagccgcggctgaacgcaagagcggcaagaagctacgtgctcttcgcacggataggggggagagttcctggtccaccacttcgcggattactgcgccgagctgggagtccgacgcgagacgacggcgccctactcgccgcaacaaaacggcgtcgtggaacgtcgcaaccaatcggtggtcgggacggcgcggagcatgctcaaagccaaagggctgccaggtatgttttggggggaggcagtcaccacagctgtttatctcctgaacaggtcgtcatccaaaagtattggtgggaagacaccatacgagctgtggaacggatcgccgccggccgtccaccacctgcggacgttcgggtgtttggcacacgtcaagaccaccacgccgaatgtcaagaagctcgacgacaggagtaaacccatgatctttgtgggttatgagccggggtcgaaggcgtatcgctgctacgaccctgcctctcggcgcgtgcacatctcacgtgacgtcgcattcgacgaagaggcgcaatggaggtgggacggcgagacggcgagtgagctggacttcaccatcgagtacaccactgtgtaccacccagctgtggtgaacgcgccacgagctgactcggagcagccagagctgccgactccgtccgcgacatcgacaagtccatgcacacctgccgccacggcgggcacaactgcgacatcggcggaattcgcgactccaccaaccatcgccgcggacgacctcgacgccgatcatgatgatgctccgcttcggttccgccgcgtcgacgagatattaggaccggcgaccccgccgggactggctgtgcgcgagttcgatgacgaactcatgatggcaagtgctgaagagccagcgtctctcgccgaggcgcaacagcaagactgttggcgtcaagctatgctggatgagatgaaatcaattgaagaaaacggaacctggctgctcgtcgatcccccacctcgccagcggcccataggactcaagtgggtcttcaagacgaagaaagacgctgccggcaacatcaccaagcacaaagcgcggctcgtcgcaaaaggatacgtgcagcggcagggaatcgactacgacgaagtgtttgccccagttgcacggctcgagtcggttcgcttgctgctggcgtacgcggcgagcgaaggttgggccgtccatcatatggacgtgaaatcagcgttcctcaacggcgagctcaaggaggaagtctacgtcgcgcagccgcccggtttcgtcgtcgacggcaaggaacagaaggtgctgcgcctggtgaaggcgttgtatggacttcgtcaagccccgcgtgcatggtacaccaagctcgacgcgtcgctgctgtcacttgggttccatcgcagtgcctcagagcacgctgtgtacatgcgcggagctaacgcacgtcgactggtggtcggggtgtacgtcgacgaccttgtcatcaccggcggcaaccactccgagcttgatcaattcaagaaggagatgcgggagacgttccagatgagcgacctcgggctacttcggtactatcttggcctggaggtgagtcagaccgacgagggcatcaccctgagccagggtgcgtacgccaagaagatacttgaggcagcaggcatggttggatgcaacccgagccagactccaatggagccacgcctcaaactcagtaagttgagcacatctccttgcgtggatgcaactgattacaggaaaattgttgggtcgctgcgctatttggtgaactcgagaccggacttggcgttctcagtgggttatgtgagtagattcatggagaaacccactaccgagcatctggcagccgtgaaacgtgtgctgcgctatgtcgccggcaccatcaatcgcggctgtagctaccggaggaagaaaggagctgttcatctagttggattcagtgacagcgatctcgccggcgacgtcgacacgcggaaaagcaccaccggtgtcttcttcttcctcggtgacaacttgattacctggcaatctcagaagcagaaggttgttgccttatcatcctgtgaagcggagtacattgcggcgacaacagctgcttgccagggtgtgtggctggcgcgtcttcttgccgagctcaagggagaagaagccgacgccgtcacactcaatgtcgacaatcagtcggcaattcaactcagcaaaaaccctgttttccacgatcgcagcaagcatatagagaccagatatcactacatcagagaatgcattgaggaggacagggtgaagatcgagttcgtcagtacaaacgatcaactggcggacattctgacgaagtcacttgggcgtgatcggttcaatgaactgtgcacaaggattggcctcgtcgaagttaaagggacgtgcaaggtttagggggagatttgttggaaataaaccttacacgatgtatctagtagtagctagttttacgttcctttctgttgctgcatgcatgttagtttttctgttgttgcatgcgcgactggcctggacaacgggacgtgaacgcgtctctcggatcgcggggatggacgcgaaagaaccgggacgtgggatcgaatcctaagtctgttatttgcataataaaaggagaagaaaaaaaccgaaaaggtgcagcttcatcgcaccacaaaactcagcatgtttcctcgtgttcgcgtgtgttttccacagcttgtttgtcgatcacttagggaaacctgacaggcacgaccacataggagttgggaggcatctgcgtcgagcattctcctgctggttgccaaggcaatcggcaaggggcgacagatgagggctatggctagcaagcggtagcaacaggcagtgcatgtgtgtactaacatcaagcgacaagccaacaagcaaagggctgaccgaccgagcaaagttgttgcagataggcaagcagagcagcagattcgcatggacgatggcgcggccatggaggagggggacgcgaggggcgggagcctcgccgagcctccagcgctccccgctgccggccctcgagcgctccccgccgccggcgctccagctcccatccctgcagacatgcgaaggggagggaagagagagaagggagagaaagggaggaggatgaagaggagagaggataatatgtggaccccacatgtcagtgggtcccacccgtacttttggtgaatgacaaataggtcccacccatattttttatttctaatgacacgtaagtgccacgtcaacgctacctggacagaagaccgagtcaatactgccacgtaggcgccacgtcagcgaaactgctctccaaaaccgccgagggagtcaaattgcaccggttttaagagttggggggttgagatatccggttttgtggtttagggtcatggattagatttcgatcacttttgagggtcacgaaataaacttattctgataatatataacgcccaattcatatgctccgcttctcaattgtcgatccatatctattttgaattttaaagtttaatttttgaatatggtttgtccgtccactttcgaagacatttagtgaattttcctcaagtttcgtagaggaatcgatttgggttcaaaagagagggaaaaaaagacaacttcatcgcatagagaaaatccgtttttcgaaggcttacagtaagatgctaaggaggaccttagcatatactatgattgatagtgaataaaatggtgagaaacctgtgtcttaaggggatcaaacttagggatgtaagtggctaacccgcaaatctacttataggtcacaataagcgggttcgcgaattatttggacctataagtaaggtttacaggttagacacttagagcgagtataatagcaggctccaaatcagttataaacatatatggatggaataagagaagagagagaagaaaaacgagctacagatttgtagctagctgctgcacggactctaaaatattatgtgtatatgagaggttggaccatgtattgatagtgtagtatatatttataggtaactattatatgaatgagctattaaattagctatagatgatttggagctagtagttgactatactatttttttagataatagttgattgtactattaaacttgcttttacacccttaggttgtgttcggaagtatatgttcccaacacgcacagcgcgcacggaaaacagaacgatccattagcgcgtgattaattaagtattagctattttttttcaaaaatagatcaatatgattttttaagcaactttcgtatagaaattttttttaaaaaaatacacaccgtttcgtaatttaaaaagcgtgcacgcggtatacgatggagaggggttgggaatccagggatccgaacacagccttaattaaaacctaccctgacaactctccacaatgcaccaactagatgagctacatttcgttctcaaaagcattacaaactcctccaaaactcccaattggattaatatctcgatctgttcttgatcgtgcccggatttgtgcgtcccaccaccaataatttataattccatcccagtggcccagaaagagaaacgtgtgtctgccattggtatccatccaatggaacgaacaaaggctagctaacacatgaatcaaatatgcaaatcacaacaggataaataaacatataataataacgcagtcagtgtctggttaacagtaatcacgcatgttcgcctgttgagaagaaacatcacacggatcgacctttagggatagatgctgatatttaaacaaccaggcataatggttcacttcgatggcagtggtttaacagtcaatgtaggatgtggcaatagctacatgcctctctctttcaacttggattagttttcataagagacatgattaatttctttgagacttaattaacaaaacatgtacatcaagctagtgcgctactatatctttttgcacgagatagctcttggcaggattggagctatctaaaaggtactaaaccaattaatatatttatactagtcatcacatatttttaccactttaattataatataattttaataattgggtttaataaacaagctgaaaagatagctaaaccctaattgttctaggcttggctccatctatatcggttggggtaatgtgcttcaatccgcaatggctatcaaacgtataattaatcttgcgaactttaagcctgttgtctgatggtccacacatgagtggtggaaagcgctagtcatatgtcttttcacgaacgcgtaaacaaatatcacattattaatatattagaaaaaatcagagttttagttaaatcagaaagccattgtccgaggacaaggaaaaataaaaagaaaggaaaaaactgctaagcctacgaaagagaaaagctagccacctctgtcaaggcttacccaaatagagatgtgttgctcatcttcttgccatcatgggagatttgggggaagagaaatcagagagtctttaatcacaaagaatgccagtgacagtcttggtggggaaaatcaaacaagaggccatcccttaaaatccatatgcatatgttttttgagtttttatatttagttttactttatccaataaaattttcaccgacttatgtcggtttgtagaaaaaacatagtattaattaaaagggaattaattcccatccacaaaaacaacctagctatcaattgtaacccacggtagcaattaatcaggtatgaacaaaatttaatctgacaagatttgtggtcgtctcccggacacaaacatcataatcatccatgatatccgcaaaacaagatgttacaccaataatcttatgatttgcgctaccaactagcatatgcatggcccgatttcattgggtgcaaatataacaatagcagcaccaaatcatttgtaaaaaaaaatgtcatccatgtaaccttagctagcaaaatcgaatcattcaggtatagctcattataaactttgaccaacttaacgatggaactgccaacacttggacacggctttaacatggcgcttgaataattttatccccgattacctagctccgattaatttacaatgttatctgctatcactcgacagggaactaaccatatttcctggcaagattcgataaatactcctacttgtgtaattaaattatccctagtaactagtttatgctgaatgattggaaaattaatcgccaaagcaacaaactaaagtaagcgactgttgttaattaatatgatctgcgaaaagcagaggtttcgatgcctggacacgtacaaccgacagtcaggactcaacaatatttttttttcgcaaacgtataaaaatattgcacgtctgtatattagaacaaaagaaagttttaattgcacaacacaacaggccagaagacctattgccggagggaaaaagggaaataaaggaagcaaaagaaatgagagaaaaatgatgtatatatttaaacaggagacaatacatatgtatatggccagctgctcgtacatgcccatttatttttattctcttcattttcgatgacgctagaatatatacatttgattttttttctcaaaatgaatggtgatatattatcgtgtttgtgttccaaaaatcaattggtacaatattatgaaagtgacgacaca

SEQ ID NO: 15143 - DNA, 4923 bp, Oryza sativa
  unsure (1)..(4923): unsure at all n locations
atcaattaatcaatcacgtacggagaaaagcccaatttcgaagtgaatcataagattcgtacaaaccacaaaagtatttttttaagaacaaaaccacaaattaaaagtatgatcaaaattgttggcttctacagccaaggtagctgacgtgtctgaccgtctgcccatggatctttttcgcactatgaattgatgtgtgttacaaaaagagggatcaaaggcaagacccaatgaaggcgactcagcttcatcatgatgtgctctatctggttctcacttaagccttcataaaatgacatgaaaaatgaattgaaggggatttgcatgcgagattcacgttggcgacaggtactcactaacctttctgatgggcataggattggcatatttgtatatgtacacaaactatatatatgtatggtcaggcgatctgctagcccctgtttgctaaatgtacacactgtgccatgaaaaaaattgaagtgccatttaattagtaaggtaactggcatctaccagaaaaatacacatgcatgacatattatccaatgtgccagaaaaatacacccgacaccttgagacaagttgcctgaaaaaaaacactcatctatatatcatatgcatacagatttttctgacttgttaattattagcggggtgcaaaactgtcctcatggacccacatatcaatacacatacagtgcgatacccaaatgtgtaaggctacatgggaaaagtaatatcatccctaaggagatatcctcttatatttttttgctatacaaataattataaaaaattgaaaaagttgataagataaatcaatatgtaataatatatcactctacaaatatacaagtttaaattcaacatatacaagttgtaataagaaaacaaatgtgcatataaatagtacacatattcaaaatcatatgccgaatttgaacttgcatgtttgtgaaatgttaaagtaatatatcacatatatattggtttatcttatcaaacgttttcatatatatgttttcataaatatttaaataacatgtaaaattgagggatatgcctagcttaaagggtgaaaatccatccccagcctacaagagacaaaccatgtgcatccagcagcgattgagataataggaggcatccgtgcatgcacagtgtggtgaccactgatgactgatcgaccagcaggttcattggcctcatctctaattaacattttccctgcctgctagcctgcaattccactagcaagtcagtcattggtgtcctcacaaagcacacaaaagtaactttcaaatagtcttgtgtgttagttggtcctgggttagaaaacacattgacacaacatgcatctatcaaagaattcaaggcatgcaaccactctacatgccctgtccccatccactgttcccttttctcaacgattttttagcattaacatgcctatatgtgaatgatccatattgcctttagccctttatattgcatatattggtcatgcacatttggcactgccacaccacttgggctaatgcagcggttgttttcttctacctcatcatcattcttatatatctaagttaccatgtcgatctgttccaaaatataagggattttgacgatatatctgatatataattaatagattctctcgctatgtgtatatatatagctaggtagctgagcaagcagctggtcatcacggatcaagaagaagattagcttagctagctaaaaagtaagtagccgtgcgaagtcgccggcggtgatcagccggcgatgacgacgtacagggtgtgctgcttcctgcggcggttcagggcggcgtcgaacgagccgtcggaggagctcggcgacgtgttccaggcgtacgccgacggcggcggcggcgtgatgggggaggaggcgctgaggcggttcctccgggaggtgcaaggggaggccgccggcggcggcgacaacaagctggaggcgacggcgagggaggtgatggccttcgcggcggagcagaggctgctcaagaagggcggcgccgcttccgccggcggcgggctcaccgtcgagggcttccaccgctggcttgtgcagcgacgccaacgctgcactggatcctcagaaacgggtacgtacttaatttacgtgattagttagctaattaaactcgtaattaacacctaattaatcatgattatgcatggattcgacgatctcttcctccatcaantagcttatcttagctactcttgtgttcaatagatactactattaacaaatgagtgtgaaatcaatctgtaataataataataataataataataataataataataataataataataataataataataataattgataataatgctcctcctatgcttttccttttttttttacggaagaatgtagagtaggctttaccttatagtcatttcattaatagaaatgaggtttacagattacatattaggtgtgggaatcatcagagagaaaaaaagaacaaaaagcagaacaaaccaaaacagaaaaagagataatttacagatatatgtacatgcctatgttcttctatagaaactatatcccagttacttattatgcgtatatatataaggaattaattcacattcaggagcaactaggcaaggccttcatcgtcagatactgtacatggataatcatacagaggctaaccatggccatgcaacctagggaccatggatgagctctcacaagcgcctccaaaacaaaagaagataaggtccctagtcatatgagaatggagaacaggtcgatgatattggaataagtgaattcccgtctttcattatcagtctaaattttttattcaaaccaattgacgcatgcaactcaatatagtatcagtcccaagtttaaaccctagttggcatataattaaataaaaaatacaacatatttctatctgaggtttgaggggacctcgtgtgaagggaagtgttgaaatataagtgaattgtccgtttttcttcatcagcttaaacttttgggttaaactgttcgggatgtattacacaatagtgaaaagaatctgtgtatacaactcaatggtgtgaaggagaaattggtcgagtctatagaggggtcggtgcgtacaactcaatcgtgggaagtgaagaggaggtcggtgtgtacaactcaacagtgggaagtgaagagggaggttggtgtgtacaactctatttttttagataaagacaactcaattaatagtgggaagtagggggggggggaaggagggggggatcggtgtgtacaattcaatagtgtagaaggggaaattcagatgagcatgttgctgcccatgcgcagagctacgagaagactgcttttgcggtttcgcctaggacacatgccatgtgaaaatatcaagtcctttcggtgagcgaaggaccgaagtcctacataactttttcccttgtttggtactcgataaaccaaaaccaaaccgtaaaaactgaatatatattcatgtaaaaaaataatcctcgctatacaaataagttgaaagatatagctacaaaataagcagatgtctctctatgttatgggtgcaggtatatcaagacatgggattgcctctgtcacactacttcatctacacggggcacaactcatacctgacggggaaccagctgagcagcgggtgcagcgaggtgcccatcgtgaaggccctccacgacggcgtccgtgtcatcgagctcgacctctggcccaacgctgccaaggacgccgtcgaggtcctccacggcaggtgatccgctcgatcaaccaccatcctaccttcctacaatctccattgcatccttaatttcaattcacgacagatttttgctatacgacactagtccctttgtccacagattttgagcaattttacccatcctatatttatacctcgaggtaccacattttgcacataaaattttaataccttggatatcaacttttacactataaagtacctcgaggtacccaaaaattggtaccaaatattggacgctaaaattactctaattttttgttttaattttccatttcaatcgtcctctcatgtaatttcatcatctactactcatcctaactaggcgatgaaaatcgtggtatgaattttatcttaattttattatattctaaaacattaaaatactcatattttttggatgaaagtagctgttaactatgttaatttgtgaaatttatgttcaatataacagtgcctatgattaaaagtgcattaaaattaaaaaaaaggtttagtggccatcctagccgttgtgtatttgctgatgggttgtcctaaattaattaattagaaaaccaaattaactactgcagattcaacgaattaaattaaattaatgaaatggaaacaagaccaaactatggacctatatgggccaaaataaatctaccggcccgtcattaggagatagagtaggcccatgggcaatgaggtggcccatgggccgcgtccatcaccggcctgcttcacgacgccgccgcgcgcgccgcgacccgtcggcttcagctcaccgttgccagccgtcgccggagaagaagctgacgacgatttcgctcccgcaggacgctgacatcgccagtgggtctgatgaaatgccttgaggccatcagggagtacgcgttcgtcgcctccccttaccccgtcatcctcaccctcgaagatcacctcactcccgacctccaatccaaagtcgccaaggtgaacacgcatttgccatctcgatcacctcaccttcttcttcctccatatactgacaatggcggcatcgatcgatggattttcactcgcgcagatgatcaaggagacgttcggtgacatgctctacgtctctgaaactgagaacatgg

SEQ ID NO: 15144 - DNA, 11799 bp, Oryza sativa
gaaattgctgaggatattccctcggtcgacgcgcattacgtttcgaattataatcctttgatgggttggaggtatggagttcagatggttgcagcaaacatgcaggtaactagtgcaatttatgttatttctgtcacactattaataatggtcttattctgcatgataagcacatgagtcatcatgtttactttttcagttcagcattgcaattgtgttacatatagtggagtggtattctatttaacaaatcacaacttagtttgaactagtgaactgggatatcctcttgcagagttgcagtataaaaggattgtagcaaggaaacattttttgtgtctttttctaaaatcaggtctagcacaaggaaagtactgaatagtttttaaaaaaaaggctttgtgaagatacataatagttcacccactttgatctgagctatctgctaccattcatgttcagggccatggaagaaagctgtggctgactcaggggatgttccgagcaaacggcggttgcggttacgtcaaaaagcctgatattctgatgaacaacgatccagataaactgtttgatcctacatccaaactaccagtaaagacaagactaaaggtaaactggacaaaagctaaatttccttttattaccggaagatcccaaatgtgctactactatttttcatatctgctacagtaactgaaagtctgtaaccattgtgtcaatgctacaaaatctgaaggtgacggtgtacatgggagacggatggcgattcgacttccgcaagacacatttcgacaaatgctcacccccagacttctatgcaagggttagcattctgatcaatctcatgtactacttccgttttttaatagatgatgtcattaacttttagacacatgcttaaccattcatcttattcaaaaagtttcgtaattatagtttattttgttgtgagttgtttttatcactagaactactttaaagcatgatttatatcttatgtatttgcaaaaaaaattaaataagacgaagatcaaacgtgagcccagaagttaacgacgtctcatcttttaaaaaacaaagagagtactacatatctaacaaattaatcgattacctaagatgtactgaaactctgaatgagctgtacacagagaagcaaactctgaatgttcagttcagacttcagacatggcaaatggctgacaagaaaagaaaaactgaaaactactgcaggtgggtatagccggagtagaagcagacacgaggatggagcagacgaaggtgaagatggacacgtggattccggcatgggatcacgagttcgagttcccgttgagcgtgccggagctggcgctgctccgggtggaggtgcacgagtccgacaaccaccagaaggacgacttcggcgggcagacctgcctgccggtgtgggagctccggcgaggcatccgctccgtcaggctctgcgaccaccgcggcgagcccctccgctccgtcaagctcctcatgcgcttcgacttcacctgactactccatcttcttcttcatcatcgtcatcgtcttagtagtagtagttccatgtatgatatcatgagggatgaagcattgatcgtactttctccgtcccgaaatatagcaatgtaggattagatggaaacatcttaatactacgaatctggatatgtcctatctggttctggtttgctatgttttaggacgaatatagtacataaaattttagaagttttgttttaaaaaagaataaattttgtgcgaaacggaaggtgtgattgtacattttgtacgtacattgtttgttgttgattaataaacgtgttaataaaagagggaaggattcttttaatttcaaggtgttgccattgattacatgttggtgttgagccacaaatcattgttaggaatcactcacaaaggccaactaggtaggtgtttaattattttcatgtttatgtacaagacctctagctttcaatatgctgtgcaattgtctttgatctacaagtagccaagtccaagataatttggaattcaattcaatgttgaagctacatccatgcctgggtaatggtttttttttctcccatgtagatgaggttgaccacgcgtcgataagactaagtccaagtttaatagtattaatcttgaggtttcaaaacgtaagtcaaagggaagatagttgctgcataaaatttatgaggacaggaaaagatgaatgtttttaaggcgattctagcgtgtggtaaaggtcatttaggacatggttttggattttttttaaacaaagcagaaatgtcaattgtaagttgtctaaattctggaattcagcagtaagcacatcgggctatctgagggaagctggattaattatctgacatgaatattgaggcctcaagatagctggtaaaaaatgatgtttctatgaagtgacagatcatttattaagagcagaggatgttgtgatgtactcctactcctattatctgaaacgaaaagttggtttaatttagagtagaagctgatctgatgaaaagtgacagatcatggaaaagaaagaactcatatttgcagttgcagtaccattcaattttacggtttcaatgtcaaatttcagccggctcttgactttctgcatgcattgagccggtcagacatggcatgctgaaactgaatagaagaagaagaagaagacaacattgccagccagagataatgctaatctgctactgctacttcatcttctcatgaaaagtggtattaatataaattcatcttctgcggagacttggaagatgtattaattgtcggtaccaaccgttctcaactctgaagttgatgtgttccgctgcatccccaccactaattcatatgaactccattttcatcggccaatcttgaatcttccatccatgttgaaactgtgcttcctgtgaggtaacacagcggattagtcatgcgagataagcagttcatcagaggattagtcatttcttcagtacagaaggtttttctgagtcaggtttctgaattttccagtgaagaagaggatgtccacccaatttctagaacctgaaaccatattctgacggctgtgtgcactctttgggtgcagaagccggaggtgctcccagaataattgtatcacttgatagaattttactgagattaataaagcttccattatctaaaaaaaaatattctgacggcaaagttccaacgatcctgacgcggctggcacaccaattaatggcccaaaatatcaagattcattcatagcctattagccttgagaaaaaggattccatttgccattgttaagatgacaagtagagacagcaagtggcactcataacgtgtagaaaggattcctgcctggatcatgagagattccaaccaagactggttgtagtgcctgtaattgcacgcaattcaggaccagtattactctgacctgctcttcattcttcagactccagaattctcatgcacgttaattcttgggttaatcctgctagctgcctagctttgtatagtactcatgtattaatatgctgtgctggggttcatcaatactacttagtattgagtgagatgcttggacaaaataatacttaaccaactactccataactaactgtcttgacataaatggaggatcattcagtgtgagtggtgagtgaggtgtgaacgaacagtgggaaacgatcagagaaacgaaagcaacatccaccatccataatctgaatctgtcaccattcatgtgtgaatcgaagagcaacaacaacaacccggaattgaaagacacccaaggagcagattagccatcctgcccccatcgatcgatcctgtatttatatacgcatatgtacagtacaacatgcaagatacctgcatatctgtattctactggacttctgaattctgatcaaatattcagaactaatcatatggtgacaactcataacgagtattccatatctcttttaagataaataaggttttatagatcttagacaattatatcgtaattactctaaaatcactttcagcctcagcataattaggatacacaccctatgattattgttttttaaaaaagaaagatgacatgacaacaaatgccatatcgtgtcatgacaaactacaaccataagtaatattcattctcaaactccaattaagtattctatgtctaatctttgaaattacattttaccatattagtattatcatgacgtggatatatatacatgtacaaaataagcatttttccagaaacatgctaatcctcgtagtactactaatctagtcctgacttggactctgaacgagctaaccttgttgcctttgactgctttgaccgttgacccagcttgggtcatgcatgactggagaacgtggcactccctgcaccgtcggatcatgaccgtacacaaaacaagctggagtagcgtgtgcccttgatttcttccatggctaaacaaaaagtccaaagcatggtaaagctagtctattactgtatcctcataaatcagcaactaatcaagcatgcaaaaggcatgtcagtaatattagctaatcaactgatcatgtggaagtcaatgctagttttgatggttcgtagtagcagccacagctgcaaaaaagtcaatcgatcaggtgaagaactggctcattaatcgcacatgcacgtgttaggagagaactaattactactagtataattaagttgccatatacaagaataaagtatgagaatagtgacctggtcaatgatctttcagaacgaaatcagcgatgacaaccgtcaagtttatacctgaccagacgatgtattgtaattaaatatactccactagatcagcattagaagtttagtattgtaatccacaaaggttacttattagattggtgagtagattatgaacccaattagggctcctttgaaatcgaaagattctttttgaaggaatgggtaagatatgaatctttgtatgatcttcctacatacttattaatacttctttagaacaaaggattttgaaattcctgtaaaatggacaaatatataattgtttggagtaggaattttagaggaaatctaccgtaaggtccaagcttatagaaaattttccaaacaacacaattcagcaatcctcccaaggactatactatcaccctaatttctatattttttctctgttactactcttttcaattcttacatttcaaaatgagcccttaggttgttcttcaggctgtttaaaaaaacaaaaaatggaaacagaagtggcggctgcattaggtgaaattcagagttggcacagtagcacagaagcagtacaacaactgcaggggatgcgaagctgccgacctgacggccagattcgggcaccagaatctgattctgaccgcgaaacgcacacggaagattaggctaatcctactggtaattttgcaacgcgatgatggtgattgcttctcgttcttgacaccggccagccattccaattttgctttgtgcaaatttatttctttttcccccactttcttttcctttttcttttcagtcagagcttgaaaggaaaagagcaatggtaggacacacaagctgctgcctgcagtagtatatggttctttaatttcttggcaataatgatctttatttaatttaggagaggtgatgcagggttaactatgaactatgctgcatttggagagaacaatgatagccttggctgcaattgtacacaattgatttcggtgctttgcccagggaacagtatatagttagtagaatagtagtatttattttagattgtcatagattacgtgtttcgaacatgcctttttgacgtttacctggagtttgtttacttgagaccatcataacatttgaaccatgaatagtagtagtccagtcaaaagccaaaactatggccatacaatacaacaccacagaagccccaactttagcaggtattactactttgcaaaaaataggtgttagataaagcccttttccttttaccactaattcaactgattaggtacaatagattcatattttaggataacttattatatattttttcgataacaagtttttttcgataacaaggaagaggcgaagagcacatatgagcacaccagtatctattgtcctacgcacactataatcaaacacttgcgaatgcgcctcataaaacatgctaagatgtaatgtaaatcaacggtagttccctaccacgaaaaaagtttctataaagaacatatccgtatctattatagctctggtttgcaaataaaaagaagagtaaattgcatttagggccaccttttatcaccaaagttccactttggactaccctttaaactattttttcactttggactagattagtttgcctctgtttcactttgaaccaccccaaaaacttttctcgagcacataaatgactttaaccacatcggcacccataaaccgataatctttccgacttatatagactattcttcgtaagattagagggtagatgtagttagaaaagtgacttggggtggtccaaactgcaacaaaggtaatcttacctagtctaaagtgaaaatattagctagagggtggtccaaagtgaaactttggtaataaaaggtggaccaaagtgcaattaactctaaaaataattgaggcttaagctagtagcctaacacagggcctgttcactttgatgccattttcaactttactaaattttggtaaaattgccaaaaaaatggctacatttagtttgctaccaaattttgataactatataagaaattctgccacaaaattttggcaactataccaaaatttagtaaggtttttttggcaacaaagtgaacaagcccacaatattttactatgtgtttcctccagctaaataacaatttctcatttatagtatgttctaactcaagcatgaaaaggctaaagcaaaaattcctttttattttctctagattaaaaataattatcgttttagataaagacattgccactttgagtactacagtatatgtacaactatcaataaatacataatttttattaaagtattttttaagattaatctatagaagttgtccatatgtatgagaaaacgagagagtacacgcagggaaagtatttggaagatcctaccagtagtagtacaaaatgacaaataaaatttgaccggagtgatagtggtgtggcgctacgactggactgacatactcctcggaaccggtggtgcctcgaaacgttcatcaaacgcaacgtgactccacactcttttgttcgttacccattccagcctggcacccgatccgacgcgtccgtccggcgacccggtttgacccaccccagtagcgtgtcgtgtcgtgtccgcgtggcggaccgcaataaaaccagtctcagccagcgtggctagaaaaaaaaccaaaccaaaccggggaagcgcgacgcggccacgacccgaccgacccaacgcggccacgcgtctcgtcgtgtttctccttttccacctccccttttttttccacgcactttaatttgagcaatttaatccgcgccttcctctcacaagtctcctcttcttctacgtactcctctccttcccccgcgcagccgtacacgactcccgatgagatgacggccaccgccgccgtcgtcgccgcccgcctcatccaatgaccccgctcctcctcctcctcctcctcccccttctcctcctcgccccggcctccgcctccaccgtcgccatcgccgccggccccaccgcctgcgccgtcgcggagggaaactccaccgtctactgcgcctccgccaccaactcgtcctcctccgccgccgtcgcgccgttcgtcagcttctcccaggtgtccggcggcgggggggcgttcgtctgcgggctgcaggtcggggggcgcgcgctcttctgctggcccgccgcggcgccgggtcagctcaggcgggtgtacaacggcccgggccagctgtcacagctcgccgtcgggggcggccatgtcgcggcgtacgacgccgcggcgcgggtgatacggtggtggcgtggcggggaccggttccctctctggttcggcggtgggttcgcctccctcgtctccggcgacgacttcacctgcgccgtggagacgagcacctccgccgtccggtgctggggcccgcgcggcggcgccgtggaggcgggttttctcaacgcctccgtctccgccctcgccgcgggaggttcccgcgcgtgcggggtgaggaggaacgacggcggcgtgctctgctccggcggtggcgtgctcgcgccgcgcgaggacctgtacgtggacggcctggccgtcggcgactcccacgcgtgcggcctcctccggccgaaccacaccgccgcgtgctggagcctcgggggcgccaccaccacgctctactacccggcggtcggcacggcgttcgagctcctcgtcgccggcggtaacctcacgtgcggcctcgtgtcggccaacttcagcctgctctgctggtcgagggatgggttggtggcggcggaagtgaacctgccgccgatcctccccggcgtctgcgtctccgacaacagctagggcaaatgcggcccgctcccggactccgggaggttcttgcaggtctccggcgacgtcatctgcagaaggttctgtgacacgttgccgccggcgccgccgccgtttccttgtacgccggtcgccgcggggaccccgagctcgagacgcggcgtgtccaaaggctggatcgcgttcgccgtcgtcggcgcggtgggctgcttcgcggggctctgctccatcgtctactgcctcctcttcggcttctgcagccacaagaaggtgcacaactctgtccagcccaacatcgccagcaacaacaacggcggcggcggcggcggcgccgccgcatctgtcggcagtggcgcgccgagcccgtacgggtcgccgaacgggtcgctcggccgcctgcggcggcagctgtcgcgcgtgatgacgcggcagcggagcgggccgtcgtcgttcaaggaccccgccgaggagttcaccttcgcgcagctcgcggcggcgaccaaggacttcgcggcggaggccaagatcggggaggggagcttcgggacggtgtaccgcggcaagctccccgacgggcgggaggtggccatcaagcgcggcgagtcggggccgcgcgcgcgcaagttccaggagaaggagacggcgttccggtcggagctggccttcctctcgcggctccaccacaagcacctcgtcggcttcgtcggctactgcgaggagagcgacgagcggctgctggtctacgagtacatgaagaacggcgcgctctacgaccacctccaccccaagcccaacggctcgtcctcgccgtccccgtcgccggtggccacgtcgtggaagctgcgcatcaagatcctgctcgacgcgtcgcgcggcatcgactacctccactcgtacgccgtgccgccgatcatccaccgcgacatcaagtcgtcgaacatcctgctcgacggcagctgggtggcgcgcgtgtcggacttcgggctgtcgctgatggggccggagacggaggaggtgaagcacctgtcgatgaaggccgccgggacggtggggtacatggacccggagtactacggcctccaccacctcaccgtcaagagcgacgtctacggcttcggcgtcgtcatgctcgaggcgctcaccgggaagcgcgccatcttcaaggaggccgagggcgggagccccgtcagcgtggtggactacgccgtccccagcatcgtcgccggcgagctcagcaaggtgctcgacgcccgcgcgccggagccgagcgcgcacgaggccgaggccgtcgagctggtcgcctacacggcggtgcactgcgtccggctggaggggaaggaccggccggcgatggcggacatcgtggccaacctcgagacggcggtggcgctctgcgaggacagcgccaccggcggcggcgccgccggccatggcaacagctcgtccagcgccagcctctccatcacgtccatggagttgagtaggatggattgattgagattagtagcttccctaattcaaatccagagtttcaaattgtgattagccccggaaggagattttaaaatttgttgcttcacttcattttttttagaggagaacatcatttgtgtgattctctcacacattttgttcatggtggctgtacatgattttgtattgaactgatttctcttttcatagatgagaaaatttctctctttttttttctactacaaacattcaacaagaaaccaaccacattgatttcattcaattctttcgataatggaagcataagtgcataactaattctttcgataatggaagcataacttcttgcctctgcaaattgcaattgaatggtccatgccatatcattttatcgtgtttgaattttcacaagtgaaatttcaacaaattgcgtgtgaattgaagagagcagttggttgtttggttggtctacatggttatacacaatgcaagcacaacaaaaggaggccgtttacttttctcccttctctctgcattcacatcggtttggtcgtggatcctgtactcttccatgatcaatatgtactcttcttccttgatccttatgcaacccacactaatcatgatgggaagaccataattcagcaagagagcaaatgccattaatcaattgtgagctgaatttgttaggacactctaactcaagaagatgctgtacatttagagtgacaaagctcctactaatcttcagagaatagttctattagggattacattagcgccattaggccctagtaaacagtagtgccgacaaatgctatctccacatttcatagagaggtagtagtatattatattagtacaaatgcatagggatttaattactgtgatctttgtccctgacatagtacattatggtcctactcctaccttacacaacattgcatttaaattgcattttgtccatacaggaacattagaggagaagaaaatggccgcatccatatggttggtgaaacaaatccttcgtcttgttgctttaaattgcatttcagcttcagttatactatctatctactctatctaatgtaggtatccccacatttcatgcccatcatgcttgaaaagaaaaggaaaaagaacatcttttgtttttcttaaagactcaatatatcttgaaatggatagtggagcaggtcaaagaagatgcacagtgttgaaattttcagaaagctaaagctggtagtatgtttgtcagtgaaatgtagtaaaggttagtatctaatgattgaggaagaacaatcattcgatttgagtacgcaaaagcttgtgccttaatagcactccctcctgtaatcctgttccacaaaaaagcagagatatactgcagaaaaacagtctcttcagattatggctcactgaacctgcaaaaatcacaaacaacaaaatgcttaatctctgatgaacggcatgaaccgcagctgataatatcactgtcaggacatatgatcaatcagcttggtctggagaaaaacagtctcatcagattatggatcactgaacctgcaaaacccacaaacaacaaaatgctaatctctgatgaatcactactgacaatatcactgtcaggacatatgatcaatcagcttggttttgccatcaccaaccatgtcactttccatttggcac

SEQ ID NO: 15145 - DNA, 10237 bp, Oryza sativa
tttttccagctcaaaagtgtttgttttattaatctttttctttcttaccgaatattgtttctagctgcaatttttctcttaatcatatgttttttcatcatacttatacttatacatgatgttcctgcagactttaaaaaattgtcttgaaaggatcttgcaaattttatagcatatatataatataatatagagtaatagattaagcgttaatttctaagtgggtttcttatggccttatgggccatgatttttggactgggctgatgatgttcaaggcctacagatgactgtgcccagtgggccatttgggtccatgttgtatagggcctgttcactttgatgccaaaaaaaccataccaaattttagcattgccgaaattttggtaactgtgtcaaaattttggcaggcaggatttcttatatagttaccaaaatttggcagcaaactaaatgtagccactttttttggcaactttaccaaaatttggtaaggttgaaaatgacatcaaagtgaacaggcccatatagatagttcctttttttttttgagatgtgttgtatagatagttcaattgcctatctctctgttccacttcctcaaatttgacttgagagtccatggcaaataataaagagcactcctatttgggttcttttgatcaaatttggtttcgttcaggttcaaacagaaatagtgaaacaagtgaagttgtttgacattgcttccaagactgaagaaaaaggatggtagaaaataaagactaagtaaattatgatgaatgctttttgttggttccaagtcaatggtccacaattgcggttagagaagagaaacaaatcaagtggtgataaaatgattcttttttttttctgaaataatccacagacaactctttacattgtttgataagagcaatttttttaagaacagataatttattttgttatttcctaatattttaaaattctaagcagatattatcatataaatatagacatttaatatgtactaatccatcattgtaacctacttcctccattaaagaaaccaaatcctagctatgtgtctggacatacactatatatatagttaggatttttttttcatagcaagagtatactacaacttttgtcctaaaataaagttattttcaacacaacactcggtcccaaaatgagatgtttttcatcaaaatgaatcccaaacattctttatttaatttattcacccactttatttttatcaacaaatcacaactttcattagattattttcacctagtttcttaatattctgtccataccaaaatacttatatttaagaagggagataattataggggtggcgtgtgcacttataggatgagtttgtaatgcgtttcttttatgttaaaaaaagagagatggaggcagtagttttgtatacagcttacaaagtcgtaacaaacttctaccatcgatgatgtcccgttacattatcttcattaattaatttatataaatacctacgttaatggctaaaaacggtggagtatcaaatcaaaacagactactacaaatttatcttttctcgaacgaaaaaaaaaagcgataaaaaccatctcatcgaggaagaaagcaacccacgataaccctcttcttcttctacccatctcgccgtcgccgccgccgccgccgccgccgccgtcgaatcgatcgaagcccagcagcgagcgatggggctggactactacaaggtgctcggcgtgggccgcggcgccaccgacgaggagctcaagagatcctaccgccgcctcgccatgaagcaccaccccgacaagaaccgctcgccgacgccgacgactccctcttcaagcaagtctccgaggcctacgacgtccgtacacctcccctttctccatcgccggcgccgccgcactccaccttttttactcacccacctcctcctcctccggcggcgtgcaggtgctcagcgacccgcagaagcgcgccatctacgaccagttcggcgaggaaggcctcaaggccggcgcggcgccgccgccgaccacctcctcctcctcctcccacggcggcggaggaggcttccgcttcagcccgaggagcgccgaggagatcttctcggagatgttcgggggcgcattcggcggcgcggggccacgcgcccccggcgccgggttcccggggttcggtgggtccccccgggcaggggagacgtcggcgacgaaagctccggcgatcgagcggcagctggcttgcagccttgaggacctctacaggggcgccaccaagaagatgaagatctctagggatgtcctcgacgccactgggtgagacagatttttctcccttttttttctattcaaatcgattcaaatcaaacagattattgcttagagttccttgtaaaaattggcattgctgttaatttgttgtgtatttgtgatcttggtgagcgagtctgcgaggttaggcagtagcagtagcacccttggtaaccagctcttcttgcctcatagcatgcacctactagttctagactgccattgtagataatctaattttagcctgccattgattcttagataatcatgttgctctagattccagcctgacattgtacataatctaattttagcctgccattgtagataatcctgtcgctctagattttattctgtcatgctccagacgagtaacctcatagcgacctttatgttctagacgttattctgtcatgcagtgaaccagcggcctcattgcaattgctgattagttaatgtatagcacaatgtaatggtagggaagacggagtaaaggggaggaaggttgagaggagaggaagattgagggtagtacacgagaggagacatgagagaaggtgaggacattgcaatagttgcttagcttgcctgatgtcctcatgggttatgccacttcacattttcctgtatgtttgctccattgagatggcataaaaatgtgcaagcattagtgtgcttcaatccatacttcattacttctgttgagtatagcctcttggtgcttaatctaattttgaacgataactgatatgactgaaccctagctctttggtgtggctccatgtagcctgatgtaaacttcgtatttagcgttaaccttgagctccatgcatcatttatgtgtagttggaaatagattatttcagtaacggaggaatgcttttatggtctgtatttattgtaaactgcataaactgttccacgtgttgagaaatccgatctacatccagctcagcatgctgctagtgtcctcttgtgttatggtttgtttgagataataataaattctacctttacaacctttccagcttcataaagaatccttctcaataaacactttctgacattgcagctacggagctactactgtataatgtataaacattaaaataaagtagcattttaatatttttgtgcaccctgtttgccttttctggtactgtttgtaaccaatatgtcaatattcgtcagctaatgtacttgctgacaaaaaaaagtattatttccactttgtcatctaatgatagctggtgtgacagttgacaattgccttctcgcagatgctgttatgtgatggaaaattattactacgttcatagcttatattttgctgcaattaggggtcctattcaaaacggatcttggagggtttaacttctagaatgttgggttcctgagcataattagcttgtgtactaagtccacagattacaaataggatggatatcagagtgctcagaggcatgcatagattttggtgattgggctttattgttgtgggatgatttaatgtccaccatcagagatagacaattgtcattaatttcagcattcagaatagatgtattgtggtgctgtgtttacttgtttacttacagtggttggggcccttagttcttaggtattttttgtatagcctgtagtaaagtcaggcatacttatgactatgagagcacctgaacaaaatgtattactccttttaaattaaagcttactgcacttagttgacataaaaatttcatcttcaagaacacttagggcattgtctgtcctctaagtatgcaaagatggcccattggaacctgtaatggtatgagatgacttacctaatatgaaagaacctactccgtatttatttaattgagtttggagcagcactacaggatatttactatttgttatgtcagttttatgtcaatttttgttattgtcattcgacacgtagcaatcatttttaatcaagtccattgtcttctgaaaaaagtagcataaaaaataatggcagaaataatggtgctttggaaaactaaagcttagacaaatgattcatacagtttgtttgtttgtttggtgatttgtaaataaagataataatataacctcatatatcgggcatcttgatgattattagtgtttgggctatagtgatgtcatggataaatatgcgtaattgtttatatgaaagttattatggtttactgtatgctgcatggataaggcttcataattgattatgccaaggtgttacgtatgacattcaatgattttctgaaacttcaaattcttctttgccgtaaaaggagctttgacttttcggggaaaaggtaggcctattatttccgtgccctttttacaaaatgtttctatgtttttgtgcaggaaaccgacaaatctggaggagatcctgacaatcgatatcaagcctggatggaagaagggtacaaaggtaacctttcccaagaaaggcaatgagaagcctaacatcataccatcagacctagtgtttataatagaagagcggtcgcacgctagattcaagcgagacaaggatgatcttatttacacgcataggatctcgctcgtggaggctttgaccggttgcacagtccaactgacaactctggatgggcggaatttaaccgttccagtgaagtccgtcatcaatcctacttctgaagaggttgtgaagggcgaagggatgccaatcacaaaggaaccgtctaagaaaggggatctgaagatcaggtttcagatcaagttccccaccaatctaacgtctgaccaaaagtcagggatccagcaacttttgcctaagccttaactggtagtacaatattgtgaacctgtatttagtcgtttgtttagcagttgggaatacattgagagggtttgatcacagttgctgaatgtacaatcactgcttcggtgcaagtattgaagaacatgtttgcattggtatttccaacattactccaattgattgccaactgctaacagagtagcagcagttcattctgtcaatgtgttcagcttcattgtggaaaagcagattttccttccttgagatatatcctaaaacgttcctttgtttctttctcctagcttaacacttgtaaatatgttccaggtgcatacttgcaactggacactagtaatccttggaccatatctcaattcccaggtgcatatactccctccgtccaaaaaaaaaaaagacaaaccctggtttccgtgtccaacgtttgaccgtccgtcttatttgaaaaaatatgaaaaaaaataaaaagacaagtcacatataaaatattaatcatgttttatcatctaacaacaatgaaaatacgaattataaaaaaaatttatataagacggacggtcaaagttagacacggaaatcaagggtttgcctttttttggggacggagggagtgcttgttactggacacaagtaatccttgggtcatatctcaacttttcttggctatttcctgaaaactactcctgccattttgtcattttgcagtgtttctagccaggtctgatccacagatacattcagtcaggcctcatccacagaaacagtaaaagcaatgaaaactctgctcaatcaacagtgaaaactatgcacagatggggaatgctttgctgatatatgacataaatttgcacatggtgatgataagatccagtgggttccgtaagtgttttccttgctatagttgctacctgagattgacctcatctgctgcttcaaatggtgaagacgacgacatggtgataagattccagaaagttcctgtccgtcgatcgatgattgttgtcagtgaagactgcaagcgttaaaagcaggatggtgatcttcttggacgaggtatgtccgagtgcccctcatgaggctgacggcacgttttggaatcccctagatttccaattccaaatcctactgagaccttaattcgcttaacccaactctaaaagaagtttatataacatctatgaaagtgtgaaattaattttccttaattctcttcaatcctttcctcacgagtattaaccccttatgaagttgacggcacgttttgaaatcccctggaattccaattccaaaacctcccgaggcattgtctggacgttcggttaatcctaagaaagggttcagcagctaggtctcatcatcatcatcttctcctggccggaatatcgccattgccgtcttccagtgagacggctggctggccttttcggccggtgtcgctggccggagtcgctgtcggagagggagaccggaggttgaggagatgatgatgatctgccgtgtccgtaggtgctccactgctcagcaacagtgcaaaaacagtgtagcaacagtgcatatttgcctttttagttgtagaaatactatagttctagtgtggacttttggggattggaaaaatttatcggatcacaaaccaatggttgaggtgacttgaggttgatcctgggggaattcagaaaggcttcatttgatatggagttatcatataataatagaagcacaaaagtgtcatggattgctgaacaagaggctcgcgatgtgtcggcaagtaacaaccgaaaatcagcatcgaaactattggtatgtttggttatctaccctatattttagtaatggtaaattcttggtatattctagcgagaaccgataaggggcaagggaaagaatatacaattagcatgttttggtttggggacaaggtgggactcatttttttttaggatgagatgatcccatctatctgttggcattagggatgtgatgatcatacttttaaagtaatagcccatatatcgaccagagaaaaagttggttggattagtccgccaatttttaaaggatcatgccaaactggatcttagggaaatattctctatcaaggatcatcttatcccacatgtccctaaccaaacacattgaaaaataggttcaacctaacccgattcatctcaaccctttaaccaaacgtatgcttaatgttgctgttgtattcttatgatatactatgatgttttttctttaaagaatggtcaagggagggggggagtttttccacctgaattttttcatataacagttcgaaaagagggattacacagttttggctcagattacagggtatctcaaagaggaggaaagggtttcctttcacgaggaaacaaccactctatcattaacgttaagacattcctcccagaggatggcgtcctctaagcatttcatcactaatctcctcatcaaagattgcatcccgtggaacacaacatcatgacggtgaatatgatgttttcatttctccaagaggttcactttgtcaatgtttatgtaatgacaagcagatgacattacgaataatgcaaattaatggccagctataatgcccctttaagatggttgctgtcaagagtggtccatcaagatcttaggaaaaaggggcgaaatagccatcagaaaatatttgcctagctagggagtatatcttgcttttccattgtggttgtcagacaacgctatgccttttcctttttattggttgctacctttataatcagataacgatcgattttgcaggtgcggcagtatgtaccgacaactgatcaagtcctcccatgttcaaaaaaacacattatttgttattagaaaaaacatattaaaaaacacattattttgggtgtcgccaagagctccaagcaaaactcttggtagctattttattttctaccaaggcattttatagaacctgctaaaattatgatattatgaaaccaattttttgtgtaaatccacgtgtacagattcgatacatccaattctatacctggggtgtaaaagactgaagattttaaaatatcatgaccacaattcatcccataggagttgagaaaaaatccctatgttccaaacaacgcgtcacagggtacatccaacttgtcatgactatcttgccttaaaaaagaacttttcatgactatcttatagaggaatcctttattaatctaaaaaatgtaaaatcctaagggaaatcactggatgtgtagtattaaaggcgtgtgtgcatggttccaccctaccaggaattcaaaaatcaattataggagcaggtgagcactttcaataaaaatttagtgagactaatgatttgtctttaacaatatagcccagtcccgcgcggtcacgcaggcctgccctgcggcatcgacccgtgtgtgtgcatacatgcgtatatgcatgcatgtgcagcgggctgatcggtcacgcgtggccggcctgagtaaccgcgcagtgccgtgctgctggtccgcgagaccgacgcggtggttgcgtccccccgtgtgccaccacgataccgctctcccgggttgcgggagcgaggcggtcccgcatggctgggctatgggatcgccggtcccgtggaatggtaatgcgggaccgtctcggtcccgcgtaaccatactgcgggagaggtatatttgtgtaaattttcggcacatagatatataaacgcaagataatgaaaaaagagatatatttttaaatttaattcgctgtttgagccggtgttaattaagagagcacactcagtgagttgagtgtgcatgtttagtgtacatgcgtagtggtgtgtatatattctctccgttctaaaatgtttgacgttgttgattttttcataacatttgattattttcagtgttgattttttcgcactgtttagtgttagccgttaaaaaaatatttatcttatttaaaagtttcatataaatatgtaaaagtataacataatattatagtttcttacatgataaaacaaatcacaacaaataaataatatttatttttaaataagaagaatggtcaaatgctatcagacaagttaacaacgccatatattttgactcagagaagaaaaaaaattaggaaaaacctcactcgctcattgatcgacacgttagtgacctgcgtgcacaagtccccccttatctttcttgacacccgttatttcgaattaacacacaaatgggaaaaaaaacatgtaatataagctagtctgcacacacatgtcgctgacaaagacgagaaatcgttttcgttcacgtgccaggtgaagggaataatatattttgggataccatttggttgtggatgcatttgagcaaattagtccatatatgctttccaatgtcattttcaagcaacaataatggagtttcgatttctttttttaacccttttttcttttgtcttcacctttgccttccattgtggctatggttaaggtgatgatcatgaccaggagtttccttggtagatagcaagtaatgtcattatcttagtatcttcctcgagctaactagccagttattaattaattagataattaattattccaaagagatcatatcgatccatatatgtttattcatactttcctgatctccaaataaacaaaccgagatacgttctggtattacgaatttgtacatactgatcagtctctagtattagatttatttattttgagatgaagagagtttaggatataactaaccatgtgatgatcaattagtgacgtgggaggatgtgcgtatatgctagtagctaatcatgctattagctatagctagttaataattatagctagctaggagggataacctcttgttaaatcacatggattagttaatcaaatcagatagaacaacaagagaatactagtatataaactgatcattaatttgatcgagaaccgacgatgacaagacaatcaattgcagatcgcaacaaactttaaataattccgtttcatcacatgaatcgacaaaaagctagtagctagctagcatgtccatattaattaatttattactaatca

SEQ ID NO: 15146 - DNA, 8003 bp, Oryza sativa
ggccggagatgatgatgatgatgatattattgagtggtggtagtagaattaggtattgtggcggcggcggcggcgaggcgatcgacctgggacttgccgcgggggccgttgcggcggatgtagaggcggtagtcgtcgaaggtcatggggctgtacagcggcggccgctccggcgacacgagctccggcagcggcgccaccggcaggtcgctccgagggttgtagaaggtcgcgatcgacagccgctcctccgccgcgttcaccaccacccggtgctccacgctccggtacaatgcgttcgtcaccacctgtgtttaaatttaattaattaattcacaaatttcttctttattagataataatgcaccaactagctaaaggtatagtaaaatttatatgaccaccacacactagagtactagacctctttaattactttggaacgcataaattttacaagatgtttaaaaggacagtttattaatttcctttaaattttcataaaattcctctattccaaaaatgagttcttagtatttttcaagaacgggtgcaactctaggctagataaaactcatatgcacgataaatagccaaatcgaaaccttaattatttttccgagttaccgaaatagagttacttatttagaatttttgcactatcttgccgtcataaattaagcatctttggtgtgataaggtggcaacgaaaattacacacacaagtatatttttaataggattttgaaaaacaaataactattacctccgttttttaatagatgacgccgtagacaattttacatgtttgaccattcgtcttattcaaaaaatttacgtaattataatttattttgttatgacttgttttatcactcatagtactttaagtgtgatttatatcttatacatttgcataaaatttttgaataagacaaatggtcaaacatgtgagaaaaagtcaacggcgacatctattaaaaaacggaggtagtataagactaattgcttgttcccccaactctgcatctctacattcagatggcctcattcggtcttcccggccaaaaaaaaaaaaaaaaaaaactcctcatctcttgaggacgcattaaaccgatcgaggcatactcacgggtgtgtgagtgtgatgcaagtagatagtgatatgtctggtgtgcaaagaaagcatcctactacttcaaaggagcagtgcagtactggtcctatatactactccatgaaggaagagcagcaatcagagagatgtgtaggggaccttgcaaggttgggatgtgaaataaaggcattcctttgctctgaattgcatttgcatttgcatggccctgtggaaaacgtgctcacaggagctagcagcacaaatgcactacactaccaacagccttatgtctgcaactgctactactgctctacctatttaatttaccctgaactttattcgaccatgcaaatattacacatgcttcagttaagaaaaacaagacaaaatcacaaagttttttaaagaaggtacgattaaattataggctagttcacgtcaaaattaaaagtttggttgaaattggaacgatgtgatggaaaagttagaaatttatatgtgtaggaaagttttgatgtgatggaaaagttgaaagtttgaagaaatatttcagaactaaacacagcgatagttagagttgaaaaacagggataagaacataatcgcccccatatacaaatctgtccaactactacaaggttttggtagctagctagctaggcaactaagattatcagcaatatattcttctctctaaaatttggtagcaataggttagcatcaacaaaagggtatatatagtagcagaaaagggcattgtagcatactgttcctattttgcagacatattcagatgatgtggccactgaaaaccctgccagcatacttttttctttttatttttttgcagaatgaaacaagatggaaaaaaattgcaacacatgtctagagatcagggagtttgttggggagtgattttcctacctctgattcgtgtggttgggctaacaagtgacagacatgcattcatgattgcacattgttgtatgcccaatccggaatacagccacagaaaagatgatcaatggtttacggtagtgttaatcatcatcatgttatgtttaattatattttttaagatgagaaaattaaccttctcatactaaacaaacacaaattaagcacatgatcattgcttggtttagttgataggtgcagtacatatttatttatatagtgtttgcacaaacattcaagctagctgatgacgttggaagaaaggtcaaacttgtgtgtacacgtacgcatactgtacatacggagtacgtataaataccaccacgtcagcaactagctagcctaattgattaattggttgattagtaggcatgcattcacacacagatagctgctagcaaacggctccgattcttctcgcctggtgacggacgcatacaatacaaacgcacgagataatcagttttattttttatctatcgacttgcataaattaaatgcattataagtctctgactttggtcaaagttaaaacaacttataatttaaaaaaaacagaaggagtaagaaacataaattagtcatgttatttcatttagtccagtactatgtgataactcctaaatttgtcctctagttaatttagaatagtcgtcatagctaggaccacagaaaatgcatatatatacagaggactaaacgactcagccaatgatcgactagccataatatcaaatttcaacaaaaaaaaaactggtagtatgtcatgcgtgcatccataaaaaggaaaaaaacatgcgtcgaagatatttatttcatatgaactcatttcttataaccataaaacaatagcatctctacgtgaatctcgcgcagccacatagctctactcgaatgcgtgcacctaaggccatatttagtatagaaatgtttatattttggactgatgaactctaagattatgtatatttcttttttcttttatgtttatgtggttgttcagtggcggagttagcatcgtcgtcaagcccggacgattaatagcgtttcacgacgaccgatcaattatatatatattgattgcattcggtaataataacggtagtggcggagtccagacgatcacctgacataccagaagctgtttccgccactatggctgcccttacaaattattccatatattttaccatgaagacggttcattattttttcccacgtgcctattatttttaccaacatgcatatgcactagctagcctattatatatatagtactcgatccctttgtctcgtaatacatgacaattttgactttatacatagtttgtttcattagtttgaccactcatattttatagataaacttaattacaagtatcaaaagaacactaattactgaacatataaatccctttcatcacaatcaaactatttatatattagatactagtagcgatcaaatcaaactgaagcatgtgaccgtcaaaactgccgaattacgtgtgtcgccacgtgaaaaacaaccaaaaatatgctgggacaaaaacattttttatgtccacctcttctactaatcatgtaaaaaaatctggagctttgctataactatcttgcaagtagaagctaaggttggatatataccggccacgtaaacatcctacctttctaattgttttattttaccctcttcgatccacgtcaggtaacagtagtaggttggctgtactttactagtttatggattgtgttaatcccttcttgttgtcctaatatagcccactaattattaatatcgttatgtggatcgatcgatgagataataactaggttatattgatggatgtgatcgatagatatgtgtgtttgacaaaactaacacacacatgcatcaccatctttacatacttttggaagaggagtaaaaaaatcgagaaaattaactactagaaaggggaaaaaaaactagctagaacacggtgcacccgtgaggccgtgaagacgaccattttaaaccggagaaattgtgtatatttataagaaaaaaaggaggaaaatgcaggtgaaaattaaaataaaactatatatatggaggtagaaaaagaaatccagtgcatttttggagtggtagataacacacgtgtaatagttacttgttgaaatgtatgtaatgcaaatacctgaatttggtcgccgacgttgatgatgaaggcgtcaggcacggggtcaacggtgacccatgcaccggcgtggcgaacctggagtcccttgacacggtcgtcgacaaggaggaccgtcatcccgccggggtcggagtgcgaggacaaccctagtgttagatccggctgtgggcaccgcgggtagtagttcacccgcacgcacactccagcaccctctctaccaccaaacgcctcctgtagcctcccttcttctacccctagccccaccgccatcaccgccatcaacctctcgcataacctcctcacctcctcgctgtactctgtcgtcgtctccctatacatatatattagttagtatttttgcacatgtaattaggacatatccttttctcccttttaaacttgtattccctcgctcgtgcttttcgaattgctaaaggttgtgtttttggaagaaaaaaagttctatacttgagtttctttaaatagtcatatcgatatgtttcttaagttcttgtaagctaaaacttaattaatcacgcgctagtctattattctgttttgcatgttgagagggaaatgttctgaactcctcaaaagagcacggccttatactaacatttaagaaaaatgctaaaacaactacttcctccgtcccataatataagggattttggatggatgtgacacatcctagaacaacaaatttgaacataccgtatgtccagatttattatactaggactgtgtttagttcacacaaaaattggaagtttggttgaaattggaacgatgtgatggaaaagttggaagtttgtgtgtaggaaagttttgatgtaatggaaaagttggaagtttgaagaaaaactttggaactaaacacggtgtaggatgtgtcatattcatccgaaattcattatattatgggacagagggagtaaggaggaattttgtgttgaatagtaataattataggtggaaattagtggatgagtgatgtgtacctgaggtcaggggggaggtggggccacttgtgaggggagaggaggtggggtggtctgacgtggaggaagtagtagtcaccccagtcgaggatggcgcccttgtcgacgccgagccggctgccgtacccttcgtacgtcgccggcgagttgccgtaccgctgcttcacctccatcggctgctggaagaacccgcgccacacgccgcgggcacgccggagcagcgccgccggcaccccgtggttcaccgcctggaagaacccccactccctgcacgcctccgccaccgccgccgccgccgtccccggagacgacgacatgtccaccaccgggatgttgatgttggcgacggcgttcgcctccgacgacgacgacggccgctccgtctccggcctcacgtaccggtcggggatcgtcgccgccccgctctccgacagcgcctgcaccctcaccaccggctccggccaacccccatcacccgccgcctccgccatgatcgatcgatcactcagctagccactgctgatgctgctgtttcacttggaatttgtaggagatatctatgaatcgattaatcctagctaattaagcacgcagtgatgtgattagtggatcagctagcgctagctgaaactgaagctggaactgtgcagctggcaacgagataactaagctaggtagcacaagtgttgttctacacttgtacgactcactgcaagcctccagcttcagggtggtgtgtgtatatatactcattccatcctaaaatataaggctcaaccacttctaacatagagatcaaataaagaatataattatatccatacatgtaaacagtgtgattggaagacttaatggtacaggaaataaattaaactaaatttaaagaactaagaggtgataattaatatatacatgcacgcacgccttatatgtgagacataaaaaatacggttgtatcttatattttgagatgaagacgaaggaagtatatatttattgattgatttgggcggcagcactacaggaatcatgttaacattaaattgttgtgcttttcagtgtaattagtaattgattaatttctgtgcaggcagctagtacctccgtcttaaaatatactccctccgtttcacaatgtaagtcattctagtatttttcatatttatattgatgctaatgaatctagatctaaattcattagcatcaatatgaatgtagaaaatgctagaatgatttacattgtgaaacggagggagtaacagcctattatcgactgtgaagcatattttcaaacagaggaataccaaaataaatgtactggtactacgttatttagatttatagttctaaatatatcatcctaaatattatgttcgtttattttgggacgaagagagtagctaggtaggaagctggcaaaaggacgaaagctactaattgtaatagggaacgtgactgaaatagggaggatcaggttgtgcttggctctatggggtttatatgcgtgcgtgtctgattgctctgcggcgtggtgccactactaccactacagtgacccaaccccatatcaaaaagaaaaataaaaaaaaatcaccatcttatttgagagagatggagatggcccaccaccatctctgtcaataaatggagggtaaaatctggacattttaattgactgcttgtattgtatggtagctggaaaacaactatttactgacccaccatgttgctgtaaaatcttggcagatcattgtcactccgtacctttgaaaccgactcgatcgaatcatgattcatcattatcataagcagcacgcaaataaacaagtttgttttgttatttgttaattttataagatttgctagacttcaggcccctgaaaatttatagcagggaattaggaaagtgcgagtgatgaaaattagtgaagtaacttgcattgaattattgaatattgtacaaaatataattttactatgactcttagtttacattttagaatgtaattttacatttctccatatgggagcctttgttgttttattctaagattaaaaaaaagttagtgttgggtgaggctaacgattgagaaactattgatagctagaaacctagtcactaggtaccatgtaaaaggtaattttattatccttgagaaattaccatatttctagtataaattttggtacctacaggtattaattatctcaatataacaaagattttaatataaatttaggtagctcaaggtatttttttaagaattacaaaatttctccatgtaaaaagcttaattggcatgttgttgggaaattaagcttcaacttgtaacaaaggagccaaaagttcaattataatgtccatttatatacattgcatcttatcccttgattcctcttctttcttcattgtaaggctcgccgtctttcacgcacacgtcatcttctatcgatttatagatagcattgttactcgatttatcattaaaaaaagaaaaagactgacagataaattgtcacgtgcattggaaactatattgatgcgaggacggaggaccaagttcgaaaacagagatagtattgcactgttcagtatagtttgctagcaatgggggccagttcataattagttcctgtaaaatttaactatattgatgaaataattaatactcctgcacactgcagcattcaatggctgcatgcacaaataaggtactccctccgtcccacaatataagggatttt

SEQ ID NO: 15147 - DNA, 9609 bp, Oryza sativa
ccttatattatgggacagaggaagtaggaaatcacacgtggtcctgcttctttctttccctttaagttatgtaaagcacaggataatgtcagccagagaccaataaatattactcctgcaatgataatactagtaaaaaaggtaaatcatacatcatattaggaaaagaaatgaggctattaataatggctgaatccctgattagtgccagtctccactggttgttcaggtttgggggtgacaaggacctgacctgtcttgaccactgccactggctgtttggctcaaatcaagagatttttctatattagtgatcagcattagggcctttgccacttttccaggccggcccactttgacttttcaagcccatgccatgcctagaatcttcttgtaccacacataacatattggaattatctgtccttttaaaatattatttggtacattttttatgatggaaataaaatagtagtacatatatggaatatatatgattaagcattatcgtactatgtaacatatagagcatagagcatgtgaaactcaatctaaaaaaatgtggtggaaaactgatgagtaccccaatgatgagggccttttttcttttctttttttttggtaatcgtggttgctgttctgattttcgaagaatagtctttgtttttcgaggaaaagaaataaaaagcacattgagtcacactgcatgcaaggaaccaataattcaattgggtcaatttaaacaagatttgcccacttgtccatatgttgtgcacacacatcacatcacatcgagatggtgggaaatcgattcatgcaaacattaagtgaaaggtcattgagtttggtactctctgctttgttctctctgaagaagaagatatgcaaatgcaagcaagttgaatcatatcaaggattgcacttgtcttctactactgcaccactgtctgcacattctatttgtcccctctagctagatgggctttcactttcaggctaatctgcacctgcaaaatttccataacatcatagccgacaagaaacctcatgccatgcgtatcaatatagttgatgcaaagtttcatgctgaaaaagcacaagtttttatcgtcagcttctgtgctttttagcctgtccatcttgtttcctttcatgtgcagatttagtttacctcttgagacctagattaactttgacgcatcttaatctttacagttagcaacaactgaacagtggccaactctgtgagatgtaaaacaatactcttcttccaaagttcagagttaagatgcaatatgtaaatatgtcttgctgtctgaaagacaatattgctatgctagctagctgcatgctgttgttttcagggttgctttttttatttttctcgtggacgcatgcatgcacttggcattgtccgattccatttggcagtggaattatttgctgtcgatccgtcgatgcattatctgaaagatttagtaatactatcatggagcagattgatcaatcaatcgagtcaaagttttcacctctgaatctccgatgctatcatcaaattgttaaatgcctcttttcctactgatggtgagatgcatgtttcacagtttcagtcttgacctcacctcgattcatcgtcattgctgtcaaaaagatggatcgtcattcagatttcagagactgaattagcagtaattttgtactgctaatgccagaaaacaatcaatttggattagctaatgacagtggcgtgtctttgtgcatctttgggtacagagactgatcgaagtgtcgtgttccattattgaaaaaaatgttgggacagtgggacataaagttgatagcggagcatgctttggtatatatatagtactaaacagtactttcaggattaaggtcgtgtggctgtcgtcaactgatgaagttgctgtcaactgtgtatatatacttttaagatttgccatgattagtgttcatggtattgtccacgtgcatgaaagatcaagcgaccgacaaccagaccaatcgagctttttatccatgcactaagattgacagatgtatacaaaaatgtttggaatgaatggatttcaaatgaaaccatttgaaaccctgtgaattcgtactgaagaaaacaagttgggcgttcaaaagaaagggacacaagagaattattgttgcattggtttcgtatatcagattgaacttatagaactttagctgaagcagtttcagagttggcatgagatggttattcccaattattcagatttcagaattcagacagggggagtataaacatggactgaattcttctactcatccagtgggccggcattttgcaggagcatatatatggactgggccctgtaaactcatgcatgcgtgaggccttaggttgtgttcttttctatgggttgggaacccatctaccgcacgaaaaacggagcagttcattagcatatgattaattaagtattagttattttttttcaggatcaatatgatttttaacaacttttgtatagaaacttttttttttaaaaacgcaacctttagtagtttgaaaagcgtgcgcacggaacacgaggggttgggaacactgaacagaacacagccttagtctgtaatgggccggtgaattggcatttgggctgaagcccatatattgtaagcaacttgtgtttttcttttcttggggaaggtttttgtcttttgtttccattcgatcggccgaggattttcctgagaaattaggcttcggatttaattacatctagtgaacgaaatacttatattcagactaaaaaaagtgcacgtacgttgcaacagggaaaaactaattaatatttatggttaattaaatggccaatttgcttggtactgccgcgaagatcatgaagttgaaaaatatcagcgtatatatgtcattgatacgagggtccagaccccacatgatcgttctcatgtacaatagtatttcataactcacttattttctcagtatgtattttttgataagaattttctcaatatgtatgaaaccattgggatttaatttagacatgtttgcttcattgcagggagcgatcctgccatgtcctcataaacatgtactactacatatttgcatcagagagcttaattggatgtgcatgtgtaggatgctctcctacagtagtttccctaaaagaattggatgtacatttatatgcatatggagccatggagacgagcagattacataaatcgcctattattagctgaaaagaattgagcatatatcttccttttctcaatggaaggcccatcccaaaaaagcccaataaatatctcaacccagtcttggaaaaaagcccgattcagttctctgcttaagcccatcccaaaaactcctattaggataagtggattatacgtagggattttctacgtatgtgcacatatgtcgcgaaattcctaatcagcgattaatcgcgagcgccctccggcgacacgagacacgtgtcgcgcgcggagaggggcggcggactgcgcgtacgtacggtttcccctcccttttttttcctgttttcttctaccgcgcgtgtacagtttccttttttttttttcctttttttctgttttcttccgtattttccttttttttcttttcgtatctttttcattttttcggtttttataatacatacgtatacaaacagagtcggagaactttagggacataaagtgaacttattccgtcaggagattacacgcagcccaatagtgtgggcggcctgggaacggcgcccggcccgacgcgagagaagctggagccatccgatttgatggacggtcctgatttatccagaactatataaaagttcaaccgtccaaaatctaaccctaaaatcattaacgttccccctctgccgctactcctcccccttcccgacggcgccgctccatctccccatcttcctcccgaccgtccttcccttcctcccctctctcacctccatcgcacgacggatccgacgacgttgaccgcggatggatccgaccgcggtggtggcggtcgaggacggatccggcggcggcggttcccgccgacccctctcggctccctcccgcggtggatctaacggcggcggcggcatcggcggcgaccgcatgtgcatctgacagtggtccggtgcaacagcaaatccggcggctgctgctccccatccccggcgtggcgacgcgaccaggagcggcggtgggcttgggagccggtcgtggcggaaagcggcgatgccgacgacgacaatgacaacgacgatgacaacagcgacgacgaggcggctagggttagggtttggattttatttttgatttgggatgttgattttgtggggattgttgattttgatttgggattgcaattgagtgattttgtgattcatgtattttgggaattggggacaaaggtgttgggagcaatcgaccgatttgctcagggattttttttaaagacggatgactcagactcaaacaacaatgacggacgaagcacgtatttttttaagtaggtatatagattttacaagatatttttttgccaggtccgattttttattaagaagaaagggtgcctaaattacaattgtacaacaaacaaggttgttgcggcttcgacactaaacgctttctaatgatagccaggctacagcttcttaattttgcctcgtcaattttctccatccactcatctttgacaagattgacgacagtttccttgacctagaagcaaaacgaacttgtaaaacgaacttgtaagaccaatttgactgggatctttaatcttaaaagctggatgggcatgttcttgcaatcccgtgtccgatgtgatctctgacgataaaaggaagggtgtgtttagttcacctccaactaccctaaattttcaactttccatcacatcacatccaaaactttcctacacacataggctgtgtttagttcacaatgaagtttggaagtttggttaaaattggaactgtcgaggggtgatccactctagcgggagatcgtgagacccccctttcgtgagttcggccgggggaagaagctcgcctatagaaatcacgtatccgtccccaaggctcctagctagctcgtacacaaccaaattatacaggtttgggccgctatcaagcgtaataccctactcctgtgtatgggatttagactgagagttacaagggttcctgatctcgggagaacacttttacttccctcctccacaagctcaggttttctgagagtcgtccactttctcggtgtgcaaggtcctccttttatacctcaaggggataccgcatgcaccgcctctacctactcttctataaggtggggacccaccttatctggactggaactcgacccgtgccttcgcctggaagctaaaccacagcttatccttgagcggggcccagcgccgtccctcgcctgaaacgggggacagccctgtcattccctcattaataggtgaagacttgtggtggccgccgtccgaatgaccccccgatgggacgggtcatacctacctccactccgccggaagcagatgcgacgtgggagcacggttgtccgtccagtcagacgtgaccggcgtcaggccggtcatagacaggtcattcttgaccatcgcgcgtcagtttaacacgccgcacgtctaccccactacattaaatgcaacagggggcagttggggcgctgcgcgcattaaaggaagtttctccacgctactccgcacaccaagcccctcgtcgtttctccgctggtcatcatggctcaagatgccggcgacgcagtgcttccggcatcgcgcattacggcggataggcaccttagtctcccccacaagatcaagccggaagatgccgccgtgagaacgggggagtcgcggccgcggccgcggtacccggagcgatccatgcacctcctgtcctttgctatggcggggttgatcccgccattctccggattcttccatgaggttttggatttctacgaaatccatgtcttgcatctcgcacccaacgccgtgatgacgctagccatcttcgtgcatttgtgcgagatgttcatcggggtgcggccgacgatgcggctattccagtctttcttcgtcccacagctgctgcatggtgcgttggtggggggatgttacttccagccccggccaggcacggcggggcaatacatcgagagttatctccgcaagaaatgggaggactggaagaaggactggttctacaccgcgctgccggaccacccgtgacttcggctccctaccggccctcccgaacgatccgccgcatggctggcggtttcggagctaggcgaggagtatgacgcagtgcgggatcgcctcaggggcctgcgaagcctgggcctcacaggggcaatggtctttggcgactacttccgccgccgcatcgcgcccctccaagatcaagcccgtggcgcgtgggagtacactggacccaatgaccccatgcgcacgcatgtgggcgagcgctgggattggggcgaggaggacatgaagacggtgattcgtcgggtgctgggtctggacactgccgagcaaacactgattccagacgggatccttcccctctgcagcgatcgcgaccgggagagtattctggctgtgatgtcggccgtcggcgccagcaggggtcagtcccgccggggcggcgccgatggtggcgttgtcggcgtgggtagcggcggcgcggccgcaggcgggagtcggaccagtggccccggcgggggtggcagctccagggctcccggcccgagccgcggacccggggtcgactcggccagcgacccgaaagggaagcggaagatgtccgaatcgcgaccgccccctcccccgcgcggagggggcgccgagcgcgtggcggaccgaccgccggcgggccacaagcgccccgccgcgcctgaggctggacggaagaagaagcgactctggaagataggtcaaacggagccgtgtcgggggagcttcatcgagcccccgaagtggactttcaaccgccctccccgcaggtacgactgctggcacccgcttcgatgctttttgctcatctcggtctcttgttccttcctcttctttttctttgttaacgcgatcagggttattctgtagcatgattccttcccaggggatctcggggtccgacccttcgcaggggacaaagtccgaacgaccagagcggcctgggctcggccgatccagggccgcgggaccttcacagcatcccggcggggcccacgggccgcacaccgggtctgccctgggttcaccacagccgggacttgacccgccgcgagcgatagcggcggcaacgtctctcccgggggcgactccgaggcccaggtccatgcggagcgccacccgggagcgggggccgagggaggtcgcggcccggaagccgaggctggaggcggccctgagcccgaggccgaggccgaaactgggggcgggcccgagcccgagcccgaggccgaatctacccgagggcccgaagcggggggtgagagggacagccgctcccccttgcacttggggcgccctcggggctggccacgcagaaggggggctgagagcagcccccagtctggcgggggatccagcagcactccgtcgtcccgggggcgaaccgtaactttttcttctccgactctagccagtatggagccgctcctgcaggtgctcgtcgccgccgattccaccgtccgggaggggctcaactcccaagttcaagccctggcggaagagcaagcggccctggaggcagagtgggcacagctcgctgcggaccgcgcgcgggttgatgaggggcgccgcgccatggacgacatggtaaaggtgggacgcaaaatgcgccaagcccaactggatgaaatccaggcgcgcgagcagacgcgggactccgtcatgcaggagacggaggaagagcggcaggcggcactgattgcctcaagtgtcctggatgaagcgctgggcgacatccgctttgtcacgcacggaaattcactagtaatttccgaaactaatttgtgcataaaatcctcgtccaggaatcagccgaggtacacaaactgacaatttaatatacaaatccatcttaataatgacgttacatacttacaaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacagctccacatcatgtcaccatgtgcctcagtaccaccacggtacctcggaaaggagctgtgacaataccccttgcataacacaactcaccacagtgcatcgttcctggatcataatcaccctcttataaacaaggcatggactccccagcgacccccgtggacttctcgccacttcacagtctggcgcactataatgaatcatgctatacaaacgataaagccgttgcccacgctggcttgtggttggcacggtaaatgtctcacaacagtagctcgcgaaccggtccttaattgccatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacaatacatataaagtaaacaaacatgtagatcatgattttagatgaattt

SEQ ID NO: 15148 - DNA, 6495 bp, Oryza sativa
caggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggagaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgtaagaaatcgatccgggaaatcaaaaactcggttttggagataaactcaaaaacgagtttgattcggataaaatactcaacggtttgctccgattcttgggggtaaagatagaggaggataagaggaatatttcccctcaactaaattggaaaaaggagcaacggggaggcgagatttggaaggaggaggcggcggctgcacagggcacagcacgggcggctcgggctctgcctgagctggaagatgaacagtagcgcagggagggaaaatagacttttccggctaggctgagaggagaggaggcggctcaggttgggccggcagaagagagaggaaggaaaggaaggaatgggctgaaaatggcccaagctgaggaggaggattttattactttcccaattaaaataatcacttaaatgatctttgaattattaaaaatacttccaatgctcaaataatttcaagaaaaatcctgaaaatatttggacactcaaagtacttaaaaaaattacaattagaccatttaatgattaatttaatatgtgggtaattactgaaatgctctttgtataattaaaaattaggaattgagctccgaaaaatctgagaaaattccagagagtataattaaccatgaagaatttaataaaaattaaatccatccatgctttatatttaggaaattttatttcccacatttaacttcacttgtaaattaatgaacatttaatataaattctaataatagtttattaaataatttataaatcctgaaacaaaaatcagggtgtgacacgcttacagtacgaggcctatgccgaggacctggcgaagagggttaaggacgcccgcggtgtcctcgatgcggctgccgcccaagagcggcgggtatcggaagccaacacctcgctgcaggctcggacggtggcgttcgagtctgagcgcaaggccttagataagcgtgcccgctccgcgcaggagtttgaggccacgattcgtcggcgaatcgaggtcctcgatcggaaccagcgcgagcaggacgcgcgcagccaggagcaagcgcagcgagcccaggagctggagtggcgggctcaggcgttgaaggagcgagcgcgcctgctagaccagcgggagttcaccttggccggccgcgtggaggagctacggctccgggaagcggcatgccgggaacgggacgccgcactcgccaagcgcgaagccgaggtgaaccgccgtgtggtggcctcgcgccggctgggcgagcagctcgcgaaacgtgaggaggccgtcgctgggcgcgaggcttggcatctggagagtgctcgcgccgagcgtgcggtgatggcggcgagggcttctgagctggaggcccgggagaaggacctggcggcgggcgggcagcccggcggcgcggagttggtgagccagcttaccacggctcagagcactcttgccgacctagagcgcttggtgcaagaccaggctggggagatcgcggccctccgccttaccaatgagatcggacccgggcagctctccgatgccgtcgatcggctggagcgcgcggggcgcccagtcggcatctccgtgcgccgggatagtaagctcccgcccacacaaccggcggatctggagaggctggaggaggaggtcggcgagaccgtaaaatcgtcatcggcttccttggcgcgagccgcggtggaactggtccttgcgagccaccaagcccgcgaccccgacttcgtcccatggcgcgcactcgaggatttccccccggggaccgaggcaaaggctcgggagcaagtccgggaggcggccgacgcgatcgtctctaacttcgaagggtcggcccctcggttcacctttgggattgcctcggacgaggagagcgggagcggggacgacggtgacgacgtcggcggcaaggactgggacgacgtcgttagcggcgccggcctcgggggcccgggcactccgtgattatccccacttttaatttctttttgttgggtgcctgcagcggacacttcttgtctttaggccatcgtgccgtcttgtctgtaaataaagcttccccttcgcactttctacccctttgctttctcctttgaacgcctgcggcacggaaagaagaaagaacaagagcaaaagtatataattaacctccctgtgatcgaaatgccatttttaccccatccccccctcgggctcattcttgcgaaaaggtaaatccgcgctcagtccgtggtacctaagtggtgaggagcaagaccgtcgatccgagggagccgcccagcgggactggccagactgaggctacgacgaccgagggtcggggatggccgtgtgtaggcccttccgagcccccggggttcggcgcaacccggggcgcggcccgcgtttaggctccctttcggcggtttttaggtcgcccaacgccacttagggttcggagtgtgaattgtcctttgaaccaggacaagccagaggaaagagtgagaaaaagggggcgtaacggcctccactttattgcttggaaagggaaaaagatacaaagcaattcacagtagtagcccccggccaagcccgcacaagccgaggggttgtgcgggggttggcccgagctcctagaaagcaaaatatcgcgacgctatggatagaagcgacggagatgttcgatattccaggggttaggcaactccgtgccgtcctccgtggttagtcaaacagagccttgccggggaacaccgatcactttgtatggcccttcctacattggcgagagcttgcttagccccagacgcgactacacgtggtgtaggatgaggtcgccaacttgcagtgaccgggcccggacgtggcgctgatggtagcgccgcaggctttgttggtagcgcgccgcacgtagggccgcgcgccttctccgctcttcaagatagtcgaggtcgtcgcggcgaagatcatcctggttggcctcatcgtacagcgcaacgcgaggtgatcccagggaaagctccgaaggcaggaccgcctcggcgccatacactaggaaaaagggcgtttcccccgtggcgcgacttggagtggtccgatttgcccacaacacggcgggcaactcctcgagccacgaatccccgtgtttcttcaggacgttgtacgtcttagtcttgaggcctttgaggatttcggcgttggctcgcttgacttggccgttgctcttggggtgggcgggcgaggcaaagcacaatttgatgcccatgttgtcgcaatagtcgccgaacagctcactagtgaactgggtgccgttatctgtaatgatacggttgggcactctgaatcgagacgtgatgcccctgatgaacttgagggcggaatgcttgtcgatcttgacgaccgggtaagcttcgggccacttggtgaacttgtcgatggcaacgtacaggtgctgatacccgcctcgagccgctttgaatggtccaaggatgtctagcccccagaccgcgaaaggccaagagagtgggatgacctgcaaggcttgggctggctggtgggcttgcttggcgtggaactggcacgccttgcaccgccggacccattcttgggcatcttgcaacgcagtcggccagtaaaaaccttgtcggaaggctttaccgaccaaagtgcgtgaggccgaatgggccccatactcaccctgatgggtgtcggctatgagcttgatgccttgctcccgagaaacacacttcaagagtatcccgttggcggcacaccggtagagggtcccttctacgagcacgtaccgcttggagatgcgcgcgagcttctcagcttctgcgcgatcctcaggaagagtatttttgtcgagatacgcccggatgtcagtcatccaaacgacctgacgaggggggtcggggccgaccctctcgggccccgaggcccgcaggtcgccaagggtcggggtggagggcgtggtgtcggggtccctcggggggttcggtcgcgccgacggctgcgcgagtttttcctcgaaggtccccagggggagtggggcttgtgccgacacgacacgcgacaactcatcagcgactgtgttgtcgcgtcggggcacgtgacggagcttgagtccgtcaaagtggcgttctatgcgccgcacttcgcggacatatgcgtccatttgtgggtcggtgcactggtactctttggatacttgattcacgaccagctgggagtcgcctaggaccaggagacggcggatgcccattccggccgccgccctcaaccccgcgaggagtccttcgtattccgccatgttgttcgtggcttggaagtcgagccgaatgacgtatttgaggacgtcccctcttgacgaagtcagcgtgactccggcacctgcaccttgaaggttgagggagccgtcgaaatgcataacctagtgcccaccacgaatgtcggcgttcgggtcctctccatctccggggagggagggaacgttggacggaacagggtcgtccactagggtccactccacgatgaagtcagccagaacctggcttttgatcgcgtgccgtggttcgaagtgcaggtcgaactcagcaagctcgagggcccactttacgacccgaccggtgccctctcggttgtgcaagatttggccgagagggtaggatgtcactacggaaacccgatgcgcttggaagtagtggcggaattttcttgaggccattaagattgcataaagcatcttttgggcctgtgggtatcgggtcttcgcgtctcggagtgcctcgctgacaaagtagacgggtcgctgcaccttttggtggggccggtccgtgctgtcaggggcagatgatctggggcgcccttgcccgagggcccttggggggtctcgagtcatgtcaggaccataggccttgggattactcgccaaagcctcccctcctcccacggggtcctcgggggtcctcccgggggttgggggcttcgggcaccaggccttcaggggacgaagggccatcgcgagtcaagggggcctccggtccgctctcttcgcgcttgactactagggcggcactcatcgcatggggggtcgcggccaagtagagcagcaacggttcctctggccccagggctaccaagatggggggaggtgaggtaagcttttagctgattgagagcttgctcagcttccttcgtccacataaatggtctggagtgcttgaggagcttgaatagggacagcaccctctctcccagcctcgatataaatcgacttagggcggccatacatccagtgacgtactgcacatccctaagcttgctgggggggcacatcctctctattgcacgtattttctcgggattagcttctatgcctcgggaggagactagaaaaccgaggagtttgcccgccggcacaccaaacacacacttgtcggggttcagtttcacgcgtgtggacctaagactgtcgaaagctcggccaaatcctgcaacaacgtgtcctggtggcgcgtctttaccaccaggtcatcgacatactcctctatattgcgccttatctgattactcaaagtaatacgagtcatacgctgaaaagtagggcctgcattctttaacccaaaaggcatagttgtataacaaaagctgcccacgggagtaatgacggcagttttttcctcatcttccctagccaggcggatctggtgatacccagatgtcacgaccggaaataacccaacgggcattccttacgtgcgtgcattaatccttgtcccaggaggcaaggtacaccaaaagttgatacaattcagagtttaacaagcggaagcgtaattagataacttattacatgggcagcgaaagcccagcacacacaaagacaaacgagaaacagcggaagactagggcgacgaccacaggcacttgacggcaggcacgagctagacaccgaagccttcatcctcctggaactcctcttctggggttgggaaaaattgagcaagactg

SEQ ID NO: 15149 - DNA, 1270 bp, Oryza sativa
agcagaacaccggccttgtgccataacatctcgactacgggcccgcaagcttggtgtatccttcatttgccctgaaaaaatgtcaatcgaccccggacttcatccatctccaatccgtgtacttttgtttatgactagactgagccacaaactaagccttacccactaaacatgtgaaagtacggtagtgctttgcaacagaggcctgaagaccggtctttatatggcagaggtgctactatcaaaaccatgcaccccgagcccagcctaaaaccacttttggggattttgaatagagggggcggtgtgaatccaattccacaatactccaacaattccacagtgtccaggtgatatgaatattcccaaggtctagagttgtaaacccacctaatgttacctaattaaatagcgaagcatctacctaaaatcatactagtggtaccatgagtagagtgtccactagttggggttttgttggttctagggtgaacaaggtaataatacaataccaataataaggtcgtaacaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacaccggcttcaacttccacgaaaagcggatcttccgaagctgcagcgtctacacgaccaacgaaaaacaaaaggcttttcctctcctaaactccatataacaagcagaaccaaagcacaaaaatgggttcttgacttcataaggaaaaattagagacttgaacggtccaattccgagttcaaatggccaagttatgaccatttgaagtttatatgctctttaaatgaatatttgcgaatttcttcatttaaattttaatttaaaatcggatttattgcgtcagccgaggggaggggcgcgcggaccgggtccacgggagtggggcccacgcggcagcctcacggtccacggtggaccgggcgcacgcggcttgcgctggccggcgccgtgggtcccacgcgtcagccgcaccgagggcgctggcggctgacggccgggccccacctggcagccgcggggcgcgcccgaaggcggtctctccggtacggtcgacgggaggcggcgcgcccgcgcccctatggtcgccggcggcggccataagcaccgcggagcggcggcccaaagaggggagggaagggggaaacgaaatggc

SEQ ID NO: 15150 - DNA, 14379 bp, Oryza sativa
acatgtttactttaactccatgtacaagcataaacctaacaacatgtatattagttagttgatgtaaattagcacatgtgttttcactctatggttcatattagttgacaaagattggtagtaacttgatcaattttcagcttcaccaactgcagtaaaccctgtctgtctccatcagaagtacatataaaataatctgtttcctgattctatgagatttgtcggagcgtccatggattagaacggatcacattcaacgaacagcctcttgttgataagaaactgacggttcttggcagggagtaactaattaattaaagaaaacaagaaattttcttcaaagttgcagcatggaaggaaactttatggagaggttggacaatctgatttctctcctgcaggaaattaaacagagcaataatttgtcggaaagtttcaaccaaaatgaggtcaatgatgtgtacattccataagaaaggtctttgccatgtcaacatcgatgacaaatgcatgaacaagtatatatcatgatcagtcccgtgaaggggagagcttcacttttctatctattgcagaaaagatgctgctcaatttgttaatccgtataaggcgataagagcttgacaattagatgggacatcatggtgtgctgatgagtcacagttaataatccaaaacatatctggaacaggatttgtcgccgttcgttcgacgaactgataaaattagttcagaaaattcaggttgctttcggaggaaggtttgaatgtctcgcatacaaacgaagaccatgtaataatcaactcatcagccaaccataatccctccttgtgacgcaagttgtttctgattaactcaataatcatatagtgtcagattggcatgttactcaggatgttaattttgtcttgaagattacagtttgactgcttccgaaacaacccccttaaggaaccacaaaaaataaatcagtagatgtgatactatttcagccccttggaatttcacataaaacaattcaatttccgcacgaattgtaaacttttttgttgtaatttggtaaattacaattctgctgtcatatcatttacatgcaattttgcaggctgcgaaagtagattagggctgtgtttagatctaaattttggatctaaacttccaacttcttccatcacatcaacctgtcatacacacacaatttttcagtcacatcgtatcaattttaaccaaacttacaactttgaaagaaactaaatacagcctagaagaagtgggtaggaaacaagaagagacagcaggtaagagcaagtacacaagaataatagcatagaacaagtaaggttttctatattacaaaataagttaaataaccatatctacaaaaacatgtttcctaatgcacaataaataaatagataagaacaccaacagcaatgagatgctggaaagtgcatagttaatggctcaatatctggacacgcatagaattctccaaaatctactccagctgcaagaacaatacttaagcatgattaggaattgaatacaacaccagctacaattattcggagtatccaaacacagcagctgaacccacataaatatatataatccaaagacagcatggacaacagtactcttttcatcagattatacaatcagccaaaaaacaaatctgaaaaacagagaagaaaaaagatatgtacccattctttgtgatcatttaaggaggaaccagcccaatgttctagaacaaaagcttttcgtcaaagcaaaatcaacattggcaacactcagaaaacattaaattattggagattatcatgctctagtatcttggttgcccttatgcccagactttggggcccaatttctgtgttttgtgccaaacccaccacaatgatgataattagttaatcacttggcttgctttaagatgcatggctccttcctttttgttataataataatgctaacactgatcacaattggtgcaccatgcctccatctccactaaactaacctgtgattgctctgcagtttatctcctatggcccaccaaccacttgagagaataatcaattgcaaatatgcaaatggtttataatccactctttagaaggaaaaaaaaataaagaaggcatcaagcaaaggaagatatgatatgctcatggaggaaccaaagaatatatactggtgaatatatctatccattgatgtactgctgataataagcatatgttcctgatgaacaacatgaatcttgcatggttaataacataagacagacagcacatggatcaaaatcttactgatgcccaaagatatatatgaatatatatcgagtaaaataaaaactcttgttggaattcttgtatacaactattttataaaacccaaagagaggggcaaaaattaatagagtaaatatcagctgttcttcatcaatctagagctccctttgggtatacatgcttctttgttgatgaacaatattatttgcgaacagcttaaatatgtactaaaaaaccatctcatttgaatcaaattaagcaaacgaaggggaaaaattaattgaaagaaagaacttctttttttttggttagctaggttgctatgagcctctgatgatcatgccaccatctgctcctgctccggccactgcgcgaatatgtcgccggcggcgtggccgtccttgacaagagagttcacccatgacacgtccggctccgccgccgcggcgtgcgtcgccaccggcatggcggattggccgcggaacgcgaacgacgccgacttgcggagcttgtgcagctcgtcgccctggacgccccagtccagcttgccgtccggcgagccccagtccgagagaatggacggcgcgccggtcgtcgccggcgacatgagcgaacgcgccgccggggcgcggcctccgcggtcgatgaagctctggctgcgcttggcgaacgccgaggcgcgggagctcatgatcgccttcgccatggagtggtccagcccgaacgcggtgttcgcgccgcccaccatcggcgaggtcggcatgtgcatctgcgtggtgtccgccatggagctgtacgcgggcatgtcgccggcctgcttgagggacagcgcgtggagctgggacagcatggccgggtcgacggagccgagcaggtcggtgtagtccggcacggccctcgccggcgacgcggtggcgaggccgttcgccgcggcgccccagctcgccctcggcgacggcgcgccggacaccttgtcgaacagcttctgctggtactggtccagcgcgagcatctcgaggtcgaagtcgagctcccgcgcgccgagcgccgtcttgaggcggctcgctggggacgacggccaggcggggctcatcatcgccgccgccgccgccgccatgtcgagcccgttgggcggcgaggagcgcggcgacgatacggtgggctgcatgccgacggacacggcggaggggttgacggcgcggagctcgtcgggcttgtgggcgaagaagcagatgcggcgcgcgcagccgacctcgtccttgcagaggcgcgtcctgtactgcgccgggtggagccagcactcgaacacgccatgggcgtactcgcacgcgtcgcccttgcggcacgagccgcccttgcggaactccgggcaaggcacgcagctgtaggagtagcggcgagggtcgcggcggcgcgcgttctcgccggggtggacgaaggggcactcggtccagtcatgggagtaggcgcgggagcacggcttcaccttgaagctgtacatgcggaactcgtcggtgctgaacagtccgctcttgaggtcgggcagcgtcaggtcaggcgggtactccttcttcgcctcctgcggcggcggcggcgacggcggcgaggccgacttcttcggcgacgacgacggcgacacggccggcgacttgagcagcagccggatggccttctccgccgcggtggcgcgcgggaggaggtcaccggcgcggagccccgaagccgagagcgcgtcgaccgacgcccccgcggcgagcaacaggcgcgtggccgcgaccgcgttcgccgcgccaccggcagccgccatgtgcagcggcgtggccccatccgtctccgacgcgcgcgcggcctccgccggcgctgccgccacgacatacccaagcacccccgtgctcccgtacagcgccgccaccatcgccgccgtcctccgctccatcccgagcctcgccacgccgctcgccgaaggcccataccacaacccagccacgccaagagacaccttctcctcctccacgaccctcctcaccgccgccacgtcgtccgctgccgccagctcaagaagcaaggacgccgccatcaccgtcgcctccttctgctgctgcggcagcggcggtgtggacggcttgcgcggcccagagcacatgacacacacaaacaaacacgcacgcagagtgttcgaccgagttcttgttagtcaaaacaaacacctagttcttgatttcttgttaaattcagagaggagaagaagaacaagaagagggagaagaggaattctcgatcgatggatggatttggagagtggtgtggttgaaaaaggcagggtagtagctgggtgcgtaacggtatatgtagataggtatagtaacggaggaatgggggttgatagagataagggaagttggagacgaagaagcagctggtctccttctccttcgcgcgttttttttttcccttctctttacacaaaaataaaataatcgttttattgttcgggttttttatttttttggctgctggatgtgtcgcgtggtcaaaaggaagggaagacgcgctgcacaaacgcaaacaaatcagagagcctctttcttcctctcttggtcgctgcatcctcctttcttttcctttccttttcgaccttcctttctacatcgtttttttgtttttcttgtaaaggaaaaaaaaaagatgagagagattttggtttgtgtttttttttggcggggggggggggggggggttggagcgggtaccatgaatgttgccacaggtgtaggcacacatgtgtttctccagtagaaaacatttcgcgagcgtgagggggaaaacttatgaggtatctacaacggtgtttattagcggactctctctgttatcatataagtaaatttggtgacgtggaagatagaggggaggaagagaaaacattgttgctacttatgatatcggcttagagccgactcttagtgtttattaaaagaaattcctctgctcgcagagggagaaaatgaaagaaagctaataaaaaactatttttgtgtattaatggttaagatgtcttttttgtcttgactatcgtaggagtctctgaataatgtgtatcaacaaagagctcatattagactttaccttaatacatgccccatgtaaagtgcatatatgagatttaacaacttgtttctatatactctctatgtcctatgatgatcaatttttggctgtaaatttttaggaattggttaagtttggaacggatggtgtaaagcgagtcaagaacccaccataatgaagctgaatcgagagtgtaaactttgctatgctcattatggaatataactttaatggataatggactataagtccactcaagctaagactaacattggactaaccctcagccacctttataagcattcaggtgataaggagtcgtggcgttgcaactcctaactcgttaatagataacgaaggttcaccatcacagtcctcggtctgtggtgttgaagcagggtagaaggttcaaacattattgcaattataccttttgtttctctagttaacttatgttgttatatataaagatgtacaacttgcatttaatcacacgataataactataatcccaatcacattgatctacaggaagaaaaatcagataaatgttacagtttatataaagagctagtgttgtagcggactaaaactctctaagaatataaagtttagaataaatagctagctttaaagtcattgcccctttataagaaaaaggtcatcacttacatggttggataagaaacaacattgttcaattcattgtacatcgaataaggggaccaaaaacatgttacccactagcatagtggaaagtctttggtatccatcatcataaggtgttagtgtaagctcttaagaactatccctatttcagtcctatgaaatgatcaacatttcaaaactaacacatggacattctttagcctacaaagctccaaatcctagagtaagggtggtgcgattcacacctcaagctcatatgtggtacaattctctgaaaaaattgtgagagtaaaaaaaacaatataatctttgtaaggtgatttaccctaatctatacaacatttaatccttgtaccatgtatcttttattctctaaactcgaataatttacttattagatagtataattagaaaccaatcgagaaagcaataatgcatggaaagactttggtatccataccataaagtgttaatctaagcgctatgaactatttatattttagccctatgacatgataaactttccaaaactaatacgcggacattcactagcctacaaactcttacccctagtgccaatggtggtgtgctttaaacttatacgtggtgcgattctctaaaaattttgagagagaaaaacaacatcatctttgtaaggtagtaattttctcaattctatacattatttaattgtagtacaccatatcgtgtttattcattgaaatcgaataatttacttactacataatacaatttcaaactaatcaagaaagtaatacggagctacttcgacataaaagtaccactctcactctcatcccttgagggttttgtctcctagtaggagtgagtaataaccaagtggtttcttgtgtgcacaagcgtgtgtgcccacaccacacggttgcatttgcatcccatccaaaccaaaaacgcgctgtgccgactggcagatatgccccacggcttgaccactgccaggtgggcccctacccggggtaacattattattctgccgggtggtgggccccactccgagccgaaaggcaaaacgagtttcacgcgtgcccgtgtggctgactccactcgactccgacgcgtgggtgacgccgttaacccgcgccgttaggcttggaccggttcgtcctcctcccaccatgggggccccacgtcggatgccgacgcggcaatcgcgtgcggacacgtcaccctaccccccatgccggcaaatatcggggacacgtggcgcgcgctcgcgtcgccccttgacttttcgcgcgccagggtggtaaatactcctaagtcaatgacatgtggggccagaatgatgtggggacaggatgtcagtgagaggggctcgggtgtgcggtggtagcggggggtttgtgcgtcggggggtgtgggtggtggggcccacgcggtgggtttccgagtcagtgttccactctggttgagttgacggcgtgagctgctttacggttagccgcacgggatttgccagcgagacgaccaggtccacgccttcaccttcacttcactgccagtttttttttaaaatttttttaaaatatttctctgactttccgctgctgctgctgttcatcttatctgaatctgaattttctgaagatttctgaagatgagggcagtgcagggcagcaaatctgaccggaattgctccatggtttcctcgacaccttaaacaactgcactgcactgcacacatatgcagacttgattattctgctcatatggatctgtaaaattattgacctcgtttgtgctctgacggctaccgcagctccagccagcacaaacgatcaaatccattgccttaggcctaatttagtttaaattattttaagaagtaaacttaacaaattatggtcttaacaatgcaacataagaaatcatttctttaagaaaacatattttttaaagggtaaagcagataatatgttttcaataattcagtgaataaactgaaaagaacatggtcttgagttaatcgttttattcttagaccatgttcttttctaattaagatataaattctatcttgatatctgttagcacattttcaaactattaaacggtatgttctgtataatacttagttgctctaaaatatcaaataatctattattcaattatgttatattaaaactcaattaatcatacgctaatgactttcttattttgcgtgcctttacttaaccctaatctttaagattcgaacggagccttaacctcctgtgtttctgtgagcgacaagaacaattttcagctagctgagtgacactctcaagctgccaaaagctctccatgtgttgtcaaatttccagcattatgctgcatgaaaaattaagcgccccaccacccacaaagacaaagcatgaaggaccgatggtaattagcaggtcggtcactcatatccttatctgcagatgcagctaagctgggcaccatgaggaattcagctgacctacaagatgatcggattattaagcatatgctaattatgcatgtgggggaatctaatcgatctgacgcctgcaatgggttagatagatcagatcatgcttgttattgttggtgtcgatctaaatcgcacgtgttccttaacttcgcacgggcagtttttcattataattaattaatcaattcaactttgcatcgatgttgtagataatggagcaagctaaggcatatgcagcatccatcagatcattcagacattcaggtagaatattatgttcggttagcactatagtggcatgacttttcttattcggattccttccctgaacaattatgtttattttcgaatagattattcagcggattgttattgtcgattatctactcaattatattatatggataaattagatactttaataaataaacataactaatactccctccgtactcgtaaaggaagtcgtttagaacaacgacgcggtctccaaaacacaaatttgacttcttgttacttatgtatacttttattaaagtatttttcaagacaaatctattcatataatttttatattttcaaactcaacaacttgagagttattcattatttatattcccaaggtttgacttaaacattgtcctaaacgacttactttacgagtacggaggaagtaactcataacaaatagtctaagtaatataagtaaagtattttttttagaaaatgtatttttttgaagtacagaaaaattaatctgaaaataactactgttgtacaataaagctaattactgctactaattaagctatacatgtatgagaaattgtgtgccctggattcaatgcagccatcagacccatggtcggatggagatggccttcaagcacacgcatataaatatgcgcatcacgcgtgcaagtagctatcagttgattaattaacggcagtttaaaaataagataattgatggcaattagaaggccaagtcagcatttcataaatggtctcgcagcaagactagaccagctcagctcagctgcctttctgcctcggctaagtgaaatctgactgcagctaatctggccctcaagattttcaacgaacaccggccttctcagctgtcatctgttaaccaccaactaaactccagtaatttacacatctactgtattatagaactaactgtccctttcataacggttgtgtgcaaattttggaaccgactgattgatagctagcttgctagctgtaattaactcgcagaaatggggacaggttaatttaattagttacagttgcaaacttgggagttgggatggattcatgcacaattggattgatatctgacagcttaatttgtaagattatagctgtaatttgaaacagtagctcactgaagctggctagctacctgcaggcagcttctgctttacaattctagtccaagttacacgtgcttgcatggtcaattggtcagcagctaagcctctacgttgactggttgaccagtcaacggacaagatgatatggcgccaagtgatgatgagtaaagtacactgttacgtgctacgtacctgagtgggccccacacgtgtacgtatatacggtacgtatacactgaactgaagagtagaaaagttcagagtagcagatgtaaattcagacacaacacaggtagtagtaccatgctccatcataatgaaaggtctggacaaacaaaaattgatgatagatgcaggttggcactcactgattagcttctctaatcaatctgtctgttttaattcatggtcggctcagggtttcagttctttaactattctgaactatgcacctcaattaacacaagcccttgatagatgcaacaatgataataatactattacaatttttcaggctcgagttgatgatgatggtgatgattggttgcatcaaaagcaaagcttttggtggccatatatgtagatatagagccagctagggcaaaaacaagccaagtgatacctaacccaactttggatttgggcaaaaaactgtcgtcaatgttttgctgtgtctccatgtttagccaaccccactactaacatgatgcatgtagtagtagtggactcagcaatcatggtggttcttggtcgtttcctctaattgttttggttgtggctctgcttaatttgtctgaatttgtcccaatgataggtatgcatacatatgaaaacatatgagaagtttcatgatattgcacttgcataactttgtctcaattatgcagaaaaaaaaaacgttattttttctttactggaaagaagtactagtgccagatatctggagaacgagtgtacatccattttctggatgccaataagccaaacaaatggtaataattaaaccagtatatatatattcactgaaaaatttcacatgccatggatgatgaactgttgattttttgtcacaatctctaccatagaaaaaaaaaagaacaggcaagaatatttcaggagcaaaacaacctctggtgaaaacacacatctcgtcatcgtctatcgatcgatcgattgaactcgctagctatcatatattcaggttgcaatttcccaaaggaaaaggaattaaagggaaggggagaaaaattttccatggccatgaaagagacctgcactgtccgtcccagcaagagcgtggtgacaaaccgaattgcaagcacgaactccaccggcatctagctagcgatggcgataatggtggagattatttgcggtgtggagaggaggcttgtcgccatcgccaacaccaccacctccatcatcacagtgaattctgaattgtcatctctctctcactgaaactttctctgaatcttttttggtttttgactcttcagagtagaggccggctggctttaccctggccttagttgtgtggatgattttctaccactcatcgccttgaatgatcttctttctagtggcatctgatgttctggactcctccttaaccacaaaaattaactgtcatcagaaattcagaaacaaaatcggcaggagtgaaagaaaaatgtttcttgcttttatctgtggctgtcaattgactgaatcctgctctctttttctttatcattttgttatgtttttctatcactgtactgtactagaggcagttgtttcgagaaattaatggagagttctggattctgaagcaagcaggaagattttgcagtacctatttctgatcgaaatgggaggagtgatgtgtgggtgtgggtttttttgttctgttgcttcaaagcaagaaatggaatatatctatctatcatccttcatcgatctctgcagcatactttacatatggtttcagttcagttcattgcaagtggttatgcctccatattttggtctcgtcagatattctataagggcatggtaccggacaaattgcgaaattctggaacaacagatttacactctggtggaatctgccatataaaaaaaaatacaaaacaaaagtggctcgccaagttgaatcataaggaattgcagaatatgatttgctcaattgagctattggataaatttctatatgaatttggagagagtattaaagaaagtttgaccttctgttagatttcctgtgtggctgcctattacatgtgaacacatggctatgcagaaaagttcattcttttgtttgagagagccacatggataaaattctccataagattcttagaattccataccctgaaaaaaaattcctcaaataatcctatgtcattcctaatttgttcctaaaaaggcgctaacgaacgattttcacgtattaaaaaatctctctgatccatgaagtgtttttggtgttgattgttgaattgaaccatgaaactgaaacctacacatgctttgcaagttgatgatcctgcctgcccttggtcccttcctacttttgagctgagcatgcctaagctttcccattgatgctgttgtgtgtgatggcaacaacaacaacaacaacaaccagttgatgagatgagaggattttgtggagttcagcccaccacactgataaccgactgatttgcccacttttgcctgctaccacaatacaagccccacctgtttgtaccaatgccctctccacctttcattcttctcccaaaactttattagctagtgctagctgttgttgatacttagtactggctagctaagcatagatgcaaatatgcaatggaataattatctttcaattgaatggctcacagattcagaacatgatgagtacatactatatgtaagccccccccttctgatggagaattaatcttctctttgattataattagcactttagtgtgatctttgactgatgatgctatctattatcatcatgaggggggcaataacatactagcatgcattatattgatgcatgtttgtgtgcactacaccttcatggcagccttcttgttcttctttgtcttcttcaccttgagtctgattttagcttcaggttggccgtcgccggcgaccgacatggttgctgccggtgaagaggcagcttcttctgattcttcagcctttttgggctcctgcaaatccttcatgattaactcaggcaccacccagttggacacgaagtagaagaacagcatcagagcactgcattttgcacacaggcgcaagaacatccatcaacaaaagttaaagaaaaaacagagaggcaaaaatcaatgagtcctgaattttgtggcatttgtcagatgtgaggttatgctgttaattagatgcgtattgatcgcatgtttttgcagctggtgtaaaatacagtaaccatctagactgtcatgttttgagtctgagctcactgaccatacagtgactatcaagtcctggtttttgtcaattgttggagataaaaaatgctaagcacaaaaataaaaaatcatgtgaaactaaggcacttccaacaatgacctggttagcccaagcccaacccaggttctacctagcccaagacacagcaaggcctagtttggcccagttaaagatgagaatttggatgtttcatagcccattggaacacaataaatttacacccactttcatataagatacaatcatacagttatattttgttcatacaaaacattgtctttcctgacattatcttgctgcttcttcgaaggccaaggaataatttgttattttcattggtaatatatatacatgtcttgtaatattatctgatgccatataagcttaaagttagttaacacaatgtattgattagctctgtaatcctaaaattagagtcttaacccttaagcataagttaatcacgtatttcatcctgtacttgcttgattttgctatcaagtattgcaggtaccagtatatactttacttagtactccctccgtttcatattataaatcgttcgaatttttattttatcaaacttttttaagtttgactaagtttagagaaaaatatagtaacattttcaatacaaaacaaacatattatcaaaatatattcaatgctaaatctaatgaaactaatttggtgttataaatgtttgctaattttttctgtaaatttgatcaaacctaaaaaaaattgataaaaaataatttaaacgatttataatatagaacggagcgagtaggataatgctggtgaagtacaatatgtatagagtactttgcctgattgggatgagggaggagacgtcgccggtgtcagccggcgagccggggaccagctgctcggggctgaggaactcgctcacctgcggaggtagcgcccgcagccgccgccccgaccacct

SEQ ID NO: 15151 - DNA, 256 bp, Oryza sativa
ataattcaggtgttagataaatacaatagttctcttgttaattaaatgtagagctggtgaatgggattacaatttcccgcaggatttggcggattctattgggatctgggtgggtgtccggtacttttgtacttacgtttcatgttgcgctcttcctctttattgggcacgggcacatccaaggctacatcggtatctgaaagatgaagggaatacacatagagaataagatgatgctgggcgataaggtacgacc

SEQ ID NO: 15152 - DNA, 948 bp, Oryza sativa
tcaagtgacaagcatgacttgccttgctctgctgctggaggaacctcggcgactatttcgaagtacaccggatcgtcttaggaaccggaatctagcgacatacaaggcaaacaatgcaaacaggctaaaagactactgaaacagggaacaaaaccatttttaatggattctacacatttttcttgatttactgagacttgaatgggcttaaacggagctcggatgaattagttatgaattttagaagattcactgtgtttattactataacaaaaatccttaaataatttattgcgcaatattttccagggctgacgtcagcacggagggggtgcggcgccggcaagcggggcccactggtcagcggctcaggggagagcggttcaacgtggaccgggaccacgcgggtggtccaccgccggtccacggaaccgacggcccagatcgccctcggggccgatcggacgggcggcgatagaggcggcccgcgggctcggctcggcatcaaagccgaccggccggccagggctagcggcggcggcacgcgcgcgtcgcgttgccggcgacggcattcggcggcggaggcgacggcgcaaaagcgacgcgaaagcggcggcagcggacggcggcaacgaccgaaggcgacggcgagcgcgatcggtggccacgcacggggaattagggaagaaaaggaaaggggagggagtcctcaccggaggggacggcggcgtccggcgacgaggagcgacggagggaggtcgacacgcggcggacggcgaccgggacgacctaaagaacgaaaagaaagaggttaaagaggaagagagggcccataggagacgggaatgccggcagaaagcggcggacatggcgaccctcaccgtcgcacgatgggaatggcgctccggcgacgaacctcgacgaaggaggggtggacggggtggatct

SEQ ID NO: 15153 - DNA, 7478 bp, Oryza sativa
tttttcttgatttactgagacttgaatgggcttaaacggagctcggatgaattaattatgaattttagaagattcactgtgtttattactataacaaaaatccttaaataatttattgcgcaatattttccagggctgacgtcagcacggagggggtgcggcgccggcaagcggggcccactggtcagcggctcaggggagagcggttcaccgtggaccgggaccacgcgggtggtccaccgccgttccacggaaccaacggcccagatcgccctcggggccgatcggacgggcggcgatagaggcggagatgtgggcgcggcggcggttgcgggcgcggtggcgcggcgggaggttggggaagggcccgacaggtgggccccacctgtcggtgaccccgggagaggagggcagcggggcggcctggctgggcctcggcctgcggccggcccagcagggaggagggggaggaaaggagagaatgggccggcggcccattcggaaaaggaagggaaaaagaaaaagaaaaaaggagaaaagaattttccctggaattaaaatattgcttgctcaattttaattggttaaaattatttttagggctctgaaaattccactaaaaatcctgttagtgaatttcgacctgtagaactcaagaaaaattccacatgccaattccgattattatttgcattgatttaaaaggggtttactcttgctttgcaccggtattttcttagggtcatttataaattaaatttaggcttgggaggagaacttcagggtgtgacaaacctaccccccttaaacggaatcttggccccgagattcggaggagctggcgaagaggtgcggatgggcggctttcaactcatcctccctttcccaggttgcttcctcttctgaatgatgactccactgaactcggcaaaacctggtgaccttgtttctggttcttctttcgctggtatcaagtatatgaaccggcttctccacgtatgttaggtcctcctggaaatcaatgtgttccgaatcagcctgttcttcaggtacccttaagcacttctttaattgggacacgtggaacacgtcatggatgccgatcatattggatggaagttctaactgataagcaacttccccccttcgttccaggattttgtatggtcccacgaagcgtggtaccaacttgcctttcgtctgaaagcggtgtactccccggagcggagtgacacgaagatacacgtaatcccctgcctcaaaagtgagctcccttcgacggttatccgcgtagctcttctgtcgagactgggcaatcctcaacctttccttgatgattctgactttctcttctgcttccgctaatacctctgtcccgaacagttgacgctcgcctgtctgatcccagaagaggggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaatatatcttccaagatttgattgactcgctcggtttgaccatcagtttgcgggtgataggccgtgctgaaatttaaacgggtccccaattcttcctgcagcttctgccagaattttgaggtgaactgactccctcggttagatacaatctttttgggtactctatgtagacacatgattctcgagaggtagagctccgccaaccttttgcccgtatacgtggtatgtactggtatgaagtgagcaaccttagtgagtcgatccatgactatccagattgaatcgtgacccgatgatgtccagggcagtcctattataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttggtgctgcctggatggatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctactctgactttatccacgagcgtaggccgtgcctccagagcggctacgaacccgtattcaacaattcccatgttgagatgctcaaagtcctgccgcaattcctcacacatgccctcgatgcacagggcagtgcagtgacttttcctgcttaatgcgtctgccaccacattggctttacccgggtggtagtgaatgctcatgttataatctttgattagttccaaccatcttcgttgtcggagatttaggtccggttgggtgaagatgtatttcagattcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccaccctgccctcttgcattaggacacatccaagtccgtggcgggatgcatcgcaatagacttggaagtctttcatctgatcgggcagaatcaaaactggtgcggatactaatttctttttgagctcctcaaaactcttatcgcactcagctgtccatttaaacttctcatctttcttaagcaactgagtcatgggtcgggcgatcctggagaagttttcgatgaatcggcggtaatatcccgcaagtccaagaaaactttgaatctgcgacacggtcttcggtggggtccatttggtaactgactccacgttcgatggatcaactgccacaccttgagctgtaatgacatggcccagaaatttgacttccgttaaccagaagtcacacttgctgaacttggcgtatagctagtgctccttcaacttctcgagtaccagacggagatgttgctcatgttcttcttcggactttgaatagataagtatgtcgtcgatgaataccacaacaagcttgtccagaaattccatgaacactttgttcatcagattcatgaagaatgcaggtgcgttagtaagtccgaaagacataaccgtgcactcatatagcccgtaccgagtggtgaaggccgtctttggaatatcctcttcccggattatcaactggtggtaggctgatcgcaggtctatcttagaaaacactttagctcctttcagttgatcaaacaaatcatcgattcgtggcaaaggatatttgttcttgattgtgacctcgttgagtgcgcgataatcaacgcacatcctcttcgtcttatcctttttctccacaaaaatgactggagcaccccaaggtgaagtacttggtcgaatgtaccctttctgcagctgctcatcaacctgcttcttgacctctgctagttcgttggccgccattctgtacggtctcttgtaaattggagcggttcccggtgccaagttaatccggaattcaatctctctcttgggtggcatggtagtgaggtcttcggggaacacttctggatactcgtagactatggggatatcttccaatttcctcaaattcttctccatggtgaccactgggatttccgcttcaatctgattcaaggagaccccttgctttggtgagtttggtgatttgtacactaccgtttctcccttctcgttggtcagggtgactgtgcgattcacacaatcgatgactcccttaaacttggtcagctaatccatcccaagaatgacatctaggtttttggattcgagaagaatgaggttggctagaaacggtgatctttgaatttctattgttatagaagggctgaattgaaccgaagtggagctattccctggggtatgaacccgcattggtgtgctaagttcctctcttattaacccatgcatcccgacaaacttctttgaaatgaacgaatgcgttgcaccagaatcaaaaagtactgttgtagggattgagttaacaggaaacgtacccagtacaacctctggtgctgcttgtgcctcctccgcagatgcgtggttgacacgagcctggataaaccttggcccggcacgcctaggcttcgggcatttgtcggcgaagtggccaagctcgccacagttgaagcaagaccctggttttgctccagtctccttcctggcttgcgcggacgggccggactgtgccggtgccattggtgggcgtggagctgcaccgcggttgggctgacctccatggtggttctgactgccactggcgccctggggaaagttgctagggtggaacgggcggtactggcgaacgatcatggtggtaggtccaccctgctgcccgggagcgaagcgcggcctctggtgacttccctgaggtgccctgaactgagcggccttcctcttcctgtccatcttgttgcgttgatcctcctgacggattgccttgtcaactagcctctcaaagtcggcgtagtccccagatatcagttggttggtcagctcatcatccagacctgccatgaacctttcctgcttctcggcgtcggtacggacatcctcgggtgcatatcgcgcgaggcgattgaactcatggagatactccgtcacagtcctgttgccttgatggagtgcccgaaattccctcttcttttgtgccacgaccccgtctggcacctgcgccttcctgaagctacggcagaactctgcccaagtgacttcagtacctggtgggcgggtggccatgtgattatcccaccaagctgacgcaggaccttgaagctggtgtgtggtgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctggtgctgctgttcggcgtgctgcaacatcctctggtacatctgctggtgctgctgctgcatctgttgcatcatggctgccatcatctgagtctgatgtgccatcacttgggctagcgtcggattctcgggaagtggtggcggaacattgccggaattgctgttgggatgcacaccctcagtgcgctcttcgccgttgctgccctcgcctgttgcgcggctaccattcctggtgtagaccatctggaggaaaagcatacaggggaaaagaaggaaaacagatgctcaggaactaagctttattatataggaatttaaactgcaattgttctgatctgaattaaaacacttaaaaagcaagcaaaaaaaataccttattaagacagccatatcataggcacatgatatcgaccgtcgactgaccccaaacaagcaacctaaacacacaaactaacaagcagaagctagacagtcgataaactaatggaaaacgagcctaatgctccgaacggctcctgcggtcggtggagtcgaaggcgtcctcctgctcgtcaccaggtccctctgagcgactcccggagcctggccgataagtctcgccgctgcccgactctgagccactggagctactactgctgagatcgcggctgccactgggagtagcagacaaccaacctccgttgccactggctggacccctggcggctgatgctggagcgaaggagagagcggacgcgggagcggacatgtgaacgggagctggagctggtgctggagctgcaggaactgcgggcggaactggaggtgctgcgggagctgctggcggaggtgggttcctgggcgcaagttggatgcgcacgggtgcagtcgtcgacatgcggggtgtagtgcggatccggactccttctggcgcgggaagtccctttaactgagcaatcttcctcttcaggcgcgctattctagtgcttcagagcgacgatccttatgagcgggccatcattcaaggcctttgacgccttgtgcaggtccgagtgcatcctatccaatccccttatcacagtacacatgtgaccaaaggtagtgtagttctcgtcagctgtcggacggaaagtactgacatcatcaccgctggctcgacaagggtgaaatcggtacgccgtgtcgtggaagatgtagttgtggcgctcccgtagtctggccatcatcaggtatgctgcctcctgacaggcgtgatctactgtgcctccggatgcctcaaccaccatattagctaggcaggtacccacgtagccgtggacctccaggcgaacacggtgaggaagctcgccactgagcggtggaaccgtcgtgtactctggcgcgttggggtagcccaccaccagcgtcatacgtgccaactctgccacaaagtcgatcatgccttctcctcggtggttgggggggtggccggccatctagagaaggcaaaggactaggatcaatgcatgctcaaatccaaatttaaataaagcaataaaagactcaaataagagaatcgaataagagcgaaattttatgcatagatcattttgcatgagagcgaataaagaagacagacccacataacgataaaataatggggaaattagatacatactaataataacaataagagcataaataccttgcaacccatgttcctgagctaggacccaaatcccaaatgactaacgaataaatctcaacagttttactaaaaccctggactgacttgttttgacaaatctcacttaaacgagcgaccaagatttttcccttgaaccacaagacagatcccaatttttcccggaacaaatccaattgcaaagaacatatgcaatgaaagggattcagagagctcttaggtttttccatttggcttgtcctacggtcaaggttggctctaatactaacttgtcacgcccagaaattcccgagtagaattccaagcagaatgttcattaaaatccccgtccaggaccggccggggtacacaaacgacaatgttgacattcagatccacgtcttacaaacatcataaaagtcttacacaaatgcagcggaagaaaagaaagacaacaggagctaagccttgactagaactgcagcgggaacaccactccacaggcatcctcgacggcacggacgaagcctactcctcggagaaaccttcatctgacacatactcgagctctggggatgggaaaaaatagagcaagactgagtactacccactgtactcagcaagtcataccggaataggggtatgatgcagggaattatcaaagaagagctggagtggttcatttgcataaagcgagcatttataaaca

SEQ ID NO: 15154 - DNA, 690 bp, Oryza sativa
ctggacaggcgaagatcacttactggttatgtgtttactattggcagttgtgctgtgagttggagggctactttacagtctgttgttgctttgtctactactgaggcagaatatatggctatttgtgaagcatgcaaagagttgatttggctaaaaggtttgtacgctgagctcagtggagttgaatcttgcataagtttgcattgtgatagtcaaagtgcaatttacctcactaaagatcagatgttccatgagagaactaagcacatagatatcaagtatcattttgtgcgtgatgtgattgaagaaggtaagctgaaggtatgcaagattagtactcatgataatcctgctgatatgatgacaaagcctattcctgttgctaagtttgagttgtgctcaagcttagttggtttaattgaatagtccaagagactattgttggcaccagtggttttctatctttgttgttcaagatgattggttgatttatgatacaagaagaatttgtctcaaggtggagtttgttggagttgttccaaattcactttaagatattggccgggcttctgacgaagcttattacggtacggtatatatgccctttgctagggttttgtggagacttgattctctttgtaagccgacataggcgtttaacccaaaaattttgagataatgagattgttg

SEQ ID NO: 15155 - DNA, 3421 bp, Oryza sativa
atatcaaccaaactttaatttaacaatgtaggtaagtggtaaggattaatacaaaattttcatgtacataaccactttgaagtctggacaatagatggggcaatccatactgaccaagaaaatctggaagggggattcaagtagctcaacgttttaccaattcgcattcgtactatcaaggagactatgggtgaggcaatatcaggctggtggctactgcttcgccttatgtttatgtttctagctactaaagaaggtcagtgcataaatggatcgttgaaatgacaactcctgatgcctcctaggccaatatccatgcataacagcacaactcgatgcatagccatcgaaattgtgtgatctgcctttatcaagtgttcatctatccctttctcagccagtagaatttcttgttccttatctgatcttcaatttgtaaaacatttcattaatttgatgcaattattcaaccttctcattgcagttcaatgtgacacatacaatatatatgtataggccaatcatatgatgggagacaagagatatatcattgcttttttatacatcggataatgttccactcagttccccggagagcgactcctagaatgcatgaagttaaacctctaactctaaaattattcgtagattaaaaaatactagccgccaactcgtgcgttgcatgggctctatcaatataatataaataaatatataggttttaatcagatgtcgaaactttgattatttgtttttcaaaatatctctctaaaaggcaattagcaggattgccccctacaactttaccttatttatattcttgattttcccacacaactctttaataaatagatagagaataataaaaatatcaagtaatttaattatcatagaataattaaaaattttgataatagcaataaaatcttagcccacgttgaacttcgcgtgtggcaggcaatgcttgcactgcaagatttttgtaattattgaattgctaaagaagacagccttttgattatctatttaaattagtaatagaaaggtttactggtgtcgtaattttagattttttttgatcaagtaaattcaaactgtacaattaatcaatgaaaagtactggagcataaactgttctttgggtatatgatctatacttccaaattttaaaaaataataagtatcatgatgtacttgtctaaatatctattttgtacgctcaaaatttagaaaaaaaaactatattagtgagtcataactaatgtgacccatagttaacatgattatgttggtcgccaacctgtgcatcacacgtgctattatataattattataaatattaaaaagttaatatgctaaatgttacttttctaattatacctatttaaaccaaaaagggtccacatcaaggactgcatacaaattattaatttcaaacttcggaattaaactaataaaatactataaaacaggagtcaacttcatatttattcatttaaattttggaattagcatttttttaggaaaaaactgaaactaaagagtgtatgatatttattaattcaaattttggaatttttcgaaaaaaactgaaataaggagtggatgatatttatgtaatattctattgctctagaatatttcaattgaaacatattctgttgtgttttacttaaaattatacttatagtgtacagattaacaaaaactaattaatataatcgagagttaaaatactaagttatttataattcatgcaaaatcttaaattgagagttgatatttcttaatatatgcatgtttgtaaataatgacatctaattgaaactgcaatgaagttttatttatatttgcattataggtgcaacaaagttgttttattttgtggatcaatacctaaattttatattattagatgtggtgatggtgtggttgagtcctgatctcatttcagatgagaaatatgtaaataaaacaaccaagatgaaaaaaaaaagattacctcaaaatctggatggagaaaatagtctgaacctatagagtctgaggttgcgtgtatccaattgacgtcgtcagttgagcagtatatgcacacaccggcacgctgctgatcgtcatgtgcaagacaaaggaggtcgatgtggcctccatcatgccatactccagcgttgtgaagagtaagttgttggctttgtctatgagtaatggagcagctcctgctgcgggcagagattgatgaaaagtaaaatcgtaattacctgtggatgacacgatgaatataagatcctcatagttaaaaattgccccttgacatagattagttaatttaataatatcttgaaaattgaacgtgaaccatatatatatatatatatatgtcggtcctaggattaaattgcatcttgcctgacaaataaaattagtaatgaaataaccaagcaaaatggttgaagcatagccaatctttttggaatgatacaaaaggagcagtacatcataaaaagtgtggaaaaaaaagaactaaccttaaatgaatctgcatgatatgcatgacaaagatagctataacaattatagtcatcaaacttttgctctaagaaacatagcaaagtaattagcttggctaaaaacgataatatgtaactcaaagataaacatttgcatgtaccattgtttactggaaagtaatttgtaagtaccaaagtaattagctttcagttgaatctgatgcagatgccattgtcttgctgattggttaccgctgcagatctatttaatatatacgtacgaaaaataatgatatatttgtaattaccggcacatgatgttcaaagagcagcttttctatttgcatcactgttattttggctgcaagaagcaagatcatgtcatcgggcgaatttgtgtacgcaaatataccgtgcggccacttgaaccaagcaatccgtattatgaattagtaacgacagaaaataaaatcaaacagtgcaagcagttatataatcgcctctcctgatgtgctttctcttcataattgttctctctccttattgaggatctgcttgctcctgcagcagcgctgcatatatacacgcatgcgcttcttgttaaacacagataaagacggttagggaaataaaattagcattactttttacctaattttgaagcagaaagattgaagggcgatgtccatctcctcgcgtggaacgaagttgtcagtattctgggtttgatcggattaacgttgatggccagccggcgaatgcatctgcctggtttacgctctcgtcgttcccatctacgttccgctcgtataatcgactggctatttcagatgggatcgatgggggtaggcgctaccgagagatatgatatagtgcgggcaaaattggttatatggcatcgaaagttcacgttt

SEQ ID NO: 15156 - DNA, 2903 bp, Oryza sativa
tatataaccaattttgcctatagtgcgttacatatactgcaaggtggatgggctttaacgtgggccataacattaagcgtagagactggattttacattaacggttacaatggtacgatatatctaaacaatagctagatctttctggttaatatgagatcttgtagaaagttctcaattagtatatgtatagattagatttaaatatttgaaaatggaaaatacactactggaaaactgatctttactcgctcgccccaaaaccacaatagtcccggttataaaaagaaccgggactaaagatgatctttagtcccggtttaaaaccccatagccattctatgatatttagtcccggttgctaacaccaaccgggactaaagatgatctttagtcccgatgatctttagtcccggttcatcccctgtcagtcccttgtcagaggggtggggatctttagtcccggttggtgtcacaaaccgggactaaagatcaccactttagtcccggtctttactcccggttagtattaccaaccggaactaaaatcacgcctagtatataatccctattccctatcctctcccccacaaccggcctcaatctcctcaacaacaaccggcctctcctctccttagatccatctcctctcctcctccctctcctccccttccgcctcccatcccggccctctcctcccccttctcccttcccatccaatgcccagcaagggccacctcctccccctcctcccttcccgaacacgtcaggcggggccgcgcccggcggggccgcacgtggtaggcggccggcggggccgcacgcaggccgcgcacggggagcaggcggcgctaccggcatccattctttttttctttttttttacaatttgtgattcacttagatgtataattttgtgatttgttgtatggatctgagatgtataatatgtgatgtatttggtttgtgtgtatttttttaatgatttgtgatgtatttgatttgtgtgttgaagtaacttaagatttgtgatgtgaatgttttgggatattactttgatttagggtttgatttaggaatatgcatcccactcgatttgggagaaaatacagggattaaactctggctaaaaaataatgaaaagaaaagaaaaagagacctaatgggactgccgctaccctctctttagtaggactaaagataggtaccaaccgggactaaagatcgatctttagtcccggttatttcactcgagactaatggtagcgatctttagtcccggattcgtagtcccggttggataaccgggactaaagggcggttacgaatcgggagtacaaagggtttctccaccagtgatatagatctgccatggaaagtactttatgtatggtgatacatgaaaatatagagttgtgtaaacatatactttgtaaaagtaatgcatgagacatgcgctataatgcaagtgggctgacctgcgaacctacatttatgttaaataaggggtaatctatggatttccgtgtaatggctcggcttgccccgtcgtaaagatgcaagtgggtcaacctataaacccatttgtaggtcaaattagtaggtaacccacagtttacccactaattttgtctataagcgggttcgcgggttggcctactttcatccctacatttttagggttatatatatggttttggaagactttgtgaaaatatacgcgtacaacagttcaaaaatgcgcgacaggttgtttcccgtggcatggagccgcgggaccaacggccggaacaatcccgcgatgctgacgcgcggtactgcgtcggtcctgcgggcccgctggctggccacgcgcgaccgagcagtgcgcgatgcccggtctgcatgaccgtgtggtgccgcacggctggctggcgggaccgctacggtaccgctctcccgattcatgggattgttccggccgtcggtcccacatctccgtgcggcgctaaaaaatcaatcgcgcattaccaaaccgcggtacgcgtgtattttcacaaatctttgaaaacattatatataattataaaagcgtgaaaagtaatatatattttcaaattttgttcctaaactcacagccgtgcgtctcaaatccaatcaagacagaccactcaacgctgtgcatacatacgaggaagctgcgtgttgtggcagtaataacaactcaattagccaacacaagttgtagttttaattcatcgtcgtaattgatacattggtctagcacgaatgcagaatgccccatgcattcaacataaatactgcactaattaattttacgacatgggctgcatgttagatgcaaagatgcttaaattattatcagtgttgatgcaaaacaattttcttgtgatgatatgatgaagcaggtcgctctctccgtcgctgtaattaagaaaacaagttgaatgatataagttgtattttctttttcccttgtactatatgatcaatcaacatgatctaatgtaaataagtggttcttttaatttggccactaaaataaacaatcgtttaatttgttcaataaaaagttatcactacgccagatcggcccatctgtgacggcctattagtgacggaccaaagtgcctcgtcagagataacctcatctgtgacgggttacaataaatcacgtcatagatagggctcaagaaaataacccgtcacaggtaagtactcatctgtgacggatctatataaggaacccgacacacaacatctttaacgtgtctacatatagacccgtcactgatgacctcttacctgtgacgggttttaagtttgtaacccgtcacaggtgagatacctcacctcaaacgtgttggatttttatacccgtcactggtgagttaaaaaaaaag

SEQ ID NO: 15157 - DNA, 4134 bp, Oryza sativa
caccactctctcctcttcctcaactctctccctcacttcctcccgacctcccgcctccacctctcttttcttcctcccgacctcccacatctcgccgcctcccgaccgccggccgcctccatctcccacgcctcgccggcccccggccatcggacgccggatccggccgacagcgcccccccatcgactgccggactcctcccccgcctcccccaccagatccggcctccacgaggtcgggggacgtggatacgcatcccggccacctcccggccgctagcgcctcctacaccgactgccgaactcgtcccccacctcccccaccggatccggcctccacgagatcaggagacgtggatccgcgtcccggccaccagacgcggccgcctctcgaccgtcggacgccggatctggcctccgggaagccggatccggccgccagcgcttcccacaccgactgccggacgcctcccctgcctcccccaccagatcccgcctccacaaggttaggggatgtggatccgcgtcccagccgccggacgaggccgcctcccgactatcgaacgccggctctgcttcccctttgctccgcgggcggatgtgcctcccaccagagggcgctgcggcctccacctcccgaccgtccctcgccatggccgccatcctcttgttttgctttgatattatattgttgtatgtggattgagaaattcttgccatcccctttctgtgaatgtgtgctatatgacttctatgaatgtgtgctatatgagatctatcggtttgaatttcttgtgtgagcaaagcaactgtgacaacgagcaccaccatggcagcgtgcgccattttttcttttgctaggtttttcacaccagtgacgggttgcacgctatgtctttcaattttttttgttgggttaaagatatcactgacgggtcacaatataaggtccgtcacaggttaatagtcacctgtgacgggttttatatatggtccgtcacaggtgttggtcaccactgacggaccttcacccgtcaaaggtgaggacagtcatcagtgaccacttatctctgaccagggccaaatccgtcagaggtgacagtttgagcccgtcacaggtagccttgtccggtgtagtgtataactaatgtaccctttcgttatgatcttactttacacgaaccagagaaagatgtggagacttgtcttgtacatgagaaagcctgactagcattcacacagttggctccttggaacatatgaattttgcaagaatttcatagagattagttcaattttacaaaaatcctcccaattccttcgattcaatggagtcctttttgcatcaagtgagattcttcttggttcttagttcgaaccagccagacccccaatgatttgttcctaactaatgtttaggaatcgttagtagtccttgtgatgttaattaagcactgaagcaaatcattcttcagcatatataatgcaagagctgttttatcttactttgagtataactatgaattccaaatatcttctaaagccggaatttgcgagtgggatagctcaaattcttcatataagttgtatgcttcagagtctacatccctatatatatagggatgtagtatagctaaaacacacccacacccttggccttcccgcaccacccacccaccccaccacctatatatatatagggatgcgctaaaccgcaccgagggtgtggtataactaaactactcccctcacggcacccccccattaacccataagtaattgagttactaacgtctttttctttcctcccgcactcttatcagtttggttctccattggcccatgagttactgaattactggatctgttaacccattagtaagtgagttactaacgtttttttctttcctcccgcacgcactcctatctattttcctatctattttgttctctactagcccacatgagtaactggattactgagacggttaacccataagtaattgagttactaactttatttttctttccacccacactcctatcacaattggcacattagtaaaatgattactgagtatgtagtaactggattactgaggctgttcacccataagtaattaagttactaacgtttttttatttttcctccctcactcttatcgcaattggcccatcagtaaatacaacgcaacctgacgacataatgttctattttgtgtacaataggacaatattgaacaagaagaatagtatccaacattgcttctctcggtgtatggaattaatttctaattccaaatgactaacacagccacattactgctaatacaaacatcatgtagccacattattgctaacacaaacttcttgtagtaatagaggtagtagtctaatgatgcactgtctaaagaacaggaatacatatttctcttaatgttgtttcttctctgaattcatggcagggaaccttcagctggggaatgcaatatgctgagagagacccatagacgccggacagtgcaagtgccacacatcattgtcgagcccacgcagtgttgcagattccttaatcctccccgccaacatttatccatcacccatgcaagaaacattgaactgtcacttgcacttgttctacacgtgtgaaaaaaatttaaaaatacatcaaaagcatgcactcaagtactatatgtagataaaaagaaaatggtaagatcattcaaatcttcaattgtggattattcaaggctccaatcatctgaactatagtatgtcagaactcaaaccaatttgaagatatctcagacaaggtcacacaaaggctaattgcacttgcccaggttaactgaatctaaaaccagtaacaaccaatatccttttctgttaaaagatcagagagtaaataagtactcaaaacaattaatagttcagtcctttctctgcagtgggcaatgatgtattaaaacctcagcctatgtgcccagattcacatagtccacccaaatttacatggtgtattcatgagaaacataattttattaaataaacaaatttacatgtgccctttctcttggtcttaattaaagtctcttctccaaacaaacttacaactagtatgtcagaagaaaccaaaaagggcataacgatttagttcacctaaattttcttgacagcatgtacattccaagcagcgtttacttctttaaatctcatcagtgaacctgttcgcttacaaaatcatttgaagagatttttctaagcggaaatcacacacaacgaaagagagaaatcatcagagtgatgcggatttttttcagaagcaggtcgcagtaaattcaaccatagactggaaccaacacaagatacagtaaaggagaaggaacgtgagtggtgcaaagtgcaaagcatgtaggatgtggaggagatggtggtgaatctggacatagatgtcatcgtggaggcggtagactgtgccgtcaaggcatcaaccttgccggagcggtagtggctgcgcacgggccttaatctcctcctcatccggcgaacgatcaggtcagaccggcgagggatgcatgagtgcgttacctcctgctgatggcactgccctggtggtctcacgcccctttggctccttgccgcatgcgttgtcctgcacgggcgacggcgactgtcgctccttggtcaccgtcgccttcgacgattgggatccgttacctcctgcttgtcgatcctaacagccagatccggtggtggaacgaccatggaggacggccgatctgctcaacgtcgagtaagctggcggtcctccccggttatggccgtcagccgttcgccgccaggagcacctccgcctgttcagatccaaaaaaaggaaaacagatgggtggttagtcacagcatgggaacctaccgtcggagtggttgtcacagccgtggtcatgcgggatgtcgatgcccccgatgatgagggtcgaagccgtggccgacgcgaggtgctggcgggttcggcaccgcatcgaccacggccaatgtggatggccggccgaggagcagggagggccatgcatgggaagaaaggcgcgggctctcggacgtctgcgtcggtggagggcggacggtagagcctggggg

SEQ ID NO: 15158 - DNA, 7387 bp, Oryza sativa
taccccccagccacacccaccccacatccctcaccccgcaccttttagaaataacgtataataaattaattactaaatgattgtttgtggcgcaatatacgataagtaacatatttactatacgtaaaaattgaatgatgtatcaatcccgcaccttttgctagcccagccaccaacaataatatgtgtgactttagtaattcatttactatcagtatgttttcgataagtaatcgagttactattctcgagtaaatgagttactatcagagacaaagcccattagtaaatgagttactaacagataagagtaacatttgtttggcacttcccttattggcccatgagtaaatgcgttactaacagagacttggcccacaatgagttactaacatataagaatatcgtttgctagccacatctcgtattggcaatgagtacatgcgttactaatagagactcagcccatgagtaaatgatttactaatagataagaagcaacatattcatggaataaaaaaattactgatatgtattgggattatccaatcatggagggagtaaaaaagttacttagtagttgattgggcctgatatataaggtagtaaatattttactgcacgaatacgggtataatggactttgtttttacaattgatcgtgccatcatcgttacaaacacatatacactcggtaccaaaaaaaaaaagcacaatccagagggcatcgcatcgcctgccaccgaagcctgtcatcaattgtggtgtggtcgtcctgggttgaccctttgtgttggccgccggcgacgaacgttgacgaaggacatgtcgaggatggcattccagtggcaccaccaccactggcataatcttctcatgttcttttctagtttcctgaacacaaatgaattcacaattaaaaagaaaattcagatatagatgagcaaccaaaaaaattagaacatgtacatcttcaacagagcaaataccaaccaccataccatcaagatgtgcatccacctgcaagagtgcacactgtagatgctgatgcctgcaagaattagaagttaataatttcagtaaaatttagaccttagtcttagtctgaagatgtctgttctgtcaaaaatatacagagaaaaaagggtatgttcaacagcgaacatatctagtcagaagttcagaaaaaaaaattcaatcgatgtgctcctttgaacaacaaaaatttagaaaactgctatccgatcgagctttttgagctttcatctatccgaaaattcagaatcaggacatgcagtactaatttcagaaaaatacgacgaatactgtacacatgctgtaaaaatatcacatatctcagagtttacacatctcacaggacatgcagtactaatttcagaaaactacgacgaatactgtacacatgctgtaaaaatatgacatatctcagagtttacatatctcactgcttatttgtgaactagattagtgaaccaaatttgtcacttgaattgctagtaaagtacctgaactgctcgtaaagtaattaaacaatggctccaatatctctaattagtacctgaagaatcaaagcacaaacagcatcgcataacattgttattcagccaaattaaccgaaaaaaatctccaagatttcagcaattggaaagacaacaagtcattacagcttattgaatagatcccacaacagtctgagcactcaaaaaaactatgtccaattaaaatagtatggagaacaaaccgaatggagaccacggcaagacgacatcgcagcaccctagaccacgacaagagggatgtcggggacgcgcggggccgctggatacggcggatctggcggcaaggctcccaaaggctacacccttcttcacccctggcgtcctcaagtattcctcgtcgatgcaggctaacctatggagtgcagggagcaggagctcgtgtcgccctgtagcatgtacatctggaacagaagaacaaggggcatctaccagcaaggagcttctcacatgatacccatgccattgaagcttccagatctggagcagaaccaccatgcaaaatcccatcgcatgaagtaaagaaaaaaaaaagaaaaaccaaattctgattcgttcctatacgcagggagggcagaggaaccctataaatcccccaatccccaaaccctagagaagtccccacctcaccaaggagaacgatacagcaatagggatccagcggaggagttggcgtcgggaggtagcgcgggtgcggttggtggaggcctcgtcggcagccttggcggaggcggcgcgcttcttgcttttctcgcttgagggagggagccgacgacaaccacggaaacgagagcgaaaccgtccccgcctcctcgccagacatggacatgcccgttcttgccgcctaacccattagatccagcacggcgcctcctccctgtagcacgccatcgccgtcgccgccgcctccgcttcctgatgccacagctgccgagccggcttcctgcctctatagatccaaaaaaaaaaggggggaaattgattagtggttagttacggtgtgggaccaacacatgtatgtatacgacgatttaaacactactaccagtaaaacaattactcagtagaaattgatagtaccgttagtaacaccattacgggaattgagggggacagggatgtgctagtgtggtgtggtgtggtgtaggggtaggggtgtgggttgcccccagggggtgggttgcggtttaatacaacgcaacccatctgtagtatagggccggtttggttcatagcctaaaatggccttaccaatgtttgggccacattaacagtacaaagtataattttggtttggatccaaatattggctggcctatgcaaaacaataggtcacgcacccatttgtaaagttattgcactcagacgtaaaaataataattgaaagtcaattaaagtgatgtaaaaattattatatttcggttgatatttgagaaggtgaagaaaacaaaaaaaaatcttaaaggtaattggatgtaaattgtactagaacgcacccatttgtcaagttattgcactcaaacgttcaattcccaagttcttgcactataccgcacccacctgccaagttgttgtaccgtgggtgcaatttactcgcacaactaatttattgttttcaccggcgccagctaatgaccgtgccatcccacgaggaaacaatctcaaactataatggaaagaaaactactaggaggctcaactgaaccccagtacggtggctatttcagaaggcctgcagaataaaactcacctctaatgaataataaaacacaaaggggagaacatgctaacaatttcaaacaattgatttccccacgtaaaacttgtataagatctggcatcggcgaaaatttatggtctatgaggtggttagggtaggggtgggggggaccatttctatatggagatcctacagattttccttttgaccgatagagttggcatcgcctacggagtgtgtgtgcaacaaggaagattagacctaaaggagtcaaatatagccagcataaccactcctgatgcatgttcgtgtgaggaagatcggcgtgccaacgaatggctgaaatgacaactcctgatgcctcctatgccaacaaccagggaacatcatatggctggaccctggagtttcagggtgtgctatctatcaagtgttctttcatctctctctcagcctgtaaaagttgtcgctcttcctccgatctttgatttatacagcaattacatttttatgcaattgttcctactctgtcaggatagttcaatgtagcacctgccactccgtatatatgggccagccaatcaactcctacatacgtttagacaaggaaatattgatgactactccctccgtttcaaaatatttgacaccgttgactttttagcacatgtttgaccgttcgtcttattaaaaaaattgtaaaatatataaaatatatatgtgtacatgaaagtatatttaacaatgaatcaaatgatatgaaaagaaaaaataattacttaaattttttgaataagacgaacggtcaaacacgtactaaaaagtcaacggtgtcaaacattttgaaacggagggagtatcttttagtaccttactaattcagaaccatccactccaaacccactcgagctatacctgacacgaacaattcatcaatagggggatgatgggactgcattatatgtgcatatatgattccctgaaatgttctaatacgtcagtatagcacttgaatgtatttatgtccaagcctttggaccaatgcaaccaggtaatcaatcagaacggggcgttgacagttccatccaatcaaggtagcggttccgaactagggtacgtaattttatcattcttgagaaggaactgagagataccacatatttcagtttaaaatttggtacttctagctacgtgctaagtatctcaaagatcgtaaaatttcttgaacaaagatttctaacccacccaatatttattcgtattattggtcgagaatgcagcttaccactgtagggataactcacatgccaatggtaatagatcgctgcatgtagggatgaaaatggatcataaatggacggaaactagctttatcatatttgttttcatatattttttcggaatcggaatcggaatcgaaaactcggatacggaaatgaaatcgaatattatcgaatacagatacggagcgaatacgagacggaacgaatacggtagcgaatatttaccggtatataaaaagcccctcaaattgagtttcttgatcaaggaagagagatcacttattattttagttcaacatctccaacatttatatcgtcaattttgtagatggtctcacaaccgcatatgaaaatcgattttcatggttgttcctctaagagatccatatgcaaatatgattatcattttctattctcaagactttttagtagatgtataacttacttgacattgtataaattggagatgttatttattttacttcacatcttcgaaactagtaatatttgttttatgctttaaatgctttcaaatacaaatgttataaactacaaagtggtaaatcccgttgagctctacaattttgatatggaacacatctccatcagatgtcatttgaattgtagatctgagattttgtaaaaattagtatggtatattataatgaatatttagacccttaaataacctcaaataataaaatagtcaataagaaagttgtagatctcatcgacctctacaattttgatataaagtttgtcttcatctgattccgtatgaaaaagttatgtatatatacgtgttttttctaaaatttgctcaatgtctgcggatatccgaaaaacattccggatagttttcgaccgttttccgattccgacggatagtacccttactgtattcgttttcgtttccgagaaaaaaaatccgaattcgtttccgaatccgaggatttccggatagttccgaccgaaactatccgaatccgaaaaatggtctggacgaacggaaactatccgaaccagtttcatccctagctgcatgtgtacattaaaactgattgtgacaggcacaatgtatcggtgaattgatgggattattccactttgtcatgagggcatccacaatatgaaaaaaaacctgcaaataagtaggattactacttggttcaccattgtagaagtagatattaagatgggtaatagcttaatccaacaataacactactacatgacaataactaaacaaatattgaaatctctatcttcccttcatcctccctcgccccactagccattcatgcattcatctagaacaacaatagatgttacggctcgtgcgcacccatgagctgcaactcttaagcgatagatgtagcccagcaagataaaattctcaaggacatggtaaactagaacacttgagtgtcatccttcaagatgtcgcaagaggatcagtaacacaagagcttccggtgcctcccagacctaccctagctagtgacccactggacacggtaatggacctgaccataactcatcatttctgtatgataatttgtagcactggcgctcagtcgtcttatcttttatggcacaaaaagggcagttttagacaatcgtaccaaatgttagcttcccatatcgccgtacaattgcaaatgacatttttgcatagaaaactctccgttaatacaagtatatgttaggccccctgataatcctactgagccacctcccacccgtccgctcaaaattaagtggtagtctcttcgttccaaaatataaaggattttggagggatatgacacattctagcactatgaatctggacataagtttgttaggatgtatcacatccctccaatttctcttatattttgggacagagggagtatagatcagtctctttgggaagcggcagtgggtgtttttttcacatggaacccttcgttttatccgcatttggagtgaagaaatactcttacactgtcattactcacatctcacaaacttgacgccacattgccaccaagtcacagattcaaccttgctagggaaggaagggggtgggggagggtgtatcgatctcgtagcataggcgcatagccaagagattgatgcagttcttgtgaagtcgccagtcgccaccacagtccattcaggttgcgcctaccagcattctccccataaattttgatccttgtaccctgccatggtgatttgaagaagatatgataccaaggttggttttgtcaaaggctccatcaccaggacaacatgtaccgccaccgctttcagcttctacgaaatggattgtatgatcaatcatccatgtggctaatcagaaaggaagaattctgggaggtttatgaattctgacagctagcgtaatatcgtcaggatctgtatctaccaatatttgccattgtctggaccattcctcaattcttagtttgtaatcagtataaataataaaaacatgatcaaacaattgctagcggtgtgcctgtgttaatttgacttcctcattgcatttttctgaattctagctagttcaaactgcaagcaagcaccagttttagtaatgtccagcacgtaagatttacattttctttagatactagatatttcattgagtagtgaagttacatccggtgctctcttcatctagtgaggatgcacccagcccgaaaagaaaagaaggaaaaaaaaaactaaaacagcatgaacatatcatactgttgcaactgcctgcttcacctgtaactgtgacgacaacatagtgtctatgccatttgtcgaga

SEQ ID NO: 15159 - DNA, 19332 bp, Oryza sativa
tgaaaactagaattccgaatgggatctttgcaagttgttggtgaaaagacagttctctcagttgcatcattgccagcaacccaccacgctggtatttctcacttctacagtcctactgtttcatgttcacaatgcctaaccaaactaactgtatgaatgcacggtagtaccaatttccatgcaatttgtaacgcaggagttcccggtgcctcataggcctactatagcaacccaatggactgatttttatgatcactcttcattagcttgtggaacttgcagttggttcactcacctcatcttttatggagcagaaagtactccctccgtttcaaaatgtttgacaccattgactttttagcacatgtttgaccgttcgtcttattcaaaaaaattgcgaaatatgtaaaactatatgtgtacatgaaagtatatttaacaatgaatcaaatgatatgaaaagaataaataattacttaaattttttgaataagacgaatggtcaaacacgtactaaaaaatcaacggtgttaaacatttcgaaacggagggagtaccacacaatacatattgcttatctcatatatatcttttgtgatgtacacaatccattgcttggcaattatatattcaagtgctgtaggtgttcaatttgcagctacagctgcatgcttaatctcaaccatcaaatgctggactgtaagatttttgcagttgtccaatgaaactattagtgtttttctccgagcctgtagttatttggtgctctttgacaaaaagttttccctgcgaattatccaaaacctgcagttcagtataacatgcatacatgcacatgccagcaagttttgttcagttagttcattctagacctggaagtgtagacgacgctgcatgaggcagccattagattaagccatacaattctgagaacaatttagacggccaatctgaaaatgaaaaatattataataaattgttttccattcaaatgttacccaattagtagttgttagcatcatataaatttttaaccgtggtgtggctcaataactaaacgatgaaagaaaaaacatctcccaagaattcttgtatcatatgacacaaacatgaaacattaacttagtcgtacatattaaattcttaaaccatttttgtatgatgcatacaagatttgtatgagtatacaagacatgaatatcaaaggaaataaaaatgataattagtggttttctagaagggatccaagaggaaacagatgttgcaatggccccaacggtttcctttggttgcattctctctgcacaggtaaggactggtcactgatcagtggagtaacagttcccaatgcctccaaggcccaacaacaaccatgcatatcaaaataaacctgttgcatgattgatgtggccttgaccggcctccatgaagcattgtgtttcacctttctctctctctctctctctctctctatctctcatgctatggaattttcttgctccttgtgatctatcatgtataaagcatgcatttcatttgatgaatctattccaccattgtcattacagttggacgcagcaactacaacctgtatatatgggtaggggtgggcgtttggtttccccggtttaaccggttcagtttatcaaacattaagccaatcaacatctttaagcctggtaattaattaagccaagcaaggcaatcgtgtgtccagcctagagtgacttatctgcagcctctccatgatctttagtctgtacaacaatttattaatttgatgcaattattcaactcggttttacaatttaatgcactacctaccaaaccggttatatgggacaatcgtgcggtggggtacagatatgcaagtgggtagtcctgctacccgcaaaaaaaccccgcttgctaattcatttttcacatgttagtacaaaatttagaagaaaaaatgaactagaagtgagataagcgggccaaaaaaaacccgcttggccgccccgcttacatccctatactagaggtatcctctacttaattacttggatgttcaactcgcttaaagagtttcatcattatctatacatcaaccatcgtccccagctcagaatccttataattagtttagacaaactccatgccatatcgttttgttgccaattaacttcaagagggaggaggatgtggtgccgagtgcacccttgatcctgtgagcccgtgaggcgccaactatcattgccgtgcacggaggaggagatgtgattgaggataagcagggggcatgaatgaataatgcgtaatcacattggcagatcgagagcgagcctgacagtgaggaagacaaagacatggtgtcttgcacggctgaaattttataatttgccactgtagtcatatgagtggtaacccatttgctatattggtccaattccgatgatatagatggtccacatgtcagtggcaaggggaattgcacccgtttgaactaaaactaatatggggcttgtgtaaatgtagcaaaacgttgtgcccacctagttttacaggctgcatgtaaaccacaaacatttcctacccaccccatatatatgggctgcacgtagaccacgttatcatttcagcccaatggcctaaacatgcacatgaatcgcattggatacagataatatgggctgaaggcaacagtaccgttctggcccaactaacatggttcgcatgtcaaccgctgtcaccccaaaagctagccgttgaggcaaggggctcccctacttatatcttaggtcatttgcccttccacaactaatgtgggactattcaacaaagcgctttggcatgtaccacatcaattccgcttctacacctggagagcttagctagtgcattgattatgatgaaatagcccctgtcaggagctgtcgatgttaaagctgcttgtcaggagctattgatgtcaagccgttgttaagaaattatgatacaggaatccctttcacctagtttcagcacaactatcacaatcctctgcagtctgaatttgcaatagagacatctactttcaaagtccgctaatacatcattgatgaatacaagttccatgctgagcctaacattatatgggctcatcgagcctaacaatatattgatgtgcaagagctttgcacatcaatatattagtaagagagaaaaaaaaagtacaactgtgacctgatgtagcggtcatgggagtttacacgaggagaaaggagagcaaaggctgtgttagctaattaaaatcaggccccgaacaaacaataaggcaggaaaaagaaaaaaattcaggactatatgcgagaaggactcctagaggattaggcttcactcctacctagagcttcccctcctacacgatgagaccatgccaggtaacaaggaggatgagggagtcgaatcctttgctgaggttatcaggtggctgccggtgagagcagttccactggacttggagtgtggactgtcggttggatgaagaggaggctagtccgtttttaggcaacaaattggaatatatgcgaaatagcaaaatgcaaaatggaatgcagagtgtggatcgttatcaggcatatgcacaatggaattggtatggtatgtcattactttcatttcagaccaagtgacagtgacaacgccattcatcatgtctaaaatcatcagcgatagagccatacaattttgagaactgtataagaaaatatgatccagaaagtttctttccagatactcaatttttagaataaggctagcacagtgtcttaaactgctaaaccatctatctaccatatatcatgcttagcagaaatcttactttgatcagctgaaaggcaacccaatcatgctcctgccatagtggaccatcgataggaggaggaaaaacatatgaccggcttgacaggaacaggaagaagacatggatgaggctggtatcatcagaggcggcgccgcaagaagacataggcagtagtctgccatgccgccggtgcacggtttcggcccctatatggacccgaaagacggcgaggtccacctaactgctctcgccatgacgacaccgataactagcatggcatcttatcatcccaccgcgtgaatatcttctcacctagctgcgatgctcagtgtgctcactctcgtcaaggacagttgtgccgagtgcgagtgcttggctgtaggattgtctcaaccctgatgacattggagatgatgaagtaaaatgatgaatcccgatgcctcctaggccaaacagcctgcaggcactacaaagtgacctggtacatggcggtacatataatatacttggagtggcctgatctgccagaaagtattttcacatgaagtgttgtttgttcccactctgtgtttgtagagaattcgcttctttgctgatctgttgattgattcatacaacatttcattcgatgcaattatttatagagcctttatggtacaatgaaaggttctaagtcctaatgtatagattgattttccttccacttaaatagattaaagtataaaattaaaagcggtaaaattgtatttttgtgctactgctcggatgcaaatctataaatttgctttgtataatggaacaacgctaggtgttttcccccagacgagcccattcctcattccccatcatccactcgtccttcaccatagcgaggtgctactagctactgcaagtccatgcacaccgtgccactgcacagtgggcatgctgcgctaacactcattcttttcaattttgtggcaaatttgtagagcacctttacggtgctccatactaccatatactagtggattatactaccgatccagtggtttaaattttactagctcaataactaactaattactacaaatcttggtttgatcaattacatgcagagggccatcttggttttgaggcgaccggcttctgccgatgctccgcaagaagaagctcgtcggcggtagtctcccacgcttccagcgtgcagttttagccccaagagggaggcgaaagtcggtgaggtccatccatctaaccgctctccccgtgccggcgccaacacgcgtggcttctttagatcgcaccgcgtgagcatctcttctggaagctgccatgcgcagcatcgttgccttcctcaagtatagttgtgatggcggcaagcgctcagctgtaggtctatgatgagcctgatggccgtagggatgatggagaagcgaaatgacaaatcctgatgcctcctaggccaaatagcaaggcattgcaaagcacatggctgtgtgcctggagtggtctgatctgcaagaaaatttttttatatgaaatgttgtttgtttgccccccccctccttctttgatctggtatttgatttatacagcattttattcgatgcaattagttaactctatcgctgcagttgaatgcagcatctacctcgtaccggagatatctcagtacttaattttgaggataatatcgtttggctccaactcagttaaaaggttcaggaaaagaaatgttgatggctaataattgtgaaaccaagtgttgttttggtttatttgtaaaattggcaaggaaattggaaaccttctgttggtttaatttcttggaaatttggtttgaaatgttggcaattgtcaacgttagtgcgcgtgactaatgtgggtcaggttgctatatctatgactagaaacggttgtttggtctatatgtgtactatgtgattgaagtcaaccttggtccatggcgaggatcaggattatgcttagggagaagcagaggtctagcatattccagactatgctcacatagaagaagaaatttccaaaatttctgaattttgggtctatcagaccccctccccacccccgcgatgcaaaattattttgctcgaatatttttggattttttcaactttttgtgaattcaacaaaaaatatttgaatttgaccaaattttattaaaaattcaaattatttcagaccgaaataaccgaaatttcggccgtattgtcaacccctgatggaactaccgaaattgaaatattgaacatgtcacgcccggaatttctatccaaaatttcaaacgcttacatgcgtgtgaaccctcgtccaggaatcagccgaggcatacaataacaaattgataatagagtataattattactctaattaataagcgaataaatgtcattacagaggtagatagttcctctcaaccaataaagatctaagcagcagaaaaataagataaacggtgcagacgactccactccacaggcaacttgaccagggttacacctaatcctccataccatcagcatcactgtagaactcctcctctgatgaatgattgcaaggtgagtatatgacatactcagcaagccacgcagcaaatatgcaagtgcacaggataacaaaggatggcatagtagggtttcatttgcataaacaacatttaataaacatttcagaatttaataaaacggttaagtaataattaaacaatattaatccaacgctatacaacataccctgttgcataggcccaaccattctgaacaaccatcccagctgcagagttctatctccaaaccaggaatataccattccaaaccaggagctaatcaaattattaccagttatagcatcttttattatggtgagaaatgtgaaactaatcacgaaagacattattagacctgcccataaccgcaggcacggctattcgaatagttttactctggccagaggtgtaccactgtacccacaagacacagccccacaacgtcaccatgcgcctcaataccaccacggtacctcagaaaggagctgtgacagtacccctcgcacaacacaatccaccacagcgcaccgttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaactgaaactcgtgaaccggtccttaatcgtcgtgagcacgaccatcaaaaccatgtgctcacaacccaccattatcaaattttagttggcaatttaattaattaaccaatcacgattgaccatcgtgagctatcattaagccatcattaaataatagtgagtcataagtatcccatttatatggactagtgtttctaagcatggctaagcaatcatatctgatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcaaaaacggactctccggaaacgtcggaatctaaagagaaaagagcaaaatcaccaaaacagcacataaacaagcatgaacagtatatgttgatatttttaacatctagatctcaattttagaaaaatttagagacttgaaccaactaaatccgagctaagatgaattagttatgaatttttaaagattaaatcggattaaaacacttatatggattttaattgaattatgacgcaataatgaattatttttgaaaagtaaaagggaattattgcgtcagcggctagggttcgcggtgaaccgggtgcacggcggcggctcacggaaacgaacggccgagatcgattcatccaaaacggacggccaagatccatcggtccacgaccgggccacggggaatgacgacaatgacgtcagcggtgacgtcaccaccggcgacggctcgggcgtgcatgctcgccggcgaacgacagcacgacagcgcgaacggagggaaccaacacgtagagggcgacgcggcgaactcaccggtgaccaaaacaatggtggaagatcaacggacggcgacggcgtcgaggaagaagcggcggcgaccttcggcttgacgacggcgatggtgttacggttgtcgtcagcgacggcggaggggcagacgaggtcggcgacggcttggcgatcacgacggcggccttcccgagcgacgacgacgaccggagcggcggcggcgcacggctggacgaacggcggcgacggcggcgctaggctacacggtgctagggctctaccggcgacgagaggcgaaggcgagggtggcggcgggtagcggagacaccgggggtccttttatagggcttaggaggcggcgacgaaggcccacggcgaccggcgacgtgaaggaaagtctagggttcagaggagagagacgaatccgattcgagatcgaatccacggatttccaaacgaaattagccgacgattccataagagaaaagatagaggggatcccggggatcatttcccctctactaatttcatcggaaacgaaaaggggcggccggatttggaaggagatggcggcggcgcgactctagggctcgggcggcgggcggccggaggtagacgacgacctgacaggcgggccccacctgtcagcgtccaagggcgcacgcacgcggctgctgcgggcagactgggccggctttggccggggagagagagagagaaggttttgggccgactttcggcccaaagccaaaagaggacttttaaaaccttttccaatttaaattattcattaaatgcaattccatttattaaaaatacttccttagctcaaataaatcccagaaaaatctaggaattatagaattaagcaaagtatttaatgaaattttatctggccctattttatattgtaatttattatttaaaattagatcttctcttctaggcttttaaaataaattctaataattctaatttagacaacaatttatatatttgggatttttagggtgtgacagaacactagccctaatcctaccatagtgaaccatcaacgggaggttgaagaacatatggccggcttgacagtgatagtaagaagatatggcagaggatggtgccatcagaggcggcaccacaagaagacgcggtagtctgccacacattgccggtgtgctgtttttgcacaaagagggacatgaaagacagtgaggtccatctaactgctctactcgtgatggagccaatatgcgtgcatgacatcttatcatccccaccgtgtgaatgtctcctcggcaagctgccatgctcagcgcagcgtactccctccgtcccaataagaaccaattcctggctatgaatatggacatatgcacatatccatattcatagccaggaattggttcttttttggatggaaggagtactcgccatcaccagggaaaatcatgatgaaggacgagtgcttcactgtaggactgtttcaacactgatggctgttgagagcggcaatgctaggtcttttcctccatcgatccctttcatctttcctcaatatcgtccactcatcattcatcatagcatgtcgtcactacccaccacacaagtccgtgcaccaccgccttgcgcacgctgtgttgccatttgccctttctaattttctagcaaatttctaaggtacgcttgtttatactgatagtattaatatcagtatattgtactataaaattcctcattaattaactgtcgttgcagatgaatgtagcacctacttccacctgtgtatatatgggccaatcatcagatgtgttttggagatacctcaatgcttaattgtttggataatgttttgctccaactcaatcaaaagttcaggcaaagaaatatattaacggctaattaacggcatagtatgtgtacgtctccttaatgttctttctgatgttgaatagacacaagtagcaaacaaaaacatcctttagaatttataatgcaagagctgctttcaccttactttcatagtggttatatatccacattctctgaagtacgcattcgaccggagatacaacttcaaagtctgctcgtgcatttggtactagatttccatcttcaagggtctcattaaaatcaaatggcatatgatcaactcctaagaattgtccattggatgccaaaaagatggatgtacggtgtatgcacagaactaatgttatgggcagacaggttagttgttactagagccccactacagtgctctctactggtatagaaagaaatctgaaccattgatctcatttgataaaagggttcatatctatttatactaccatcccatttagcggtagtagaaacgtggagggacattattgtatcaaagaaatatgtgcggaggggcataatcatcattttgcagttactaaactttttttccttattttttggactttttcaaggaatactagtgatgccagtgcaatggataatcataaatcgatttagttggaaaagaacataaatgacagttacttctaattatggtattagtaaattactaatttgcccctaataattactggtagtataatattaccagtatagagcaccgaagcatcgctcggattactaaggttgcttctccgaacttattctccctcaattgtgtaacaaggactctgttagttggacagactcgagaccaggcctctagtgtaccactgctattgagttcatcattttacacgcagatggatgggcctgcctagactggcacggaaagacgaggtcaaactaaatatgtctaatctgaaaataccaaaagaaaaatttgtgacaaaaatgcgacttaagtcttttcgtcatgttctgattccagtggaaattcatctacaatagtagcgacaacgacagatgttatggcctttgtgagttgacttactgctaccgtcgacaaacaatgtatgcccctctgcaagatcaaactattgagtgcatgacaaagagaaactcctgagaagtcaacacaagggttaatttccgtatgtaatacatgagtttgtgtttgcttctcaggtgtaccctaccattgggccactagagaccagactggttctcatcctagtcttttgacctgtaattttggagtcattggctgtcgcttcttataagaaaatgccggaatgaattccattatcttataaaaataaacttcttactaattacagctggtatgtgttggcttcatgctactatcgaaagatggatgccggtttgctagaattgtcagaacaatagaaatgaagtaacacaggagcttctctggtgcctcccagccctaccataacaacccactgaatagtagactcgtcctcactaactcttcatttctctccatcagcttgtagcacttgggctcacccactgcctctatatttcatggaaaaaagggcagcacgataccatatatgaagatcctcgacgttactagctagcacattaactaacaaatgaaagaaagaacaagtcttaaacattcttgtatggtatcacacacttagtagaaacctcaatttgaataaccagacataggattaaggactaagaaaaggtaatatttgcatgcataaattaaaatatactatatatacaatctgaacaataagaatggggatatgtgccaaacttcaagggattcaagaagaaccaggcattgaaatcaactcagtggtttattcagtttgcattgtggaatcaagaaaactgagaaaaatcctttcccttgtcacttggctgttatcagaagtgggatttaccaaggatgagtcttgttttttccttttgtgtggataaggatgtgtcttggttctttgtgctttgatgattttttttttgcggggttgtgctttgataattcatacacttggtcaccagacatctgctttcgacactagtagcgaagccaggatttgatattaggggggtgtgggtgtggggataagccataagaccgatcgaccaatatcgatagctaagggtctcaaatagtcaccatcaataacaattaatgtgtaaactagtcctttaaaaaaacttgaattctagctctttaataatatcacagaaagtttggaactagtctttattgctaaatcctttcaatgtaaactactgaataatctcacaaataagtaacttctattttacttccaaaaaagatgagaaatcacaaactaaatatgaaagttgtagatcatgttcttgctaatgttttttttcagaactgatcttgtaagtacaaccatacaacaacaggttggttgtgggttggggggggggcgtccggataggtgggtgttgaccccctctagcaccccccacagttgtgccactgttcgacactgctggccaagaacttatttcacacatgcgtcttgttcctgccatagcaaagtggtgacatgaagaagaaaatgtcaatgacaaaccaaggttggttttctatgaggggcatcagtaagaagagtccccagtcttgtttgcctccttgatgtggctccatttcttaggtggagggaaaattaatcactctaagaatggttcgacattgtaggttcctatgttaacagtgataaggacaagcgcgctacctggctcaagggacccccaacgatggtttgagcttccctgagactgagagggctcaacatgcttcaagggaaccgttaagtctagctctagctctggctttgtttcattgtgctgccggcaacctgaccaaactagcagcacgtttcctcacttctgtcgaatgtcctgagctctgtataaaacagatgaactcctggtgcctcccaggcctaccacagcatgcaaccttattggccagtcctcataccgccattagctcttagcaaagtgctctttctcatcacaagttttatagagaaaaaaaggaagtacgatctgattacatatagttattcatcattttctgcagttcttttgatcattgtgcacctacaactgcatatatatttttccttttggagatatgacttcaagattagtcactcttcaggttatcattagaatgaccatacatttaagagcaaaatatatggccggttcttaaacatgacagaggtgccacttagctccataaactagaaaaatgcacatataggtccatcatcatggcttgatgaaccatggtcggtccaaaccttatttgactggagttgaccgctgacgtgacattccacgtgggcaagactttctcagccacccaccactccctcctcactatcccgccgatgtggcattccacattggcatcccaataccccgcactgatctgcactatcttattcaccaatgaagacataactctatagataattgatgtatcccaatcccaaaacttacaccctgatccatctttctacagaaaatccaagtaatgtcaaatcatctccctcatcgctacccaacacttcggcttggagtggtgggtggctacaaaaccaaatgaactcaactaataatcatcaggtgactaggcaagtttagaaaatattgccctgattagcatccgtcattgctgtgcacttcatgatggtctgatcattgcatgaggggcactgaatcaacggaacaactaacctcttccggcgactactaaatgaggacgagcttggaggagccatggcggcctgaagcgttgaaccctagttgtcatgggagaaggcgacagagcatggatttggggattttgtggctatccaagtggtactatagtttgaaggggctaactgcaaatatttctccacgcttcattgtggagggggctggctacaaaaatggatgcccacgtggaatgccacataggcggtcatccctggtcaaacgaggtttagaccggctatggctaattaaaccaagatgatggaccttgatgtgcaattttcaagtttatggaccatcaagtggtacccccctctcataagtttaagggcgggccatatattttattcgtatgagtaaattacacacaggggaaaggccaactccgtgtttaagtgccattaaaaagagaaactacattgaaaaaagcactacagaattcctgtctcttgccaaatcctccactcatgcacaactgtgcacacaccccagactcatggacgaggcgagattcctaattggcgcatacgcgccccgggcgcgcaattccggccctcggcccacgcggccaattaggaatctcgtgtaagccgcgtgccgcctcgaatctcgtgggcccttgacgttggtctctttgtacgcttcgtaattgatttttttacaagtggctttctttaaactaacgtaactaaatatgttagttaaggataatgatagtatttacggaattttttttggtagattttttttattaatagattgaaactttttaagttacatttgaaaacttttgacttaagatttaaactttgaagttaaattttaaaaactttcaactcatatttgaaaactttcaactcgagatttgaaatctttcaactttcatctcaagtttgaaaaaatttcaacttagatttgaaaacttttaacccagatttgaaaacttttaacttgagatttgaaaactttcaagtcgagatttgaaaactttcaactttcatctcaaatttgaaaaactttcaacttagatttgaaaactttcaacccagatttgaaaactttcaactcgagatttgaaaactttcaactcaaaattaaaaactttcaactcaaaatttaaaactttttaactcagatttgaaaactttcatgtcaatattttgacaactttcaaatcgtattttgaaaattttcaagtcaatatttgaaaacttttaactcaaaatttcaaaagcaattgtttttatttttattgagagattactgtagcatttcgctaattgccatgattagcgctgatcgttgggattagcgacgtagcgtcattttgtaaacgctacggacgaggaggccgcgtgcgcgcgacttaagatactcgcgcgtgcgcgcgagctagctatctcctggacgaggatccctggaaattccgtgcgttgcacaccttccaaattatgtggggaacgagaatcccacctgcatcaacatgtagggatattggtaggttatgctagacacaccaagtaaagtatcatgtatagttaccactcgacatgccaagcagtggatgaagattctgagcagaccgatccaacaaagcgtgtgtcaacgtagatggttagatagtgtttttatggatgatcgatggttcttaataattcctatatctcttttatttcagaacttatgggtgtgcttgtgatttgacagtgtatcctacctttgtagaggctaggagtgttctctgtgcagttgactcacctggactgttgtatccgtggagtattcggctcttcttttgtaaaagaaagaatattagtggttttcctctcgtagcctcagctgctgtatggcacaaagaattccctacaatttataaattaaaaaaccagcagttcggtttatatgcttccactgtggtccagttatagtttatcatttcagaaattcagcatctttcagaagcctactacgaaattgaccttttgccacaaaacaaattgttgcattattagagccaaattcatggcaatagctatgcattgccacaaatctaaagttatgagaaatgcccaggggttttccggctagctccacaaggtggtgcgatagacgacctgggttcaaagcctcacccctcctaattatttgatattaggtccttccctaatattgtagttttttttttcaaatctaaagttacagtagagttgctagctagccgtggtaacaaatcttaagctacgatagagttttcttgttgcaacgtttattttcatggtgctttctgatttatattgcaatgaattgctgaagtatcgccacaacgttatatcatggcaagaaagtcttatttattactacaaaaccaaaaattgtggtgaaagtataaactattgccacaactcatatgttgttgcaatatgttcgtggcaatagttaacttctcctgtagtgatccatgcaaccatggttcaggtggtcaaatctgaataaaaaaaaaacatatcacaagaaaacaatatatcctaccatatactaccccttactcaatttttaacagcttcttaatattactgaagctcctcaatgttactggcgcaaattatatcgcccctaataaagcagcaaatgtcaccttcaacgtaacacccttcttttgttcattgtgcgtgtcataaaaaataatccgccacaatttaaccagccaatcaagccacaatttttcatcaacaacggaaccgactcacggatataccattttaccatgaaggcctattttgccatggctcctactcccaccagagcctgtgcctttgctctctggcttaacaacaatccccattcggtgaagatgacccaaccacacaagcaggaaggctacgctgagctctgtttcgtgagaagcgcgcggcgtacatcagcaagtgaatttggttgacgttgccagaacaggagggttgatggtgccaggagtgttgaggatgatggctcaaagacaaccaggcagttcagggtgatacggtcaaatggcaaatcctgattcctcccaggccaaccagacaaccagtggctgatctgccttttaacatgtggtgtgttgttcatctctctttggttctgattttttttttatttatggaacatgtccagtgtttgatttatacatcatttgtattcaactctgttactgcagagtaatgcagcacctaccacctgtatatacgggacaataatggtctgatgggtgctggagatatatctcagtgcttatttacatggataattttcagctcggttaaaaagttcagacaatgaaatgtttatggcttattaagtactccttttgtgctcaatatgttaaagactcattaatgctctttctgatgttatgtagtagtaataagcacggaagcaaaacattattcaaaattcataatgcaagagctacttccaccttactagtcatacatattttctgaagtctgaattctcttcgagacaacatcaagtctacccatgccttttggtgattactactcgctccatgcatctcgtactggattagacatattccagtactataaatctggataggggcatgtccagatttgtagtacttgcgtatgtctaatccagtataaggttactatattttgtgatcaatgaagtacttggtagcaaccttgaaccgttacctggaatattaatatggtgccaaacatccatctttgagtgtatattcaaaaccaaatagcagttgatcaaccccaaagtgccatctgtttgtgtgtaaaagaaatataaaccaatcgatgtacacaattatgttttgggcaaaaaggatagatgttgtcgggatcaaactggattattgcagtggcctcgctaatcctattcattgttcgttcatggcgcgcatgtctctggccactggcaaggaacattaatttacgaataaacatcgagatcatatataggattggaagttacaagaatgcgaggactgcgcttgatgaattttccttaacataattcaatcaaggacctaataatgttgatttatagtgtaggagtacttttaagtcactccgggattgtttagatcgtccatttcatagatctaatgtttggtactcttattgattacctcctatgaggtaatagctcttaaaaaaagaccatctgtttttctgcattcgatatttacagcatggcgttctataaggtcagtactaagtgcaataatcttctcacatcctaaaatcccaattataatgtaccagtgtcttctaaggctggccgctaagttgagtgctgcaccttgcatgaatagaaagtacaatctggactcatatggaagtgtcagaaagaaaatggctcatgctaaatccatcctgacatacaaatagtctttcaaaattagcctcgatttttgcatagaaaaatgtcatgatgaatacatagtgattttctttatgggatagtgcgaggtatatttgggaacagagatagattcaagattgattcaagttggtgggcattggacaagtctcaactgtttatttttaaatttttattttgtggcaggtgtcccaactgataaattggtgaacaagtctcaggctctcagctggttgaagcagaacaacccagtaaaagttcagtttgacatatacacagcaggctaccagttttgtccagttcatcatgacaaatctgagaacatcactccatcaatataggtggtttaatctttaaaactaaaactagtaaggtagcccgcgcatacgcgtgggcatgttgtttaatcttgtttgaaattttattattatgaatgtttatgtgtggatgatatttttgaaatattttttactgtattttaaacatatgttcgttaataactgttgggcatattatttgaacctgtatatcctcaaatttattagaaaaaatatgtcacaataatggagttagttcatctatttatattgtgcgtgattctttttttaaaattattggagtttccaaactttatataacattttttgttttgtatgctatagatgactttaagtaatattttaattttattatatattaatgaaatatattttctattaaaaacatagctaatgacgctacttcatctaatcaaagatagacttatattacttatattccttccgtcacataaatcaaaggagttaaattttatcccaaaacaatagaagaatttatatgtaaccaagacagtgattttctaaatataccacgataatctccaaaataccttatcatattttgacaaatatctatattatagtgcatgttcgttcagtgcccggtttgttttccacacctattgtttctaatcacatgagacaccttcagtaatttggagaatacatatgtacatttaaattagtgttgtacatttggcatgtgtttttcacacctaaaatatgagtgaaattttatcataacattaattattacatgtcggctccatatttgtgatgtattttgggctatagatattagtagtttatttatttaaaggaatacaaccggatcacaaattggatatatgaaatttaaataattt

SEQ ID NO: 15160 - DNA, 19651 bp, Oryza sativa
  unsure (1)..(19651): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatcatcatcagattcatcaacatcagaacttgcattacgagcaataaaagctagatcaacaacttgcttacctttgctctcatcttcatcttctggttcatcaaaaacttttatgagttcttggattaaccaacgcatacaatgcttcttcttctccttttccttcatgttcttcttcttgttcacgtcatcatctttgactcttccatcatcttccttctttcctcgcccaagcttaggacaatgcgagcgaagatgatcaagtgctccacactcaaaacaacgattcggttctcctcttttcctgttcctaacatttttcatagctcgagaaaatttgttagataacaaaaccaagtcctcctcctcgaactgttcgagttaatcatcgggcatggcattaaataaagcaagaacagaagacttcgatgaagaagcaccaacatccaaagaagtcaaggaaaaaaccaaagcagtagacttagaatcaactttatgagaaagaatattcatctcatgagttttcaattttgtgtaaagcgaatctaaagtcaaagtagacatgttcacagactcctgaatagatgtaactttcatatcccaaatagacatgtgaagaccattcaaaaagtggcgagaaatctcagattgtggataattagcatcataagaagaatcaacagatctaagatcactcaagattttattaaaccgagaaagatagtcatccaaagcttctccaggtttcatctcaaatttaatatactcctttttgaaaagatcacgacgaagttctttaatattatttgttccttgatgaaaattactcaaagcaatccaaatctcatgagaagtttgaagatgagcaacacgatcataatccgaatgagagatcccactcaataaaagttaccctcgaaatcgacggaagtcggtctgaccgagattgatctgccagtctgaccgactggatgccaccggtctgaccagtgttgaatcttcggtctgaccgccaaagttgcctaccgcgcctgtgatgtgagcgtgtgcataatgaaaactgatgcaacaccccttgattataaagatgtcagtagaacttggtgctataactgttgcatatgcttcacttagaggaaagtatatgttgttgttcaactcattgaatttgatatgagttgattggttgatgactccaaactcccagacatgtaagtttaatcttgacctactactctgaagcgaagaaaaaattgatgactcccagagttgactcgttagctgattaattgattgcttcatcttgacataaagcttgctgaattttgagccatgtatttgtgtagcccccgactctttggttagttgggaaacaactgaacatagagtcaagaattatagcttcttgtcgtcgagtagtcattgcttgattgaaggtatgtgttgaagatgtccaagtagaaatcctgaatattggagagccacttgttgtagtaaaataacaaggcatcatatttggtgacgcatgccgagatgtcgaaactcttgtagtcatcgtggttggtgaagtagcaaagcttgcgaagcagaggcaatagagtttgccggtgccgaagacaatgaagatgaagtagctccaccatggtgacaaagttgtatagccatgatgacgtgaacaggagtcggcggcaacagaaacaaaccggtggcgaagatgcgcagtgatgaagataaaaacaccagtcggtagtagaagaaccagtcggcgtcagacaaggcgaccggcggtgaagacgatgacgtccatcagtaatagtagcggcataaaccagccgtagaggcgagggcaccaatcagcagcagacgagacgaccggcggaaacaccagtcggcggcggcggaagcaagcctatggtgtagatgacgtagacgcccaacaacggtgatgtgaccaaccaaccgtataggcgaagacaccagtcggtggcggatgaggcggccggtcggtgaagacaacgacgcccaataacggcggtgtgaccacccaaccctataggcgaggacaccactcggcggcggcaacggcaagccggtggtgatgttctgactgatccattcctagagcgtaagagataagcttaaagccatgaatcccttttatgcatatctggatctggatcctgcagaacaaatatataggatgagtagtatctgatataatactcgaggaaaattcaagtatttttaaaatgtttataaatatgtatttctcctcttgtcaattttgatttccccgagcggatgactccttatgtttaaacactctgcccgactagtcatagcccccatgcaccgggagtcggcctaagcacttcccaaacatgcatatgagtgacatgaattcgtcattaatggaacaaagtttcacgaatcagaatttactactcgggtacttccgcaattgttaagagcagaaaataaatttatcttatctctatgcttttgatttattccgaataatacttagcaccttgcgttactcggtccatccaacgagcccccagctgctaggaatcggcccaaaggcaactatccatcgataaaccaaacggaaagcataggaagatagaactccataactcgataggtacttttgtacttagattatatcgcaagcaatcaagataaatattataaaaattgtttagaaaatataatataacatctgtagcccccgactcactagtcaacggcgaaccagttgacatagtgaggcagaggaaaaggaaaatgtcatataaagaatgaaataaatgatgacttagctttgtaatattccccttggtgatgacagaggtggccaatgtgggaacaaagtcgtccatcaataacaatgaagacaccggtcggcggcaacgaaggcggttgacggtgaaagcgaagatgcccaccaacggcggcataataggtcagccgtgtaggcagagacaccagtcggtggcgatggaggcaggccgagggtgaagtcgtaaacgcccaacaacggcggcataataggccagccgtgtagacagagacaccagtcagcggcgacggaggcaagccagtcagtgaaaatgtagacgcccaacaacggtggtgtgaccatccaatccgtgtaggcgagggcaccagtcggcatcggcgaacgccaaccgtgaaggcaaagaaatcagtcagcaacaacaaaggtggccgacacgggtacatgcaaaatagatcaatcaacatatgaatctgtttagtaccacgaaatataaatataaatataagcaatgtatgtacatgcaaaacatgcaggcaagctcaattaattaatcaattgatgcatgatcctggcgaggtgtcctgttagttgaatcgtgcatgtcgatagatcaacacatgcatgtgaattgctcttggctgctggtgatcccgtgtgcaagctgtaggcggcgctgcctatagtcccacagtgcatcggggaacacgaggcattgggcagacgcatcgagatgatagccattggtcttgatctcggtcggcatgcaaaaacaggagagtaacacgaggttaatctgtagttagaaaacaatctaactgccgggaagacaaacccaatgaagtttcggcggtgaaggctgccgggagatgacaaagatgcccaacaatagcggcggcgtccaccaacaaccgtggaagcaaagacagcagccggcaaaggcgaaggcgttcggcggccaaacggtgctgcgcagctccctcttgttcgctgtgtgagtttcggcaagaacagacgctaggtgacgtgagtggggccagcgcgatcagcagcaccacagccagaacctatcgcccagcagtagatagcttgcttgatcttgatcgctatcccgtgcacgtgaacaaccaaagctccagcatgcatgcaaaataaacaacacagcttaactcatctgttagtgtacaaataaatattctgtatatagaaggatgaatgatgcacggcatgattatcagttaatccatgcacgcagattggatcagcacgccgtgtgcatgttttattcctggaaaacgacgatgtccgcatggctttcctagtgggcggagcgtttcgtcttgcgcggcggcagcttggccttttgtcaatcggactcagcagcacgcttgattcaaaacaccaattaatctgctgatgtgatccgtcaactggccggatcaatgatcggcccaaaaactcgacatggaagccgaggatgtttacatgcatgcaaagatacagactaaccattgtgattagtactaaaagataaaattatctgaatttgatagattagaacggctaaccagtcgtcgatgaggatcggagctatcaaatttgtcgggactaatttccttgccccgaagggaaaacggatatggtaactcctgagatttgttccatcacacttatcgacgaggaactcgacacgcccctacctggcgcgccaactgtcgaaacataaattcggcaataataaaaggggtagtgcacgagacctaaaagtggatggatgcggagacaagagatttagacaggttcaggccctctcaatgagaggtaataccctactcctatttagggatttcaatccgccaggtgtattataagatctgacgatctagttatgtcctgccccctaaagggcctcctgcccaccttatataggatggggaggcaggattataagatagaaaccttaaccgatacggtatcggttttctaaatctactttacaatcttatcaaaccagaactttaggccattctataatatacaggaaaacgtaatacccaagtcatgatccattacatattccatagttataagttatcccctataaccagtcggataatcatgctgtgtggatatggggtacctataatctccacaatgtgggagtgagttttgtatgtagtgttggtgcgttctacaacaaactgatgtttcattcaatgcatggctttattctaatggcctcaaaaatgccgagtggcaacagcatctacttcctgctctagaggagatgattttttttttcctttcaaacgccgggaaagatgaattaactgaagcacagtgataacgtagcctggtaagtgcattttccaggtatatcaaaccgacctgcgcaggttttcgataaatttaaaggaatctttgcaattttgcatcactgttgattaagcatggaactcagctgggttaatcagagttcattaccactgcaactcatcagtttatgtatccaacaattcggctatttggttcaaaagtatggaattcactcatgagtagatcagagttaatcaagtatgcagttgtagtgggtgggcattaaactccactgcaaaacttgagtcactccaagttatatactcccttcgtcccaaaatataagagattttaaatggatggaacacttcctaatagtacgtgtcccattcgtccaaaatctgatgtctcacctttttctccatgaaagataagatgagagaggccaagttctccatgaattttccccgtgtcgatgaaggaactttagtcaaatttattaagaacgagtgccataagagatgatgtagaaaaatgaatagttacaaggaccaatccagttgggttgatatcgaagggttgggaggcatctgaagttcttgcgttaccaaagctttgctcgattcttcgagatattttagataaaggattatcaaacctgacctctttacatttgtgggggtgtacacagctaaatattcgaacacgagtacataagactttcccttaaaggggtacaaactgcagcaactaacctctcccattacatgagagataacaacacaaaagtcttaagaacaacaaaagaaggaaaagactaggcttcaaatcttccaccaaagttccagtgatacaccgagaagaactccaatacacacttctccagcaacttgcaagagctcttaactgtttcttcatcgactcctttaagaagcaaagaccaagttcttgcccaatgcattcccacaaaaaagacctgcaagaaagatgtagaattggcaccattaaagaccacatctctgttcctacataaccaaattgtccaaagaaatacagctatgcccacaaagcattattctcttgagcctaggttcaagacacaatctagctgtcacgccccgaactagtcccgaccggaactagcccgtgacgctccaatttaacctgttaatcgataccagtcccaggaaacagtgctggtatcacagggagacagaatatcacagcaacagaggtctctttattatagagtagaggtacagtcatgttaggctgcggacagatcccgagctcacaactgcattacaaaagggaaacggaagccaggacttggaccaaacacacaggcgcgacttgggaactaggccgaaaccctaaaactcatcgtagccggcttgctcctggaagaactcctcatcagcaggatctgcttcatcttcttcagcaactgggggggatatttatatagagcaagggtgagtacgggagtactcagcaagccatgggaattaagtgtttaatgcaggcttcaaggaaaggctgttgttttcgcaatttattttatttaaactcttttctaaaaacaactaagtgagtgcttctcaaacgacacggatgagatagtgcgtctcgtccggtcggagtatgtgcaatgtatcagtctttagaattaaaacaaggttggcacccggccaacagcttttcaaacggccacccgggccaacaacttttcaaacagccacccgggcctacaacttttcaaacagccacccgggcctagctaatcccaacagctgcagatttttcaaacatcgaaccccttttcacaacagcaatttcacaagcagtagtcaaacaaaactacgctaggaatcacctcacatccgcccatgaccatgggcacggctgttcgaacagtttgttaacctctgcagagggggtacactttacccacacgacattactaacccgggtcacccaacctgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccagaggtgtcccattccacccatgtggtcgtacttgtcttatgtttggatgaaattccaaggaaatcggtccttaagtgcaagagcgggaaaccgtacacccgatacgttccccggtccgtggttttggaaattcatttagttcgtaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaagtccgccaatctgtcttgcagacgggacaaaagattaagtgcgatcctatcaatgcataatatttttcaagcaacataattaaatttcaaatataggctcaagatgttcaaaggtggcttgccttgctcgagatctagagcttgatcctcgaaatcctcgcactgcgggtcttcgggctccgaaactacacgcgaaacgggacaactcaacaaacggcgaaaataaagccctattaatgacctctgagcatgccattagatagatctcgagatttgaggaattttggaagttgaacggagtcaaacggatttatggttgggaagatattgaatttctaagattattggatttttgatctaaaggaaaaaggatttaattaaatcctttttgaaaaagaaaagaaaagaaaagagggaggggaaatagacttttcctcgggcggctagggcgcggcccgagagaaaggacggcttggccgagcttaatgggccggccggcccaaggaggcggcccaagtgcgcgcgcgcgggaggggaggagagagagggccggtggaccgggctcaccgtgcgcggtcccggggtggacccgcttgtcagcggctcggctcaccgtgcggagggaacacgcgatgcatgcgcgcgggcgggggagggacgcggtgcatgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgcgggccggcgggaggtagacgacgacgccggccggaacggacggcggacaacagcggcgagcggcggagcgaaccacggcgataccggcgaaagcgagcacaccgggtagttgcacgagacgaggggagacgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcgaattgggcggaactacgccgagcgaggccggcgacgggcgggtgctacggagctcgggcggcgacagcggcgagcacacggcgagcaacggcaacggtccgggcggcgccggctaactatggggaggctactcaagctactaccgaaagctagggggaggagatggagcgaggaggaagaacggagagaggcatcaccgagaagaggaggggcgctgtgacgagaggccgacggcgcgggagtaatctctccggcctcgggccggggaagaggaaggagacgagtgcccggagtccccttccacgtccacgaacgcaccggctctcccggcgcttggcgatggacggcggaggcgagacagagcacgggagcggcggcaatggcgagggggtgaatgggagaggaaaggaagggagggggaggctgggggtttaaaggggcggcaatgtcggtttgggaaccgacttagggcggtcaagggcgcgagctggcgctcggcggtcgcggccaaagcggcgacagagaggatgacgccggcgaggaaaaaaaaggggaaaaggagggagaaaaaggggcttgcccctttgcccgattcgggaaaaaggaggggggagcgggccaacgcggcacagggaggagggatcctgcctccgtcccttggcggcttgcgcgcggagtgacggggtccgggcggtacggacgcgagcggtttggaccggcgcgacgacacgggcgacaggcgcgggcaggcgctgccgatgtcggcaaccagacggtcgcccactcggcatgcgcgcgcgggaaataacggccggcgtccgcgcgggcgcgcgcacgcgaacacggcgcgcgggaagcggctttgcgagcggggagctcgcgcgaggggagggggggcgctcggcgtgggcgactcccgcgcacgcgcgcgcggcgtgcgggcagagcggagggggagcggagagagagacgctcggcgcggctctcgcatgctcgagcatcgtgcgggcgaggctgagcggggctgagcggggggagagcgcgccggagaggggagggagcgagagagagagagagagagagagcgcgcccgggagagagaggagagggccgggggagagggggagatgggccgagcgagattcggcccatcgacctcgggggaggcaaaatagacttttgcggaggaattgattttggaaggatttggattcagaattgaactcgacgatagatcggggattgagatcttgagatggcacggacactagacaacaagcaaggaaacaaatttcgcaaatagggtttttaagagataattttcccgctaggcgccacgacggaacgggcgctacactagccaattcccaaacatttgagacatgttgtaagtttgtctaatcccaaatgtaaaaaggagagcattgtctaccaaatgaggaactacttcatttagagtctcaaggtctcacgccctaccgatgagaatggcaagcatatctgcgcccgatgcttcgagataacagtagtgttcttttcttgtcatgtattcgataatcacgtctcatggcaactgacaatggcagctactgaccgtaccatcaaactgtaattagttgaaaggaagtctattggtgttgttgatgaccattcactactataaaacatcaaataggtatcgccactataagtgccggaagtactaaaatcggcacctataggcattttcccaccttcgcgggttgaaatcgaaaaaaccggcacctttaagcaattacaggtgtcggttctaaataaaaaccgacacctattctatatgtatcggttttttaaaaaaaacagaacctttaatattaaaaacaggcacaggttttcttaaaaaaacggcacctacgaattgagccgaaccggtgggccccaccacgacgcgtggaggaaggtccgctcggcgctcgcacgaggagataaggtcttcgaactctctcgtctcatctcgatctctcttgttctctccgctttctctcgcgacaccctccaaacctctctctctctctctctctcatagcggcctggcggaggtagtggcggccgcggcgcctcccctccgacagatctggccaggagcggcgacccggtaggaggggaggcgggggcagcggcggggggggggggtggcgggagggaaggcgacagccggcgggaggggactcggcgatggctcatgtgttcttgtgtgttttgtggttttgtgtgctcatgtgttcttgtgtatgacttgtgtgttcatctcgtgttcttgatgtgttcttaatgtttatttttcgtgtgaaattgcttcatgcatcggctcaattcaaaccgatccatcgagctagctgtttttttttttgcgttcctgaggcctcaaaggtgccggtttgaaccggcaccgatgactttcagtcatcggtgccacctccgtggtgccggtttgcctaacgttggttcccaattaccggcactgattagcttctctgtagtagtgattcagtagattcttggaacatatgctggtaatcaacagtatcaggtgttgacatttgcaaaaaaaaaaattcttataatattttcatcattttttttgacggaaaacagcaggagaggataataatttcatcatcgacagcatagttcgaactgacgacgacaaaattaaatgccaacctcggcatgctcatgcatctccttgccagtatgactgaactgcagacactccttgcacactggcgctgaatttgttgcagggaattagctgacagtactatgtacatccacccgtagccttcatggtagaagccagatctagaagctgaagtcaatgacataaatgagaatttggcaccaaattttcctgataattttaacatactggtagttaatttctcgcacatttactactacataaatcattttaccatgtggccgaaagtgatatttgcatgtgggcccacctgcgttaaaagatctatgaaaattggatttgtgcatgtggctagcgcatccgcatgtgcatgcagtaatttataccgtcctcgtgcaaaataatttcggtgaaaaacaaaaaccaaatcggccgaaccgtaccctgccactggccgaaccctagcccaccctccgccgctggtcatcgtagtagtggcgccgctgccacccaccatcgtcatcgggcctctgaggcccccccgcccccgctctctcccgatgtttccgcctcagccgccggagtgggaaggggagaggaacaaaggagagggagtagaagaggaagagaagagaagagaaggagttggagtggataagaagagagagaggaaaggtttggtggagaggtgtaggagagaaaaggtgcagtaactattgtgtgaggcccatttgctctccgctttgcccacataatatggtctcttaagaggcctgtctaggaaaataagtctatttttacatgctggcctcttaagaggccacgtgcaaaaatacattatcacatataacccataaacctttttctgaaaaatgatttttgtaggcacgaccagttacagtccgcctgcaacctacagggatactcataaaaaaaatgtttctatagtagagattcgtgtctagtaggtcatattcgaatctaccatgcacatgctacctggttcaatggttggttggtgcattctattgatgagctagctgaagatttagttagacgtagttgcaattttgcatagtacagtgatttgaataactctgcacagaaagagatcctactgtccttttttatggataaaatacgacacaagcaagcccaactgtgctacagcctacaagcggaagcggaagggaagagatgatcgaactcctagaatagattatctcttgagaggtaatttttttttaaaaaaaacacagtgcaaacgaagtcgccacatgtctaggatttgaactcgggtgggctggttccaccacaaggaacctaaccagttgagctattctcacttcgcctcttaagaggtagttggtggtgcaccttaacacaactcataaataaaagctcgtaggaaattatataggctgataagacggggaacaatacttcatatgcatatatatatatatatatatatatatatatatagccagatcggttatgcagatcaggaaactccggaaatgcgacaggacacattgcacgtaggcataggaggcatcaggagttgtccttctttcgatccttcatcgccaaggccttagcgatggaattgtcgaaactgcggtatgcagaggagcactcgacgccggtcagacggtccttgacagtttccttctcgttgctaaacttacagtaagcttggctgcttgctgagaatatgctgatgactccatgggacgagaatgtgccatccgtgttcatcgccgtcacgtttaaccaactgctgtcgcttctccgggcactgcctcagcaaggaatagttcagggaggcctgcacactcagcaatccagtttgacctcagtatcttcttcttaagaatgatcctgtgcatggattagtttatcgtttgtatatacatacacagttcctggatggttctgaccgtattctatttcattggaaatcaagaaaactctcaattttgtgctgcttcgtagattagctagctcctaattaaggcttgaacattcaactgatgagatgaacagtttcctattgaagtggtgaattcgactattgtggtaaatttctggtagatgaggtgcatgtgttaactgaaccgcaccctttatgtcttacaactattgcaggagtcatacatgatacacagtgcactactgtttagtgctgaaattttcagttatatcagataattaattaatattgtcccatcttcctaaaggtcgacatgatttggtgtgaattaacggctctggatcaagttaccagatattcatcaacttttccttgtttctcaaccaaacttttcaatcgaattgaacattatatgatcaagcgctgagatatatccagtcccccatcgatgataattggcccatatatacaggtggtaggtgctgcattgaactgcaatgacagagttgagtaatatttcaatcgactgaaatgctgtgatcgagcaaaaaactcttacaggctgacagaaatgcaccgcatttcaagaacagagggcatgcagaccaggccattgccactcactgtgcagctcgggttgctttgcgatgcatatgcttttgtttggcctaggaggcatcaggagtagtcttttcactggtgtgccatcagagtggaaatgggcgtatatgtgcagcggatcgctcaccgcagatgggatgttgttgttgcattaccatgagtaagctgaaatcgttgccatgcagtggccggcgacaacggtggcaggcatatcaatggagtaactatgtgacaggcacaaattaactgtcctccttctgtataatgtcttgtgtgtatgcaaatcgtgtagtttgttagtctttaactcctctgagcagttgttcagattcaaggtgatatatgtttgtttaggacctgcgcttactgatcgagccagcacaattgaggaacaatagtaacattcggaagatgctagaaattgaggaacttcgttatattcaaatgatgctaaaaagtgggggtagattaatattttcttgtgatatactgatatttaatctttcagatttgaccacctaaactgatctcaattctgatggcgtgatggtttcaaatatttcccaaatgatgaactggacaaaaagtggtagccctgtggtcctgatgtgtgcagtcaaactgaactgcaggttttgcataaattgcaggcaatcaaatactgcagccatgttgagattatgacaatagctccagtgctacaaaggctaaaggggaaaactctttttcccttgccaaaaggagagatgaacaggccagttacttcattcaatggaaccgatcagtattgtagtgatgagacaggtgcagaggtgcatattggattcagcggcacaacttgaattactgcatcgatacagattttgcatctatatggattaattttatagtccacgagaagataccgggtgataccacatattatattatagtgtaaaatttgatcacctcagacaccaataggtgttaaaatttacattaaaaatttggtacttctcggtaccttaccaggacaatgaaaagtctcattcatatatattttcatccatgctgcccgttttgttccatatatagaatgatagagatgatcagtcagctcccaacttctatactacaagcctacagagagaatgaagtgttttgttgaagatcggtcttgtgaccctgcctcaagtgggttgctataataggcctgggaagaatcagaatgtccggaatttcccgtgttacgtagttcctccacttggctagtaagatagaaccaaggactaatttattttttctgtgtactcgagaatttcactttgcatggcggcatccatctactgacagtaacagccagtcaagttgtataggccataagttcttccggtgctgttgaactggttgtatgtgatgcttcccaggcgcctagtttggcatgctgaaaataaagacggtagtttggcatgattttacgttttgatattttcagaatatatagatatagtatagtttgatcttatctgtttatgacaatctaggcatgctcagacaactcttgtgtgatatatacccttcaaaaatccaggattttcttagcgggcacaaaccggtaatggatggctattgatgaatcttaaacatactgcacagacaacgccagttaattagccatcaacactccttcgtcttaattttaactgagcttaaaattatatgagtaattaactactgagatatctcaccccatctgatcaccggcccttatatacaggtggtaggtgttgcattccactcatcttctgcaatgacacggttgaataatttacatcgaatgaaaagttgtacaaatcaaagaccagatgaaggtgcaagacagcacatgtcatacaaaaatattttcttccagactgatcgggctacgctagggtgtaggcgtgcagcggggtgctttgacgcatggatgcttggtttaggaggcatcaggagttgacattacacatatagatccacacgctgtcaccatgacagtcgacatagtagatatgcggtgaagatatcgtcgccgccgcttggtgggggctaataattcagcttgccttaagcactcaaggatggtgtgcatgtcctcattgttgtcacgggattggtgaaactgagtcaaggctactaggtcggatgaatcttggtgtcctcaaccctcctgctgtgggcctgtggcaaccgaaaccaattggtggtggtgtgtcaggctagtggcgaattgtgctttccttacatcttttaattactgagctagaagagttgaaaacttcataacatttagaagatactaaaaattgaggaacttcattatatgaccatcatgaagataaaaatataagaacctcactgaaattcagaatttcaggtgatgctataaattgagtcaggagttaatattttggatggacattttttatggtatttcctttttcagattaaaccacctaaactgatggagtgatggtctcaagtaagtctgacatgatgaattggacaaaactggtagcctgctgtgtatatgtcaaactgaaatgttcntaaggtgttcttcttcaagcagttgatgttggaattaatgaatgggccttagcccactcgatattaattctttgaaaatcacaaaagcccacctcatgcgatggcatgcatgtggagtttagtaccaccttgcttattctagaagagggggacctccttaaaagggaggatgccttcctagccacttgaagcatgtgtggtggagagaagaggggaaacacacgcgccctgttcgttcgcgacggctcgccttcttcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttatgggatgcactgaatactaaattcggtgctactgatgctagcaatgatctgtatatcatggagcagtttcatgactacaaaatggctgacaaccattctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggagaaatacaaagctcagcagaccaccaacttcaagaagcagaagaagaacaacaacaatcctaatcaggatgagaggacttgctttgtgtgtggccaagttggtcatctggctaggaagtgtccacaccgcaaggggatgaaggcacctgcagggcagacttctaagtctgctaatgtgaccattggcaacactggagatggaagcgggtatggtaatttacctactgttttttcagttaatcaatctactaattggtaggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacatgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtatgtgaaccatatttgtggcagtgtggatgatgaggctaatgtttggcattcacgtttatgtcatattaattttggcttgatgtctcggctttccagcatgtgtttaattcctaagtttttcattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtcccggacatgcatgttggtacaattatggagtctcgtgatgctaccttccttgagagctttttcccaatgaaaaatacccatagtggttcg

SEQ ID NO: 15161 - DNA, 18795 bp, Oryza sativa
acagtagttcatcacaaaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgaaggagttattttgtgcttgtatgttgacgacatactgatatttgggacaaaccttcaggtgataaatgaggttaaatcattcttgtctcaaaattttgatatgaaagatttgggagtagctgatgttatcttaaacattaagctaattagaggtgagaatgggattaatctcttgcagtcccattatgtggagaagatcttgaatcgctttggctacattgatagtaagccttctccaacaccttatgatcctagcttgttgcttcgcaagaacaagagaattgctaggaatcaactggaatactctcaaatcattggctcgttgatgtacctggctagtgcaactaggcctgatatctcctttgctgtgagcaagttgagccgatttacttctaatccgggagatgatcactggcgtgcgcttgagcgagtaatacgctatctgaaaagtactgtggaattggggcttcactatactgggtatcctgcggtactggagggtcatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatcagcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgtagtagagatcgtgcgggcgccctgatcaagcgacccttctctatataaaccgacccgccgtcttcacgcaatatttgcgagatcaatctagggtttgtctcctactctgtactgcgccgtcgctcgtagactactccatcccgctcgccggcgtgcaccggcgatcgggagagcaggtctccggaacctctgtcttcgacgttctgcaccgggagaaggcggcaataaggtttttgggaagcgcttcgcgcgactgctccctgctcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagttgagacctatttaccaatttatcagttgggacgcctggcaaaaaaaaataaaaataaaaactaaacatttgagacttgcttactgcccaccaacttgaatctatctttgtgccaaaattttgaaagagtacttgtatgtcaagattgtttttagcacgagtctttttctttctgacacttcattgtatagtttccaaacatgtaaggtacagcacacaacttaccagccagcctctgaatacattggtacattataattggaattttaggacgtggcaagtgagattatttcccttattacttaccttatagaatgccatgctataaatattaaatgcagagaaatatttgtttcttttttaagatctattacctcatagtttcatggctgatattctgattttaaattttggaattttggatttttggtcccctggcaggacactctttcaccccaatatttattttttttaatatatagaaaaatgtattatacttcaggtaaaaatgttaaaatttcaattttttccagccaaaatattctgaaatttctccaattgggatcaatcttccagacccaccctcccccccccctaagctttgcataatatagaacacaacctaccgtacaaagtcaaactgaaaaccttggtgttgtataaaagttacaggaattcaaggtactgcatccatatgtcagattttttgaaggctcagagggaaaacactaatactttataaattgtgccaaaaggaaataattgacaacaacccagctacttggtcaaagatatgtgcattgcactgttgagtgttgaatatatagttgattaatcctggagttttaggtgcacattgaactcagctacagaacttaaatagctgcactggtatcagattttgcatttatatatgatatcattttgcccatcttcgtccataaaagatagagatgatcagtgattccaaacatgcgtgcggataaagagaaatgaacagttttagtgaggactggcgcggtctccaaatggttgctatgctaggcctgggaagcatcggaatctcgagtgttacaacagctcacttgttaacttgaaggactgtgtactgatgagtttctttctgttctgtactcaagaatttcattttgtttagtggcaaccatcattcgaccctagtagccagtcaactcacataggccgtaacgttcaccattattgctatatggctgtagagatgaacttccattagatcaagaacgtgctgaagaatgaacctacggttttgcacaaatcgacttttatttctacatttccagattagacaacacattcttatcttagtttgttttattaaaatctaggcatgctcaacttttgttgagtgaaatgataaaatgaagagcagtggcagccagcagcctgctagctgcacgtccaaaactaagctgctggtccctccatccaccggcgaggcggcggtcttcaccaaaagcttcgttcacaccatcccaagaacatattgcctgctacataacactggaaaatgaataggtttagcaaggccatgctaataatctagtttcatcccaacttctatcctaccatgcccaaaacataattgtgtacattgattaattagtttacatttgttatatacaacagatggctcttttgagtttatcatctgctttttgattttgacatacactcaaagatggcaaattagttttctaaataactgttcagagtcgctacctaaaagtattaatcacctaaaaggcatgaccttgaagttctctctctctctcttgcaaattcagatttcagaaattaccgatgactagtaaggtgaaagtatttcttgcattataaattctgaataatgttttgcttcagtacttgttactacttacaattaataatagaaagaacattaatgggtgttcaacaaactgtacggagacagatatattagtgagccatcgacatttgtttatctaaaccttttaactgaactgaaattttccgagtaattaagcactgacatatcttcaggacataactattggctcatatatataggtggtaggtgctacttctgcattccactgtagtgacatataaaatgatgtataaataaaatagaatcagatgaaggaccaaaagagagatgaactacaccgcatgcatagagacagatcagggacactgagattcaggttggcctcggaggtatcaggatttgccatttcaccatcaccacccttactagtagcccttcttgatgatcggtccgtacatacaaggcttcttcatcttcttcatttgtttcctcattttctaattcgacatcagttgtgggtggcggttgctcgtcgggttgatcgtagtcttcttcatcaacgatattctccattccaacaatatttagcttgcctacgaatacaacatgatgtggtctggcagatttcgcaagtgatgggtccttgacatataatatctgcttaaaggatttcgcgagcatgaacggctcatctttgtagccaacatcattcaggtcaacgatgatcatcccgtgcttatcaaccttcaaccctcttggaattcttacccacttgcatcggagtagagggactttgaggactctgtaatctagctcccaaattgactctatgaaaccgtaataagtctgcttcttgccatcatcatcataggtgtcaatgctacgccactgttttgatttgtacttttgttgtcctgggccttggtgtcgtaaaaagtatacccgttcatgtcagccttggtacgtgtggattatgttggatggcccccgagataaagagaacagttggtcactatcgatgtctgcagttgtcaggtactccatcaaccatttcccaaattgaagtttatgcttcttcacaagccatgcctcggattcctaggattgtctctgcagatttcatccaagtgcatgtccacgtatggagccaccaaagccgattgccgtaacactgcaaaatgggcttgtcttatgttttgtcgattggggttgacaattctcttgtggcctaatgttctttttccaaacatcctaccctagtgacggtgcacaattacaccaataggttgcagatccatgtaatctatacataattcaaccataaccattgacgatgctgtttttttaaaatatctattacctcatactttcatggctgatattttgattttaaaatttgggaaatttgggatttttggtccactggcaggacatctttcaccccgatatttatttttaatatagaaaaagtattctactttaggtaaaaacgttaaattttcaattttttccagccaaaatattctgaaatttctccaattggaatcaatcttccacacccaccgtcctcccctcttaagcttttcgtaatatagaacccaacctaccgtgcaagtcaaactgaagtgcttggttttgcatacaagttacaggaattcaaggtaatgcatccatatgtcagattttttttgaaggcttggagggaaaacactaatattttttaaattgtgccaaaaggaaataattgtcaacaacccagcaacttggtcaaaggtatgtgcattgaactattgggtgttgaatatatagttgatatcatggagttttgggtgcacattgaactcagctacagaacttaaatacctgcactggtatcagatttcgcatttatatatgatatcatttagcccatcttggtctataaaagatagagatgatcagtgatcccaaacatgcgtgcggataaagagaaatgaagagttttagtgagcattggcccggtctccaaatggtttgctacgctcggcctgggatgcatcggaagctcaagtgttacaacagctcacttgttaacttgaaggattgtgtaccgatgagtttctttttctgttctgtactcaagaatttcattttgtttagtggcaaccatcattcgaccctagcagccagtcaactcacataggctgtaacgttcaccattattgctatatggctgtcgatgaacttccaatagatcaagaacatgctgaagaatgatccaacagtttgccacagattgacctttattttgatattttcagattagacaacagattctgatcttagatttttttttttatcaaaatctaggcatcctcaacatctgttgagtgaaatgataaaatgaagagcagtggcagcgagcagcctgctagctgcacgtccaactgagctgctagtccgtccatccaccggcgaggcagtgaccttcaccacaagcttcgtccacaccatccaaaaacatgttgccagagccggcaaaatccctctctgatggccactgctacaaaacacaggcagatgaataggttttgagaggccatcgtaataatccagtttgatcacaacaaaatctatcctatcatgcccaaaacataactgcgtacgtcgattagtttatatttattatctacaacagatggctctttggagtttataatctgctgtttgattttgaacatacactcagatagaaatttggtaccaaattaagttttgaaataactgtttagagtcgctacctagtagtaatcaccaaaaaggcttgggcataccatgaagctctctctcttgcaaattcagacttcagaaattacccttgactagtaaggtgaaagaatttcttgcactacaaattctggataatattttgcttccgtaattattactacttacaattaataattagaaataacattaatgggtctttaacatactgtgaagacaaccaggagcggacccaagtctcgagccacctgggccgtggcccgaggcctagtactggaggcccaaggggatagtttattttccaccatgtattaatcatgttgggccatattctccatgggctggcctgagccttgggccagtcttgggtccgtccctaaagacgatgatatagttaatgagccatcgatatttgtttgtcttaactttttaagtgaactaaaactatccgagtaattaagcactgaaatatcttcaggacaaaaccattggcccatatatacaggtggtaggtggctgctacttctgcattccactgtagtgaccgataaaatgatgtataaataaaacaaatcagatgaaagatcaaagagagatgaactacactgcatacatagaggcatacagggacactgattcagcttggcctaggaggtatcaggatttgccatttcacaaccaccaccctgacctacccggtccagacgtacgcatgcagttgatcagtcaccacaggtgctactgtccttgaccagggctcaagcttaaccctcctgcaaggcgtcctcaaacctcctgttgtggcaatgaaaaccaaataccgatggtgtgttcgactaccaccatattgccatgctgacgccacctctcatgaaaccaagctctgtctagtatttataattgtgtggcgggttcaccatagctggccggggaatcgtgttacgccggtggtcaggcacaggttaccggggataggagcaatgactaagtagccccgtgtggcaaatgacagatccgtcagtcggcgccgttgttgaggtgaagttcagaagttgtagaaaattgagtaaggtggtaatattttgtacagtggcaaccatcattcgaccctagtagccagtcaactcacacgagccgtaacatttaccattattgctctatggctgtagatgaacttccattagatcaagaacatgctgaagaatgatccaacagtttgccacgaatcgactttcatttcaatatttccagattagacagcacattctgatcttagataaattttttttatcaaaatctaggcatgcgcaacatctgttgtgtgaatgataaaatgaagagcagtggcagtcaacagcctttgctagctacacgtccaactgagctgctgatccctcaccaaaagatttgtccacacaatccaaaaacatattgccggcgccagcaagtcccctctctgatggtcactggtacataacacaggcaaatgaatatgtttggcgacgccaccgtaatactcaagtttgatcctaacgacatctatccgaacctatcatgaccaaaacataattgtgtacatcgattagtttatatttatcctatctttctataaagttaaggcccactacatcgtaaagctcaacatacaaagatgccacatcatccactaacatttactatatctcaaatctcatgcaagcatgctaatttattaagttttagagttttaaaatgcaagcattaattaaattatcatcccacgtaatctatctatctattatatactaaaagtccattaaacttcctacaaacgctctcaagttaccacatgacactctaataaattagagaaaatcctgtaaattctaagaaaaaagcaaaacatctacctcttgattttcacttaaattggtgggtccaatattatacaccgttagataaaattgatcctaaaataaaccaaatactatgggtcccacctaactcacgtacgtacatgggtatgcagtacgtacgcctccttccaattattttcgtatgtagtatgtacgcctccctccaattatttcttcctttttctctcttcttttttccatttatataattgatatatatattttaaataaacataatttacaaacaaagaatataccatcatataattctttataaacacagttaactaaattagctctacaatctttgaaaataaaatttacaccattatatgtttacccattaaatcaatataatttccaattaaaccagtgtactcattattatttgtactatttttttcaaataatacactattttaaaataaagtttacacaattataatgtgtacttatcaaataaataatttaagatctatattaactaattatacgtgcacttaaacagatggacccattatttaaatcatggtatctattttttttattaatttagactattattctcaaataatgtactattttaaaataaattctacaccatcatattgtgtacccattaaattaacaatttaaaatatatattaactaatttacatttacactagaaccggtggacccattatttaaatcaacagatctattgttaataactaaagtgtccaaagttctctttttggtccgctgcacaatgcacgtctacacctttgcctttcgcacgtgtgacaaagtatcgtgtctgaggcatcttaggtgatcacgatcgctgcaacgctaccgcttttgttaataaaaaatcttaagccaccacatatatatcaactgttaaagatttttagaatgagaaaacaacgagttctcacctacattatttagaaacattagaaaaacaatgtcccctccacctccctctccaatcacatgtgcataacactgttacactgccaacccatctctggctcgagttgtatgctattcattcctctccaatctcctccctattttcagcataatattaacacatattaatagaattcgtactaggataagagtaataagggagttttaaggccctatttttttattgattccatcttttgcattttcgtttgcacgctccacgctttttcaagtttataaatggtgcttttcttaaacgactttttaactatttagaagttaattcatttgtttataatctcaaatagctatcacataaatcagataattcatcaatttcagttgtcctaaaccctaagtagtacatatttttttcgtacgaatcatggtgatcaacgaataatcaaagtggtaacatgaatcttaagagctactatgaacaattgcaaatatgtgtcaaaattatttgctattaattagacatctaatggtttgctagcaacatatttaatttctctctacatgtatataaacatagacaaagctagaatgaatattaacatatatcccatacatatatattacatgttaatattctcattacatgtggtaagtccattaaaatttcaaataccctcaagctaccacttggtgctctaataaattagagaaaatattagaaattctaagaaaaaaagcaaattatctattacttgattttcacttaaatcggtgggttcaatattataaaccattagattaaattgatcttagaagaaactaaatactacaaggtcccacctctccaccttcgatacgcacctacgtacgcgtgggtacgtatgcttcccctcccttttatcatttttccctttcttcttttcttcatgtatacgcttctctctctttcttactatatcatgcgccttcatgagacgatttaatcacaagaattttgagtatcttgctctcacatttttaatttgtagccatactataagcaatatatagtttattatttactcaagaaaataacatgattcaaaagtcgtaagtacttaatccatctcctacttaaaagtttgtgaatggatttttaagataccttaagaaaaatagaaaccttaaattattataaaataacattatccgaactttagttttcccttaatctatgagacaaaatctttgaacaaacaataaaaatcttacctttcaataatataagtgcccgcgcatacgcgcgggccatcttcctagttcacataatatttcaatatatctctacatcactttttataatatcctatacacctatatagttcatcctcatttaaattttagagcttaaaaaatccaagcattttaaatcatcattacacataattctcaaaatatttcaatatatctcaccatcattttatataatatctatatacctatacaatttattcccatttagttaattttatttctcttctctctcattaagccatatcacctcaattatttctaacccttaaatgattaatctatgggtggaattatctccctcattttcttctctcataaagccacatcatattacttttaaatttggctcatcattctatatactatttaaattatgataaatcacatgaacttatgtaagtttctatcatctagctatcttacacattatttatatttattattatcataccaaactcccgcagcaacgtgcggggtttcacctagttatatacaacagagatggctctttggagtttatcatctactatttgattttgaacatacactcaaagatggaaatttggcaccaaattaatttttcaaataactgttcagagtagctacctagtagtaatcaccaaaaatgcatggtaagaccttgaagttctctcattttcaaatgcagacttcagaaattaccgatgactagtaaggtgaaagcaactcttgcattataaattctgaattatgttttgcttcctacttattacgactaaaaattaagagatttgctccggtccagcaaaaagtatctcgagctaccggtatctcatggtaccaaatcatttccgatcgtcggatctatctgggcaggattggtattgttagatgcaacgatcgaaaacgatttggtaccgtaacgtaccggtaccttgagctactttttgttggaccggagcaaatcttaaaaattaatatcagaaagaacattaatgggtctttaacatactgtgcagacgatgatatatatagttaatgagccatcaacatatatatatatatatatatatatatatatatatatatatatatatctgggtgtacgtactcctgcttgtatcagccgtccatctgtgcacccccgatcgagttatcgaatccacctatgacctatcggacccgttttcatttttgtggagaaaagaataatcctagtaaatctgcaattatcccacagggatcggaactatctcttttaaaactctgttgtttaccaaactaaaccacaaatcgataaatcggatctgagggcgaggtcgcaatctacgggagattctggggcgacggcacaatcaatcggcgactcgacgtcctcggcggcgattcgctgccgtacgtccacaacgtggatccgtcgactaccatccacggtgcagtccatcagcaagccggagtcgacgatgagatcgacgacaactcggtgtcaacggaggcgaagagttcaacgtccacggcgaagctgcgatccgtcgcgacagcccatctgcaagccgaaggcgacggcgccatctccatccgcacgaagaaagcgaatcccctccaaccgaagatcagggcagcctgcctacccaacgaatgccaggagttgcctggtagatacgggcagttctgttctttctgattatctgatatgttttgagattatcgatctggttgccgcatacatataccaccatctcttcttaactacacactccattgaatctcttcttaattatactaaagtaagagatcgtattatgtcaggcaataagaaaatcgttccaaaattcagtatgtttcttttcattcttgctcatcgtattgcatgcttgcagcaactgctatccagttctttacgtctaagctgaaataaatccatgttagaaccaggtgcataggacgctgccaaaaaaacactggcaatctcatgcatacgtacgttctggtcttctgaaattaaactagaatcacctttttgttttgtttttttttcgacgaaactggaatcacttggttctgaattttgtgaacacggctgatatacctctgtatctcctttttttttcaatgtatggactacttctgaagtcagcagtgtaccacttctgtgaaaagcatatgctacttccaattttccaaattcatgcatatttcaggaaaggacccatgcaacatttttagtcacgccacagcatgcatgcatgtatcggccaagcctcaaggatgtactgctgcttaaaaaaatagtatgtattccaaaaggtagcatatacttctctataataaaaatgatagtatatactaatataaagtagtatatacttctctttaaaataaagaagtatgtggcagcacatacttctctacgtaaaaaagtagtagaaaagaagtatatggcagcatgtacttctctaggtaaaaaaaacaagtgtgtggctgtggcagcatatacttctctacgtaaaaaaacaagtatgtggctgtggcagcatatacttctctatgtaaaaagcaggtatgtggcatatgtacgtatctagctaattaaaagaagcagcacgaacctcttaaaaatgcagtatatgcttataatcctcgtgattaactattaatattaatcatgaatatactagttggaaagaaaagaagtatgtactaacatactacttttaaaaagtacatacttatactgcaaaacaagtatatatacttctacaacaagtagctaagtatatacttttaatgagaaaaaaaggtatatacttccaacgagctaccattaaattttttgaacctagtcgtacgtacgcaccggccggtgcatgcagataatttgaaaaaaaaacaggaatggtgttttctttttttatctaattattcattatgaactaatggatatccattaagaagagggagtacatacacctgggagtataaaagagagatcctatatatatatatatatatatatagacacacacacaggtggaaggtgctgcttctgcattccactttagtgacagataaaatgatgtataaataaaaacaatatgagatgaaggaccaaagagagatgaactacaacacatgcatagaggcagatcagggacactgattcaggttggcctaggaggtatcaagatttgccatttcaccactacaaccctgaccttccgggtccgaacatacacatgcagtttgtcaatcatctaacgtgcaattgtcctttaccagggctcaagctcaaccctactggcatcctcaaacctcctattgtggcaacgaaaaccaaatgctgatggcatgtccaactaccagctagcgtattgccatgttgacgccgcctctcatgaaaccaagatctgcatagtgttcctgcgtgtgtggcgggttcaccatagctggacggctaattgtgttaagccggcgggcaggtacaacttgccgtgggggtaggagcaatggctaagcagcatcgcggggcaaatgacagatccgtcagtcggtgccattgttgaggtgaagttcagaagatgttaaaaattgagtaggggggtaatatctggatgtgtaattcatttcttgtggcatgttcttttttcagctttgtgaaccatttttctatggctccattctcaaaaatgctgaatgtctgaaatgatgaactacaacttaacacattggtaacgtagcctggtaagtgcatatcaaccgaactgcaggtttttgaaaaattatagggaatcaatccttcaagccagagagcagtagactatgagaggacaacgactaatattatttctgtgagaaaaggagagctaaattctccactggtccaacaatcgaccacttggttattattgagagaaattttacggtcctggagaaaatacttcgaggtacctaaattttacacttaaattttttgttgtctagaatgcaggtcgtgaggaagatggcgatagaaaaggcgactagcgtggtggcagcagcgacggcggcgtcacgaggcggcaccgcctcgccgaagagcggactttcctcaacggcgaccccgtggatgggaggtgttctgaacgtctcaactagcgggaggcggggctgggatacccagggtgttcgagcccaaggtaagcccaacactgctcatgcggtttggcgggttcatggtggagggatccgacatgggtggtccatgcgggatttgcttctgaatccgattgaggaggttgctatccccgcaaggtgggtctgggtcccgaaggggaggtctctaagtccgcagctagggtttccagctaccaagcgtgaaatagggcgatttggggagaaggcgacgccaatttggaggatcccggcgaagttggttgacgggagttccttccttgaagttgctaaggggagtggagagatggatcgaaagcctcagcctcagcgtccggagcaatgggtgcccaacaagaggagggcttttgaggaggaggggggggaattgggggaatcgaaactttcaagatagggaggagtgagagttgcggtctcgtttgatggggcaacaacagcagcgcgagggaggaggatggcagcaagttgacaggaggggggggggacagatcttggcaaggggagaggaacagagatggagatgcctgggaaggtggtgacagatgatttttcagaggaaaggagaaggttggagaagtggggagagcaggagcgatgcagaaggaagagatcaaatgtttcaattgtggggaaagtggtcatcatcaggtgaattgtcagaaaccccctctatgctatgtgtgtaagaatccgggacatatctcatctcattgtcctgctcatggtggggggagtagttctagtgatgggaatagagtggctgttaagttgaagggttttggtattcctgagcagggttttttcagcttgaaagtcgatattcctgatatggaaaaagtggctcagtttagagggattcttactgttgaaaaaggcaatgggtctgttcagaaggtggctactgaaatgtcccatttgttcaaggaaaagaaatgggattggaatgtaaaacaaatcagtagcaatgatttcctgattgatttctctagtgaggatgaaaggaggcaagtgaccaaattcgggggttttgtgtttaagacttcatccattaaggctagtgtgatagattcaaaaatgacagacagtgcagtggatgagctgtttgtagtctgggttaaagtgattggtctaccaagctttgctaagaaacatgatattgttagggccatctctgacattgtgggggagtttaaagagattgatgaagaatctctaaaaggggaaggagctgtaagggtaaaggtggggtgtttggatcctaatgccatcaattactcagtgattatctacataaatgatattggatacaagattaaataggaggcagaggttgaccatgatggtactggctcagtagaagggggtgatgaggatgatgataatgcagatgatctagatgatgactaccctcctgggatggggggtaaaaaggatggtaaagagaaaaaggatagtcccaagaaggagtcacctaaaggtacagatagtaaagggaaagggggtggcaaggttcaatctgctccccctgctctaaggagagccacagagaccatgcagaaagcctttaccttgccggtatcaattgagcctgctgaaaaggatgttggtaacactgtcattgaggtagggaaagagggggaagacaaagcagtagtgctatggaagtcagaagatttctctcaaccagatatttttgacaaagatgtctcaggaggacgacaaaagtaatgatttgttgaaaagaatggatgtggacttaaaacttgggggtgtgaaactatttactgatgaagaggaggagaaatgtgcaataccaactgattcagacattgagatgatgagggctgaagaggatgaagacaatgagaagtttgtactagatagtgggatgggggaacagaacaagggagagattttctaggaagtcaagaagaagaagaagaagaagcaagtcttgcaaacacagagacaaagctctagagttaaagataaggaagtccccgtccatctgaaagctgaactcaggaagtcgtatatcaactcatcttcaggtttggtttctaaaaatccttatgcaatctttcattctgttagtcaagatttccttctaaaaattgccaatgttgggagggtaaatcttggtaatagtagtgatgaagttaattctaatcttgatgctataagggccagagaattagcacaagctactttatttgaagctgaaaagagaatgtagcaactggccgaaaaggataagggtgagggtgagaagggacaggagttttcagatgaggcttgcatggtgcatcaagaggttttggtagacaatgtggaagagaatctgagtattccaggtttggaaagggggattggctctatgatagatgagagtgaaaaggggtgttctgatatttgtgaggtatcagatctttctgagccagcaggggggagaaagaaggaaaagagaggtaagcaatgtggtcaaaagggtgttgacagaaaacatgtggcctgggagatcgcttaactccagtgcaggtccaaagctcgccttcggatgttgttagtgtgtcagttgatttgatcctgtaatcaacaagaaatagaagcaaagaaaccgtggttaaatctataaatgatagccgatcggctaggtgccgatgacatatcatttatctttgagccgatgtcatctgtgtatcgatcggcagtcatgaataagtaaagaagaactaaatctactcgatcggctgtagatattaacgatatatactccttatatcgatgtatacttaaatcaagtgattgggatagatcggtcaccatgccaagacagtataaataacttagatcga

SEQ ID NO: 15162 - DNA, 14687 bp, Oryza sativa
tctaacaaactctaaaataacaataagtctttaagacagacttttgcccacatttatctataagaaatttacataagatatcctaattaatagatacaattgcgttcccgggactccatccgtgtgtggcaatcatcctgaagtacattaacttgaacccgatgtcgcgtacaagtcgtattgtcggaatcggccgtatcggcttgcttagcccgactcagacccagccgatcctaatagtagccgatctggacttgagccgactcctgctctgtttccgaactcgatctccgcctcagacttcgctttgatcaaatcttctgtcctgacacagatgttaccaaatttggtcattaacacatgcccccaagtccgggatatttgataatgttccggatttgccatgtaccgactccgagcaagtttcgcactccgccgcttttgaccgttattccagcactttaaatactaaccgttacccccgagaaatctcacgccgtgacttccgttttcaccgctcaagcgaaacctcttctctctcttctccggcgattcccccggtgcaaaggcgatttctaggcgacttcctcctcaacgagatctccgcccgcaccaatgttgtcttccgccagcccatctggtgcgccatcagtcgaaaacactgaggtaagttctcatcggctaaatccccttccttagagcagatcgattttatcctacctcatattgctttccttctcttggttgcctcggatttgtagcatctttcccaccaagtcgcaattcccagtctgacgcatgaaaaccactactttctcggcccaatcggcaatcctgaccccaccgagttcattattggtgaatccaataggatccccttcagattaaccaacccagatctagctcactggaagaatactttcaagtcctggccgtctctagagaaagttccaccagaaaagagctaaactacatggttcaaacgtgtatcagccagcaagagggtccactgggatgaaattggaatcggccaagcacttgattttactatagcaaactcggccaaagatgaacccctgatagcagctgcttcttacttctggtcaaacactattaatgcctttttattcaatcaagggctgatgacccaaactcttatagatatcagcatgatcacgggtttggatgtcacctcatcggccaaccctatgagcttgaacacaaagaaccaatatgacttcaagaccaaaagcataggaggttggtcaggctatgtagcggcatatatggatcagggctcggtcacccctcgggaacatgtggccattttgttaatgtggctagaaaaatttcttttctgtggatcaagttgcggccccacaaccaactggcaatttctagctggagctctagaaacaaagagacaattttccttgggcaaaattctcctcggctatctataccagatgttgaacaatgcatcggctaagatagccatcggctcagtggttggagcaggtagaccctggtggctgctacgaacctggttaaacctgatagttatgaaggttgtcaatcggccatccgtatcagaagctgagttcccaagactagagccgattgtaggggatgatggagaagagcgtactcatcagagatgcacatcatacggagaatatgcttctacaccaactgatgccggggcaaaactatcggctgaactgctcaaagattggttctgcagcttctatgaaggctttcaaaaagatgctcgagtttggttcctttatgaagattctacagaacttgagcacccactagacttcagattcgaagacatcaaccacgaaatataccaatcgtctagggagattttctcagctgcaatcagcccatgcatccttcctgttggcattcatcaaggaagaaacatccaagcttcttacgaattctatcatccaatgagctcagctagacaacttggaatgggccaactcccaattggcttattctttgccgacaagatccaatgcggaggagaaatttcatcgaccttgatgatggatcggctactcaaccttcatggaccccctctgggcagtattgacaacatagaattggcaatgttgagaaacaaaaactttgacagatggtggggtgaatggaagctgcatctattccaccaaccagcttcaatgtatatgacagacatcttcccagatgttgtccctcaagtaagtctttaactccacttgatttaaatagctgtttggccgattaatctcaactaatcctccttttgatttgcagacaacagaatcctctcctcgccgtcaaagcaacagtggtaaggatatccaatatgccccaggtttaattcctaacggaggtgggctatctcctccggttattggatatgatgcccccaagacctcacctcttcttcaagggcttatcagagaaccagctgatgctggcaaaaaaaggaaaaccagatcgtcggctgtagacatcgcagccccaactaagaagaagaagacaaagaaaaccaagccagccgatgatctgcctaccctagattcatccattgaacaagctctggatgaagagataattgatgacgaagttgatcaggccgcagtcgaagtaagcgatactgaaagaacaccatcggctttgcccaagcaaacccctccaactccttctgctcgattcacttttcaagggtaaatatctctctttaatccctttcataattattttgtcttatagccgatcattcccaagtcttataattgcagaaaaagaagactgcggtgaagaagaaatcggctacaacaacgtctaaaccagctctaccagtaagatagttttaactttcattagttaatttttagccgattctggctgacacttgttttctttcagccttcccctcctccttctcctcctgtacaacaaacatcaagtgaccagaccccttcagctgtggggagtcatcacgtcgaggaagaagaacaaccagctgctcctgctatcccagtaagtttctttttgtctcaacaagcattcagattggctatgactgtttctaactgcttctaaatcgttgctgcaggtattagccgatcttttctcttttgacatcagagactatcttgatgaaggagaagaagataccacaagaaaaaccttagcccctttatctgatgatgtgaagaaaactctaggaagaatcttggatcggctagaagcatcatcgctagatagcctggtggttgattgtggctcaatcagggctcggctacatgagattcaggctctaatcccagatgagttagccaatatcctcaccccagccgtttaccttgagcaacaccaatttaaactggaaaaagccaaattaagactagccgaacggcgagagcgcagggatattgaggccactatccaagctaatcgacaacttgtgcatgaagagaaatccaagcttgatcaactatctgaaggcctaatcaagtctaatattgatcggctcaaggctcacaagattgaactcttagcacaacttgaagaatgcaacgctgagctggacatggaacacaaaaaactagccgatctcccaaaatctattgaagaacagaaagcaagactcaaatcggctatcaagcatgttgctgatctgaccaagtctctgaaatttatccctagaaccgacgctcaggatgcttaagccatagaagaagtagagcagattaggcagaaggctatatcgaccatccagcgatacttatctcaataatttttgtgtaataaaacttagaatttttgtaatcggcgaacactttactatctttacaatcctttgtgccgattaatatgactttgaaatgtgctcaaaatttttgcactgcattttgatatatatgtgcccccctagttttgcaatgtcaagagcattgataaaattatataacaactaagggcgatataacaatatcggccattgtacattggcaaaccacaaccgagtacaccatgaaaaacaactaagggcgatataaccatatcgacacaaccttataaatctggaacggtccttcccaattcggcgaccatttgccgaatttactatgacgagtaccaatcggcaaaatcaacttccatacaagttcaccttccgaaaaatctttaggtaccactttcttattataatgccgagcaacatgttccttatccttggtaacctttgccagggctcgcaatcgcgactgaaccagatcctcgctctcatcagccataaggttgtaatactcatcggctgttaaatcgttttgcaactccgttcgtcgagagccgattctaacttcccatggcaaaacagcctcatgtccataaacaagccatcctataagaccacaatgcttcggccaaccgagtatgccattgctgaggataatcagaaattttccgcttaatgaatttgatcaaacttttattagacgcctcagcttgcctattagcttgtgcataataaggtgaagaattcaacaacttgatacccacactatcggcaaactgaacaaactcatcggacacaaagattgaaccttgatccgtagtaatagtttgaggaagaccaaatcggtagattatatgctcctgaacaaattgactagcatccccagaatcaactttcttcaaaggaatcgcctctacccacttggtaaaataatcagttgccaccaatataaatttatgtcctttactcgatggtgggtttatcatactgattatatcaattccccaacctctgaacggccatggcttaataataggattcatagccgacgccggtgctcgctgaattgctacgaacttctgacaatcctaacaccccttataatatctgaaacaatcctccagcattgtcggccaaaagtatcctgtacgccgaagcaaccacttcatcttgtgagtcgattgatgagtaccacagatcctctcatgaacttcgccgattgcaaccttagcctgatcggcactcaagcacttaagtaatactccatcaattgtccgataataaagctcgtcatccaacagtgtatactttaatgccttatatcttaatttcctagaagccgactgagatagattactcaaatactgatgcacatcgtacctccaatcatcggctgacattgctgcaatttcaactttaacatctttgatcattagcttataccccgactccccttgagctaaatcattagcttcaagattttgttctcgagatacatgctttaaagtaaccagccgaaactctttcattagttccaagcacttctcattataaaccatcaacgtatcgttcttgcattcatattctcctgccaattgactgattacttgcaatgaatcccccatgacttcaatggtatcggttttaacttccttgagtaattgcaaccccttgagcactgcctcatactctgcttgattattagtcgcatatggtttaatagtataagcaaactcgaaacatgcccccctaggggaaattataactatgccgatgccacaaccatgagtacgtaccgatccgtcaaagaataaagtccatggcactatctcaaccgagccgattgaatcttcacgatgctctacaataaaatcggctatagcttgtcctttaatcacttttggtgattcataccgaagatcaaactcagtcaaggaaaatatccactttccaactcttccctttaatattggagctgatagcatgtacctgactacgtcggctttgcatataacagtgcactcattagataatagataatgcctcaaccttgtacacgaaaaatgcagacacaagcataacttttccacaggagaataccgagtctcagcatccaagagccgtcaactgagataaaatacaactcgtttcttcccttccaactcttgaatcaaaaccgagccgattgactccttaccagccgataaatataacctaaacggtattcctttctgtgaaggaatcaaaacaggaggagagctgagatactccttaatattatccaaagccttttgcttctctgccccccaagtaaactgctgatcggcttttaacctcaataagggtgtaaaaggttccaaccttccggacaaattagaaataaaccttctaacaaaatttatcttgccgatcatttcttgtagctctgtcttattttctgggggctgaatcttcttgatcgcattaacgctcctttgggttacctcgatccccctttcatgaacaagaaatcccaaaaactggcgggtcgacacaccaaaaacatattttgttggattcatcttcaagccatatttcctggttctctcgaaaactttccttgaatcggctatgtggtcctccacttctttagatttgacaaccacatcgtcaatataaacttcaaccaaccagtcgattaaatcatgatatatataattcatggctctttgatatgttgctccagcactcttcaagccgaaagttatgacgacccattcaaataagccgattgcaccagggcccctaaaagccgtcttatggatatcttcctcagccataaaaatctgattatatcctgcattcccatccataaaactcaaaattttgttccctgctgaggcatcaaccagctgatcggccactggcattggatattcgtcctttggtgtagctttattcagatctcgaaaatcaatgcacaccctgaccttgccattctttttaataactggaactatgctacaaacccattcagcatatcagcagggacgaataaaaccagcatcatacaatcgtttgatctcagctttaacaggttcgagcatatcggctttacatctcctcggaggttgctggcgtggtctaacccctggcttgataggtagccgatgttcaacaattgatcggctgagtccaggcatctcataatactcccaagcgaagcaatctctaaactcttttaggagctctatcagcttggttctaaactctagagacaaatttttgctaataaatgtcggccttggccgatcgtctggacctatgtctatttcttccaactcatcggccgacataaaaccttgaccttgcttgtcatcgagatcatctactgtatccttagcgtagacatttgaaccctccacgacgccctcaaagtaatagcttgggttctccatcttcgattggctgtatatcagaatcggacacttttagaaaatctccatcccagacttttccagataaacaatcaaggccatccatctcccaaagggctaaatcggcactggcaacattaactgacctgtcggctggcacgatctctatcttgtcaccttgccattaaatcaagcattgatgcatagtcgaaggaatgcaacaattggcgtgaatccaatcccttccaagcaacaagctgtacgaacccttcccatcgatgataaaaaacgtagtaggaatagtcttgctgccgactgtcagctccacatttagaacacctctggtttccgatggattaccaccaaagtctttgagcaccatatttgtcttgatgagatcctcggcgttcctacccaacttgctgaacgtagcataaggcatcaaatttaccgcggccccaccatcgaccttcatcttagacatcggcttcccattgacgtagccgtttatatacaatggtttaagatgccgattctctgtcccctcgggtttctcgaatattgcctgttctggtgaaaggaccaacttagccgatccctcttccacttcatcgacatcggcctgatcgatcccgaattcggctggcaatgtaaagaccatgttaattggtgccgctacaatgctcttcccttttgccaacctcttcgcctcatcggctgcagcatcatcggcaacaggaacctgattcttgacacgccactcctatcttggctttggtttcctcagctgatggttgatttcctcttcaacctcctaaaaacgctccctgttcctcaatctttggacccttcttttctgattcttcgtgaaaataccagaaggacaccattgattcttcctgattatctcatcctcttggccataatcttgattcatcggacccaatctctgatgaacaggaagtcttgtctgccttagccgattacctctactatatgaccggctcgagctctcgacgatatcattgcacccagggcagttttcaatgaatggcaacctcatcccttcgttccagcagaatctaaagaactcacaaccccaatgaggatcaaaaccatcgtcgtattcttcataatgcttctcctgctacttgttatacttcctctgatacttgttgataatcctagccgaattcactcgaaaaccctttgcatggaccctatcggctgcttgaccggctatatgcaccatattaacaggaaaaggattacaatcgaccttcatcggttttttggaatcatcaaacctaatctttcccccttcaatggcaacttggatttgctgtctaaaaaccttgcaatcgttagtagaatgagacccagaattatgccatttgcaatatcgcttcttgcctaattcctcagccgatggtattgtatgaccaacaggaagctgaatttgcttttctcggagtagtaaatcaaagatcttgtcagccttggtgatatcaaaatcatacttttccacttttccagaactttttacccattggcatggtaagacctttttgcttctcacctattcggctgcagctatttcagaatcatcttccttgtcatccgatccatacatgtatggacaaacatgattaactttcttagagcttctcctcacttccgccgacctatgctcatgcaaggttaccttctgtatcagatgcaataagctatcaaagtcttcggacgagaatttctccctgattggaggaatcataccatggaatgccaaatcggctaactgagcatcagttaaactcaagctaaagcaattgtttctcatctccctaaacctctgaatatactcgtgcacgggttcatcatgccgctgcttgatcgctgtcaagtcggacaacttcatctcatgaaccccactgtagaaatagatgtgaaattgcttcaccaaatcggcccaactactgatcgacccacatggcaaagaggaaaaccaagtaaaagctgatccagacagagataaccggaataacctaactctcagagcgtctacagccgatgcttcaccacactgagcaaggaatcggctgatgtgctcataagttgacacgccctcttgtctcgaaaacttggagaaatctggaactttaaaccgattggggagagggactatttcaaaccactcaggataaggcttccagtctcttttggtttaagcccaaattgttctctcattacatcggcaatcacatcggcccacggtcgttgctgagttgctccttgtggctgttgttgcatagactcgaactgaccatactgacatgcgaactggggctgagccaatccccctggctgatattgggcttgtggggaaggaggctgatattgatagctcaaattactcccttggtaattatgaagattcggctggatgttgcgcaccaagtgttcaggaaccatctgaggtatcactgtgccgtccggctgtgcacggtgaaccaaatgctctgggataacctgatttacaaactgctgtacaggttgaccaccaggtactgcgaacccggccgatgcatttactgaccccgggtgctgaatcagctgaacgatctgttgtctcaatggagtctgttggatcggctgctgaggctgctgccttggtggtgtctgctgaattggttgcagaggctactgccttggtgatgtttgctgagcctgttgtactacctgttgttggattggttgtacaacaggctggattggtggtgtctgctgaatcggctgctgctgcactggatcaacaataggtggaggtggcagaaacatggcagcaacttgatcttgggttagccgattcatagccttcccgccatgctgtggcagatcccttgttaacaaccgagggttcaccggctgtcctggcgtcatagctagtgtagcaagcaaaggagtcgatgctggcgccgtcggctgagttgtgggtgcaacggagggaactgcttgaacagatggctaaacatcggtgatcaaagatcgataatttaggaagacacctccatgcaagtaaactgtgcctgcagcctgatgctcagctatcgaaccatcggctattgtcttcatcatgtttgacaatgtattgactaataccccggactgattgatcaaagcatgatgcacagcgtaatcaacccgatcttggaagttattgaaaaaatcttgtgctagttcactattctagttaagattccctccttgtggctcctgagcaccatcaccttgtacgccatggactccttgagaattgtcgccttgatcgctcgtggagccatcggtagcacctttagtactcggctgagccgagccacctgaagcttgtttcacttctccatctttaaaagaaccggtctgtaacatcccggcctagggcttaataggattaatagaatactcatatcaacaagttgcaacttcttttccggaagccgatctccaaagaactccggggttaagcgtgcttggcctggagcaatttgggatgggtgaccgaccgggaaattcttcccgggtgcacacgagtgaggacaaagtgtgcagaaaagatatgtgttggtctgtgagggcagtctatgacatatgatagctatcagatgtaagcgggcccggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgccgccatgcgctggcactggatacatggacgtggccaagagaggacgttcctggcctagggttgatcgacgggggcgtcgatctctcttaagggggtgagggtgtaacatcgtggcctagggcttaatagaattaatagaatactcatatcaacaagttgcaacttcttttccggaagccaatcttcaaagaactccggggttaagcgtgcttggcctggagcaatttgggatgggtgaccgaccgggaaattctttccgggtgcacacgagtgaggacaaagtgtgcagaaaagacatgtgttggtctgtgagggcagtctatgacctatgaaagctatcagatgtaagcgggcccggcctgggggaaggcgggacgttacacggtcccaggactatcagcaaccacttttattttatacttctgaacaagtgtccccttgcgggtctgctcaggcgtgaatttctctggatcgatcagcatgacgttgacatcaatgatgtcagtcaatccctgctttaacgccttgcctttaacagaacctgggctagatagtggtggttattttatacttctgaacaagtgtccccttgcgggtctgcataaatgagtttaggaactgatcccgtgcctgctgcagggttgcttcaaactctgccatctgctcaggcgtgaatttctctggatcgatcagcatgacgttgtcatcaatgatgtcagtcaatccctgctttaacgccttgcctttaacagaacctgggctagatagtggtggtggctgtttctcggccatgagaaagaactgacgtctgacttcttacaggacccgctggacgtgccaaaagcgtgttgacagaaaacacgtggcctgggagatctgcttaactccagtgcagctccaaagctcgccttcggatgttgttagcatgccagttgattttatcctgtaatcaacaagaaatagaagcaaagaaaccgtggttaaatctataaatgatagccgatcggctaggtgccgatgacatatcatttatctttgagccgatgtcatctgtgtatcgatcggcagtcatgaataagtaaagaagaactaaatctactcgatcggctgtagatattaacgatatatactccttatatcgatgtatacttaaatcaagtgattgggatagatcggtcaccatgccaagacagtataaataacttagatcgaaatatatatcaataacagggttatatatgtttgtagcatagccgatcagatagatctagcatgtatcagctaatactccgatactactttatatcaagatattaaagcaagtataatatatcgagcaaaagcctaacattcttagacacagcaatatcttaatataaagggctgatttaacatatcattgaagcatatagaacaaatataattaaatcagatacgatcggctgaaactccgatgctattctaatcggcaactagaaggcagactagagatcgatattctaagcacgactcaataggtcaaactcaactgatacagcattaagtatgaaaagaagaacaatatttagacaatcaagccgctagaagtttcatagaatggtagatatctcatataatctagatcaacatcaagatctaacttaatcggctgccctctgtgtacagatatttgccgatagtagattaggtggcgatattgctagagattatgtaagatatatgataactcgacgaattatataaacaagattagagtatcacaaagatggaagcactaatcctaaaaacacaatccgtcataacgagttttacctcttgttgaagatcgaaaccgatgtagctcaacccgaaagcaagaactcgttgaagcaaaactaaagcaaaagggtggcgatgcgccgaaattgtattgaacgtgtgtgttgttaaattacatagggctcggggtctatttatacccgagaattacaagatatgcccataccggacacgactattatctctaacaaactctaaaataccataagtctttgaggcagacttttgcccacatttatctataagaaatttacataagatatcctaattaatagatacaattgccttccccggactccatccgtgtgtggcaatcatcctgaagtacattaacttgaacccgatgtcgcgtacaagtcgtattgtcggaatcggccgtatcggcttgcttagcccgactcagacccagccgatcctaatcgtagccgatctggacttcagccgattcctgctctgtttccgaactcgatctccgcctccgacttcgctttgatcaaatcttctgtcctgacacagatgttaccaaatttggtcgttaacaaaggggtatggaccgaaaaggagggggagacctaggaaaacagataaaagatgagagttgtattttggaatatcagagattgggggcttctgggaggcagagacagttaagggagatgatctttgaacaacaggtagatgtgatttgtcttcaagaaactattaagcaaaccttttcagaaagagaattgaggaatctggtgggggatcattttgtgtggagatatgtggttgctattggacactctggggggatcatgactggggtgagagatctaatgtttgatatcctagattgggatcaggggaagttttctctgaaaatggttgttaagaacaagagggatggtttcatttgggagctgatcaatgtttatggtccagcacatcaatcaaatagggggggtttttctggatgaactttcccaaagaatgcagcagggggtgtatcctatgatcttggggggtgatttcaatttatatagattttcagatgagaaatctggagggggtggggtggatgttaggagaatggatgctttcaatttgttcattaaccagtatggtttacaggagttgtttaagcttgggggcaaatttacttggactaataagcagtctacccctataaggagtgtgttagataggattttagtaacatctatgtgggaacagaaatttcctttagccattgttagctccattttaaggttggttcagatcactgtcctttgcttttggacacaagagaaggggggagaatacatagcacttgtttagggttgagatgagttggtttgaacaagagggtttcaaggaagatttgttaaaaaaatgcccaattaagttgcaaggcaaggctatggattactggcatcttctcatgccaagtcttaggagatggatgatgggtggagtgctaacatggttaatgcgcaaaagagaagaaggaaagagatagaacttaagttggcagaattagacaatattgaagaaaggagggatttgtttccccaagaatgggagatcagatatgagttggaaagggaagtggaaaatatttatttacaggaggagatttggtggcagaggagagggggtgaacaatggctgttgaggggggggtagtaatacttctttttttcacaagattgccaatggtagaaaaagaaaaagtcatattttttctctgcagcaagggggagacacaatcttagacttcaaccaaatccaacatcacatttatgagtactacaaaaagttgtttggaagagaggaaattaggaatattcatctg

SEQ ID NO: 15163 - DNA, 883 bp, Oryza sativa
taggggatgctctctcagtcattttggagaatgcttgtaacggggagtcttagaatgtttggttcccaatttggttccaggggggttaactcaccttcaatatgctgatgatactattctttttactaaagcttctgaggagaatgttttggctttgaaattcctgctttattgttttgaagaaatgtctgggatgaaaataaactaccaaaagagtgcagtttatgtcttgggggttcctaaagaaacagaggaaaagtttgctgatatgttgaattgcaaagtggggagtctgcctttcacttatttggggttacccatgggttttgagaaaatagggttcttcagaaagtggaaaagagattggaatcttggtacagtgggcatctgtcatatggagggagagaaatcaggattaattcttgtctgtccagcatccccatgtactccatgggtttctttaagctccgagaagaatttcacaagaagatggacagtataagagggagattttactggcaagggaatgggaagaagaagaagtatcatctaataaaatggcagggcctgtgtagacctaaggactttgggggttaggtttcatggatactaaggttatgaatatttgtttgctgagcaagttggataataaaatggaaaatgattctcaggacatgagctgtgtggtccttagaaacaaatatttgggccaaaacaactttttcaggagctcagctgggggggggttcttagttttggaaaggtctccatgattgcaaagattggctgaacaggttggtggttaaaaaagtgggaaatggaaagaaagtgttgttttgggaggatatttggcttggggaggtccctctcaaaactctttttc

SEQ ID NO: 15164 - DNA, 2112 bp, Oryza sativa
ccctcgtttttgttcggattgttcaggatttcaaattcataaacctgtgcatgcaaatcttgtagtagtttgttactccttaatcctacgtgacctatggttcacatgaatgtttatactttgtgtgatatgatgcaaaaatctttatgtacaatgcttttctttatctgttactatttatttggaaggtgtggaacgcgcagattttgcaggaatccgtgtccacggagtctgggatgtgtggcacaactgtgcaagagtggaggatttcgcaagaggcgggtggttttctccccgtagtctgttccttttactcgaactggaacacagagttggcctttcccctcggcaatttagttgccgtgttctatgtacttgtaacgacactcctgccctgtctaaacaagaattcttggccggcattctttcaccggccaacgaaaaaaaaaacaaactgaacaaagttggaagctcagttcatgaaagccaaacctttttttttcctccaaaacaagacactccattacatggtgagatgaagagtgattaatcttgcagtcatatccccagaaggaaaattacatatgcagttgtaggtgcatattgaacacacctgcggaacttgaataagtatgaaattataccatatgcttcctttttttctttataaaataacagatgagcgagcacttttttataacttgatggggtatgagtatgaggcttggccattaggttgttatggtaggcatggaagtctcaggagcttcatctgtttgacaaagtgcaagcctttggattgcactaaaacatctcgttgctagtatcatcagattggcgtgaaccccatgatagatgccagagctggagctaacaaaaatggctttcttgtagccattcctcaaactagctgatactccttagagatagacatgatcagtgtgatatgatatgatatgttagtggtttaagacttgttctttctttcatctgccgattattgagccagaaaaaatgagaaacttcagtaacattcagaagatcgccaaaaattaaggaacttgatcatattatcatcacaaagattgtaaaaatttaagaactccactgatattaattcagaatttcaaataatgctacaaattaagtgtgttggagttgttccaaattcacttcaagatattggccgggcttctgacgaagcttagtacggtacggtatatatgccctttgctagggtttcgtggagacttgattctcttgtaagccgccataggcgtgtaacccaaaactcttgagatagtgagattgttgctggctggtgcccgtggttttttcccctttcgcattaaaggggttttccacgttaaatcgtgtgtctccgctgtgattgtttttcgtttactttgtatttctatacgtcgttcataacaagtggtatcagagctttggttgctgttagggttcatgacgacgtcgatgaagttcgatcttccgctgctgaactacgacacgcggttctcgctatggcaagtcaagatgcgggggattctggcgcagactcatgactatgatgaggcactggataacttcggcaagaggagggccgagtggactgctgaggagatccgcaaggatcagaaggcgctcgccctaattcagttgcatcttcataatgatattttgcaggagtgtttgacagagaaaacttctgcagaactatggctgaagctggaatcgatctgtatgtccaaggatctaaccagtaagatgcagatgaagatgaagctgttcactctgaagatgaaggaggaggattcggtgatcacccacatggctgaattcaagaagatcgtggccgacctagtgtcgatggaggtgaagtatgatgatgaggacttaggtcttctactgttatgttctttgccaaattcatatgcaaatttccgtgacaccatacttttgagccgtgatgaactaaccctaaaggaagtttatgatgctctccaaaacaaggagaagatgaaaattatggtgcagaatgacgggtcgtcgtcctcaaagggcgaagctttgcatgtgagaggcagaactgaaaacagaacctcaaat

SEQ ID NO: 15165 - DNA, 2425 bp, Oryza sativa
tgctgcttctgatgatgattctggtgattgtctggtagtatttgctggttgagttgctggtcatgatgaatggatttttgattccgcatgttcgtttcatatttgcactaaaagaaattggtttagttcttacaagcctgtgcagaaaggggatgttgtgcggatgggagatgataacccatgtgctatcgtggggaattggatcagttcagatcaaggactgatgatggcatgacacgcaccgctggaaaaaatgtggggtatatgccagggatgtccagaaatcttatttcattgagcacgcttgatgcaggaaggttacaaatattccggttcagatggcgttctaaaaggtatcaaaaggttctcttgtttgtttgaaaggtgatcttaattctgcaaagttatatgtccttagagggtgtactttaactggttctgattccgctgtgctgctgttagtaatgatgaacctagtaagactaacctttggcacatgcgtttgggacatatgagtcacattggtatgacagaattgatgaagagaaacctggtgaagggcttgacttcgagtaagatcaagttttgtgagcattgtattttcggcaagcataaaagggtacagttcaacacttttgttcacaccaccaaaggtactctggattatgttcatgctgatttatggggtccttctaagaagccctcacttggtggtgctcgtatatgcttacaattattgatgattactctagaaaggtttggccttattttttgaaacataaagatgatacctttactgcttttaaaaactggaaagtaatcgttgaaaggcaaactgaaaggaaaggaaaaatgcttcgtactgataatgggggagaattttggtcgcatgcctttaatgattattgcagacaggaaagcattgttaggcatcacaccataccccatactccacaacagaatggtgtggccgaacgtatgaacaggaccattatatccagggcccgttgtatgctgtctcatgcaaggatgaacaagcgtttctgggctgaagctgcaagtactgcctgttatttgataaacaggtctccttctattccactaaataagaaaactcctattgaggtatggtctggtacgcctgctgattattcacagttaaaagtttttggatgcactgcttatgctcatgttgacaatggaaaattagagcctagagctgttaagtgtcttttccttggttatggttcgggagtcaaaggctataaattgtggaatcctgaaactgggaagacttttatgagcaggagtgttgtattcaatgaatctgtgatgtttactaacagtttgccctcagaacatgttccagaaaaagagttgcagcgtatgcacatgcaggtggagcatgttgatgatgatacaggtgttcaggtggagcctgttcatgagcaggatgaccataataatgatgttgctgatgatgatgctcatgatgatgttcagcaaactccttctattttgcagctagaggaggaattacctattgctcaacgcaagtcaaaaaggacaacaaaacctcccaaacgtcttattgaagagtgtaatttgtcttactatgctttgagttgtgctgaacaggtggagaatgttcatgagccagcaacctataaagaagctgttcgttgtggtgatagtgagaattggatttctgctatgcatgaggagatgcagtctcttgagaagaacagtacatgggaggttgtacccttgcctaagaaaaagaagaccatcagttgcaagtggatcttcaagagaaaggagggtttatcttcaagcgagcctccaaagtataaggcagggttagttgctagaggttacagtcaaattccgggtgttgactataatgatgtgttctctccagtggtaaaacacagttcaattcgtacttttcttagtattgttgcttcacatgatcttgagcttgagcagttagatgtgaagactgcgtttttgcatggagagcttgaggaggacatatacatggaccaaccggaagggttcatagtgcctggcaaggaaaaatatgtgtgcaagttgaagcgatccttgtatggtttgaaacagtcccctcgtcagtggaacaagaggtttgattcatttatgttgtcacacagttttaaaagatctaaatatgatagctgtgtttacatcaagcatgttaatggatcacctatatatttgctgttatatgttgatgatatgctgattgctgccaagagtaagattgaaatcactaagttaaagaagctgttgagtagtgagtttgatatgaaagatcttggtagtgctaagaaaattcttgttatggaaattagtagagacagaaaatctggtttgctatttcttagtcaacataattatatca

SEQ ID NO: 15166 - DNA, 741 bp, Oryza sativa
  unsure (1)..(741): unsure at all n locations
tcttggcttctttctgtgttgcagatacaattgtctccttgaagccagtaaaattgtagttaatcttttatggctttttttctccttccctggttactttagttcatgtattgctgacgatctgtagctcccatctgacacacagctatgctacttttgttttcaggaatactacaatgggctcatacagtccaggaaacatgatggtataagagtgaacttcagcagcaagcatgggaaaggtactggttactgaatacttatatatcttgtgcaatgcaatccggcaaacttggagtgcttgtataaagttggtgtcgggtaaaagccaagatacttaaccagttggttcttgcaggtgtttgtgcgaacaaggagtttgcagaaggggaccttattctgaaggatcaaatattggttggtgctcagcacagtcttaacaaggttcgtctgcttttgaagtgatcctaggtatttgttcccttctattttttgtgtgaactgctcctccctgaagtgtggtgtccattttgtgttttatttcagattgattgcgctgtgtgcagttattgctttcgcttcattggttctatagagttccagattggacgaagattgtattggcaaagcgttggttcaagcagtgactgcactaataggaggcattgccatgagagtgatttgnnnnnnnnnnnnnnnnnnnnnnnnnnnnnnnnnnnnnnnnnnnnnnnnnnnnnnnnn

SEQ ID NO: 15167 - DNA, 525 bp, Oryza sativa
gtgacactatagaatactcaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacag

SEQ ID NO: 15168 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagnnnnnnnnnnnnnnnnnnnnnnnnnnnnnnnnnnnnnnnnnnnnnnnnnnnnnnnnnnnnnnnnnnnnn

SEQ ID NO: 15169 - DNA, 877 bp, Oryza sativa
cgcctcccgcaacgtccaccgcctcctcctcgcctgcctcctagtcgcctccaaggttctcgacgacttgtaagcataaatcatctcttcttaattaacctctaatttactcgttcgcaagtaaaatcttacacataattgaaccatgtaaaagaacctcagttttgttaggatacatgaagaacaaacacaaagattgtggccactttgtctgtgtattaatcccagcaactgtgtttgttcttatcatgaacagttggaaacataaccacagatctgcagtcactactgcatgaacagtcaatgggtagattgagaccaaccaataccacaattaaataagaatgaattaatcgatcggtaattattatttattttttggaaaaagtacgaatcaccccccgaactatagcggtcgtctgaattacctccctgaaccataaaactggatattcttcaccccgaactatgtaaatcagacgaattacccccctcgacctaatccgcggtggttttggtctatgtggcatacgctggtagtccagtcagtattttatttattaaaaaaatatggaacccacttgtcatactcctatccaactattcccctctctctcttatctccctcttctctcactctcttctcactcacgcacacggaggcaggcgggcgacagggagcggcggcggcggtggaggcgagcggcgggggatgaggcggcgagcggcggcggggtgcggcggagtaggcgaggcgaggcggcggcggcggcagaggaggaggaggcgagtgcagcggcggcggggtgcggcggaagaggggagcgcggcggcaacggcggcggggtgtggcggaggagacgagcggcggcggggt

SEQ ID NO: 15170 - DNA, 21954 bp, Oryza sativa
  unsure (1)..(21954): unsure at all n locations
gggaaggacgacgagctggctgatctggtgcggcgcctagtggacgccctcgcccgctactccgatcgcctcccgttcgacctcgatcgccaggtttgccgctcggatctgtgatcccccccgtgtcgcgcgtgtgttttgcggtgttttgataatctctaggttttcctcgctgtttagggatttgtggtggtccgtggtgtaaaggtggcgcgccttgcttgattgtttgtggggaaggctagtcttttttgtttggaactatattttatactgtggccattctactattgtttagttgttattacatacatatgagttcgaagcatcgatttggtaattcgttcttagcagctgtacaagctagaagctgtagtaaatttttaggcgtggattcgcagttcgctaatgatatgtctcccttttgggaaatgtggtcgtatttgggtcattgtgatagttgagattttgatgtatcctttaggttagtaataggctaatagtgctgcgagaaatagttactatgtagaagtgttggttggccagaaagatgcaaacttttatgatggcttgctttatgtgatatcatcgaatgatctacttacctctatagtcagttaatgaatcactaaataattcgttaatggcatgttgtcgttttgtaagttctcttgactgtagtgttttacaacgctatttccaagaactcggtagtaatacaacgtgcagatcctaggctagtaatggatgcaagcacaggcatacacatgcgaacatgacatgtgcatgcacggcgaggtaaaccgatttctatgctcagaaatctgcgctacaacgtcattaaaacgactttaggtatcaaatcacgtgaaagcacttaaaagtgccgtagcgctcgaaaatcgaccttctgggccctatgttgcaacttgcaacagcatgagcattcatattattccacaaaagattgtacttggtgtcaatttttaatcccttgtatcagtcgttgttgtggtttggatgagtgaattggtgccattttttgtgatttctcacacacaaagtccgttttattaattcttgctacaagaattattgaattacttcaatcttctattttagaaacttcgctcatttactacacttgccgcaattacaatcacacttatctttgcctggaaactgttgagagctcctcaagagcaacctcggaggccacgtagacgcgttgctccatcacctagcaacaccagcagtagatcacggccaggtgctttgacctcaacggatgcttgttcatcttcagcagattcaagagcacaggaagcaatcaaccagcttttccagccagtaaacgtattgcctgtttccttttctgaatactgaaatgatgtatctgcttttagggatccttggactgatagtttgcttatattcttctccagctgactcttgagcagcttgttaggcataaactgagcgaaggacgaagggtattttgcaagcaactgctttcacacctttttttttcacgaaatttaaagttttgttataccaatgcatgtttctttcccatgtgtgaattataatgtttaggttacatgccggttacttggtgtgattttggaggaaacaactccagaggagctccaggtgagcaaaagcgctgctgcaaaaaaaatttcctgttttttgttaacgaatttaatttagcggaattatacttttttttcagaaccatgtcacagtgagaccttctgtcctggaggttcttctagaaattgcaaaattctgtgatgtctatctgatggagcgcattcttgacgatgaaagcggagtaagtaataaggaccatgcattttttctgttgcatttatgttttacgctttacaagtatgctcaagacttgatatgtcaatatatactgatatcggcatatgcacgcggaataaacagtaatcaatttaccattgatatcggaataatacgatgaatgaacaactacctggtctgctattttatttcattatgttcaggggttctttttttttttaaaaaaagaaaagcagaagagtatttttggaatcatcactatagacacactgcctagtacggaatttgaatgagctattatagcttgacatcagcacaactgaataatgttgcaggaaaaggtgttatctgccctgagtgaagctggactttttacgaacagtggattgataaaggacaaggtaagccgcatgatgaggtcacttcagaaatataactgcttaatcgttttttttttcatttgggtatagccattggatgttcgcaatggaccttatgtaacatttcttcaaatggcaggttctcttctgtagtacagaaaatggccgcacctcttttgtgcggcaactggaacctgattggcacattgatactagtccagaaattgttcatcagctagctgtaagtcacaattttaacaatcaagtatcatacttatagaagcaggttttgagttgctatgctcccttgcagaggtttatcaaatatcaactacatatttctccacaacgagcagaaagagtagcatccaatgttttcagctctacaagcttggaacaattctttggaggccttgatcagagatgataatatgaggtagagcaggagagaatttattatttgacatgtgcatcggcgtgtttctcatgaaattgatagcagcacctgtatatcatcaccaaatttgacataaaacctgtatgctcaaccgaccggaagacatgacggactgaatatatgtactgcacaattctacacgccgttcctctaatttatactgtctatctctctgcaggtgagctccagcaaacaatggcatagcgagaactgagacgaacatcattgttcattttttttccttgaatgatggaactcgtttttcttgtaccatgtgtaaaagtcgtgtcatgttaaactggttctgcaactccccataagctatggaaagagatagcatctgtagcataatccatgtatcaattgtgttcctgtataaccgaaatacttaaaattgtcatccagttatttgttcggccattcatcccagaaatgtgttattttcacaaaaggaaaaatctcaactgaacagaaggaataaaaactttctgcagcatccaacattagcacagcaaaatccagcatccactcaaataagtacgtatcatatcattctttccgcatatcctatcctaacatttttggagttgtcaaaatctcaattgcatatcctagacaaaaaaaataaaataaatggagtcgtcaaaacttcaattgcatattccacaccaaaaaaataaatttcaggaacctccaaactgtggatcttgttcagttgggcttttcttcttggcacctagggcacgtacagatgaatccataatctgcaagctccgcctgcctctcctcgtaggagacatcctcatcgatgtaggatatggtaatctagaattttcacagttagtacttggcaaaacaacgttttcaatgttttcttttttcactggcagcacaagaaaaaaaatatttgagataagcgttaacagctcagtacctcatcgtccttcttgataggctccagagcaattatcactgcattaccatcagtatcctgcaacggtagttcaatggttttgtcggattgctgactggcaatttggtgtgaaaaatgagcgaatcaactggaagaaatatagattacctcatcccttttatatgctttagcatttggacaacatgaatgattcatacagctttgcaaaggaaagaatgccgtccctgccaacgagaaaattcacaagagaatgaacgaatactgctgggtaaatagaaaatgacattactgtggggggagataaacttgggaagaagctccacataccctcacaaggagctgcatagtcttcacctaaagcatctagaaatggccttgtaaccttttcagcttcctcctgggatatgttgcacttcagattaacaatgccacaagaaaagctaaggctaaccagtgaaaataccttctcatcatctggaagatcatcaatatgtatgaaatagtcttccactggagacggaacaaccaaaccactggaataaaagatggaaatatattgaggttattacatcaaatgcagtacagaacttatttctgttgatggaaagaaacaatgacagagtatgtaatgcacatatacaaatgaaaaataattagatttacttacagattgttcagctcaaacatgccaattaaatggccatacacgtcaagtgagaacactaggaaatgtcaaggtgaccgtttttttttacgtgagtcaatgaaacttgattacttgaatgtgaagggaagctacttatttatatatatgaactgatctagtatatgccaaaaagcttgcatgcctgcacgactcagaatcaaacctagcatccttgagaagctgcaatgactgcgaaacacagaagataatgatctgcccatcaatccattggtatgtgggacacttttcaatcaaaacaataaccacttcttgtgtgccatttttatattttaactgacgagctagtgaataaagcttcgtttcagagcacaatattgtgaatagaatacctatatagtttcaaaagaatgaaatatgtgacagcataattaccgtaagtgctagatccctaatttgctgcctaaatgtatcttcatcacaggaatcaacatcctcaggcaaagcaacagagtcccaccacctgcaacaagattttttttttttgggacatattagggtggaacaacaatgcaaacaactcaaaggatcttgtagagctagagcaaggtagtgaaagccacactgagctgaaaataacatcttgccaacaaatccaaaaaaagagaacaaaatatgcaaccatgcaacagagatcttattgactgttataaatgagaagagtggaaatatactagtaccattgaattattgatatacacttgatgaagaaactatcgattgtgcattaaaataacactgctggtagtgccatacgcgcagctactttatcagaggggatgaatagttgcatgcgaattcatgactttacctctttttgtagcccatcgaaagtggtttccatgcttccataagcaaagaaaagtttgattcatctgtgttattttgaaattcaggctgcgttttgagtttcttgtacctcagcagagtgaaagtgatagcctgacatgtaaaattgtatcgagctcatgcatcatgatcaggagatattaaattgactgcaattggtagcaataaggaaattgcaattgaatcttttgtttggggatgttcttgatatagctactaaaactcgtcttgtgcaatagtctgtcctggtgcattgataagtagattgctgacagccattagtgataacagtaccaactcaagtgtgatgcttgaatgctttttgtattagccatggacaatggcaaagttctagtatccccataaaacttttggagaatattagaatctgagatgagcacataacacgatgtttagtgcttagtacactaaacattaatctatatttctatcacataccttggcagcaacaagaaaaatatcattggaccctgaaaataaagattggtcagtagcagataacagactgacaacctcaatcacaatcatcactaatcaggaacaattgatctaggcatgctgcatttaatgaatagtgaacacaacataaattcgtaatgatggtatataatgatcactgcatactgcacttaccatttgcatgttctatgaatttctgaagagcagatctctgggatggttcagtcttagatccagtacacagcaaagagtgataagtttcccagtcggaatcagcacatgattggctaaacaaaaatgcagaatcaacaagttatgtttttaccccaagattacatttctatctaagacggcaagaacaagttacatgttctgataagataattaggttttaagttttaacacgaccgacaactataacctatgatggagaatgaattgatcaacaaaatatttatgcctcaaacaaaattcctaacatctttgggtgttgcagccaaaagaaagtgtgaactgtaaaatggttagtgactcaaacctgcagtagcgttcttcctcacatccacgacaaggaacaacttgaggcaaactaaaatggtctgtgaaaggcagtgacatgtcaccagtaataagtgatcctaagacctcttctggcaaagtactactgttttcctttgttgcaccagaagaactggcactcgatcccaaatcactctcatggcaatgcctcctattagtgcagtcactgcttgaaccaacgctttgccaatacaatcttcgtccaatctggaactctatagaaccaatgaagcgaaagcaataactgcacacagcgcaatcaatctgaaataaaacacaaaatggacaccacacttcagggaggagcagttcacacaaaaaatagaagggaacaaatacctaggatcacttcaaaagcagacgaaccttgttaagactgtgctgagcaccaaccaatatttgatccttcagaataaggtccccttctgcaaactccttgttcgcacaaacacctgcaagaaccaactggttaagtatcttggcttttacccgacaccaactttatacaagcactccaagtttgccggattgcattgcacaagatatataagtattcagtaaccagtacctttcccatgcttgctgctgaagttcactcttataccatcatgtttcctggactgtatgagcccattgtagtattcctgaaaacaaaagtagcatagctgtgtgtcagatgggagctacagatcgtcagcaatacatgaactaaagtaaccaaggaaggagaaaaaaagccataaaagatttactacaattttactggcttcaaggagacaattgtaactgcaacacagaaagaagccaagaacacaaaagattgtttctattctgtcgaattgatacctccatcgagctacattcactacacactaactgggatacccaaaaaagacaaacttaagattgtacttctgcaaataaaacattaaactacaccgttactgttgtaaactaaacaattcgcctctcatctcaccaatctaaaaaaaaccatccatgcggaccaaaaagaaatcctcctttctcagtaagataactgaaaccaatcatagtaagatatacccatcatagtatcacttccttataacgaaattcccgacaatgattacccaacctttctacagggaaaaacaataatcgcagcacaagcaattcccaagcagatagatttgagacccggaggatggatgggcaagggaaggaaaaagaaaacgtacctgcgcgggttggagaggaggggtggcgaggagctgggcgatttggggcgcgaactccctgtccaggtcacacgggcttgcgctgctcccacccatgccgccgccagcgcgagctgctgcctcttgcggctgcttcttccgccgccgctcgccgccgccgccgtggggtttggggggttttgttctcgagaccttgtctcgtacttgggggagaggtgtggatatgaacatacgtgttcgagctatgaaggcggaaacaagggaagtacgcctccttgttgaaaacggaaactgccatttttggttcaaattgacagccggtgtatgcataactgcacacacataaggaatatgtgaatgttacttgtaaactgcatacatatggtatatgtgaaattgcgattatcaactccagtcaactaacattgtcatcatatccctgatgcttatgcaagaattcccccaaaaagaatgctaaagcaattaaaccaccaccaagtacctaatccgtagtatagaatgtaattcatcctctagtactatgaatctgtatagaagtaggtaggatgtatcatattatattctatattgggttaagggagtatatgtactagcccagttccattccgagtttatgtgttcgtcaccatcaccatgtcaagtcaacatccagccttcaacctttgtaaccaagacgtgcatcgagattgcttgtgatgatcatttcaataatgcaacatacactgctaattactagtaatatttgtgagtgttagatacaccgaatacagcagaaaacaacttcctaggtccccaatgcacaatacataaacaatatacaaactttttcttttctttttgtttttttgagatggaacttaattatctaccacttgctgggtagctagtgagcgccagctcgatcgacaattctcattagatgcatagcagtatagcccatgtatatatatatctatgaatttagatatatcctatttctagatttatagttagaaattggattttttttttggagcgagtataatcgaattgctgaattgataccttgtcaactccttcgatccgatcaatcaaacctgccatagtcatagtgccgtgatcatatatgtatgaactcccccagatatgcgattaatccaactaactattgcctaaattacttgtatattagccatatcattggcataatgctgtcaacctcttagttagttggattgcaaattaaatgggacatggcacgagcaggtaactatacaaaattttcatcgtcatccacgatccaaccaccagctggtgcaaaaccagcagcttgatatataaattcaggcagtagctgcgccattgctggtattagctagcttctctgcagcctcttccattcctagctagcttgtgcaagagctcgcaacaatgtcgtcgtcgtcgtcgtcgttgaaggccttggtggcgttcatgcccgtgcccaccgtcgccgagctcgccgccggcagcaagacgtgggccatcaagtgggcctcgggcgggaactacggcgacttgtcgtccaagaacacggtcgccgtcgccgacagcgtcggtgagtgagcttctccattcctcctccgttcttggcatctgncaacaatggcgtctgagctgatcgatcggcgtgtgtaatgtggcgcagtgttcacgtacgggacgccgcacaccgtcgacgagctgtcggcggcggactacacggcgtgcagcttcgccgccccgctctcgtcggacgccggcggcagcaccaccgtcgtcttcgacaagcccgggacgaggtacttcgcctgttcgtccgggtcgcactgcagcatgggccagaaggtggccatcacggtctccaactcgacggcgccgccgtcgtcgtccaagggcggctcgtcgtcgtacggcgcggcggccggcggcggcgccgagctcgcctccaagctggtggtgggcctcgcagtcggcgccggcgccattcttgcgctctgaacatgaactcgatcgtctctgaattattggcagcatttccgtcgtttgagatctttgcgttgcggtgttcctatttgtgtaatgtgcagtggattcccttttgttatgatcttgttttttgtatgcatattttcttgaatgaatttagtagttatgcttgattacacaaaatcagaacttgtctaatgaaaattttacacagcatcgctagcacttcacaaatttgacttctacatattgtaaaaaaaatatcaaatttgaatttgcatgcttgtgcagtgaaatatcacatattaatccatcctgcaatgacagtttttttttacatttttttaataattatttaaataacatcgcaagaaacgaagggcatctccttaaagggcgaaaaagacttccccatcacaatcataggagtaacagtttgtactttgtaatgcattccatcagagaaccaacattaaaattagcatgccatatatatatacacacaaaaaaaggctgcttctgatgtaagacctcctaacatcccattccagcgacggcgaacataatctaattacaaaagctaactaaccctctctgtccaatgatcagagcaattcaaaagacatggcatcacccatggtgaggaacatcgggtgcataaattaatggtgctaaggctttgtcatcagctatagctgataggactatgtcagtcttgctacgacaaaattcaccagctagctccacaaaaggatcatgagctgccctcatattccgaatagatattggagatcatctatggtgagccgagttgcactgccgccaggtttgtcctcaccaaaagcagattggaccatctttctcttcttctcctggcaagagaacataaaagttgtgttgacaaaaatggagagtaaaaaagaaaacatgcacaagcatggtgacactgtctaaaatgaattgatcaccagtctagctccaaagcatgtccaattatttaacaacccttacaatcgagagaatcgaaaaaaaatgcatgaaattgcctacatgatttcagctactttgtaaaaaaggtaaacctcatattagtttcaagaaaaaaatacatgctaaccagtatacgcaagaatggaaaattttcattttgtagaaatgcatctttaactgatgaagttaaatatgttcagttcatatcctacatccagacgactaatgaagtgcataccatctaaaagaagaaaggctcatgcttttgaaatgaaaatgtaacagccaaaatgatacctgtagagctaaaatccgatcttccactgtgtctttgatagttaagcgggaaacggttacaggacgggtctgaccaattctgtgtgctctatcaactgcctggtcctcagcataagggttccaccatggatcaatcataatcacatggcaagcagctaccatgttgagaccaagatttccagccttaagtgacatgagcatcactctcacctgaagaatgaaatttagttatatttgttgaccatctacatgtaacatcaaaaaaaagaagatagagatgaagggcgtcagaaaagtacctctggatcagtgttgaattctctcactgctgcttctcttaagttgagagacattgcaccatcaagccttctgaattttatacggctgctatccagcgaaagctccagcaagtccagcaagccagtccactgggagaatactatcgccttagaaggggctacttcacttggacttgattccatagtatcactccaagttagagcaggtgtattcacgattgagttaagtatgtcagtggttgccctgatcttagaagatatgtaactgctttcacagattgatggagagccatctgcttctacagaactactagttgttgcaccagactccaatttatcagctatacaaaaccttaacactccaggtgaaaaaactgtttgagcgcttaatttcttcccacaagaaggggagggacagacattctcatcacttgttaagctcttatgcacacactgataacagaaaacatgaccacatgttgctacaacaacatcctcaggtgggtcctgcaaaacgcgcagaaatcaaattaccgtagttatcttagtatccatggagtaacaaacagttcagataaaattaaactactgattgtttaatcacacacacatgacagttcagataaaattaaaccactgattgtttaatcacacacacatgacaatcctgttctgatatccttattttgctttttcataaaagaaactattcgaagataatgtaatactatttttttgcatgtacagtatgtgattagattgcttacactgcatctggaacaaattgcatagtctccttccagctgtccaagcaaatttatcactgtttccttaggaagtttgtttgccacttctacagaaccagtatcaatcaaatctttttcctttcccttcaaaagaagaggatggtcacaagcctgccgaagtcgcagcagcaatacaagaatgtttgcaaaattttctcttatcgtcccagcagaagcatattcctgtagtatgaacatggagtataaacattttgcattgaaatttctgaactactgcaaatattttgaaaaagaaaagtaatcacactgaacatggtaaactattgactagcaaacctacttgtgcttacgaagataaatgtaaaaacttggcttctgttcattaaaagtaaaaccttcacaattgctgtgggcacaatacagctaagtgttcatcggataagacaagagtagaaaacaaaatgtatggagtattgatatggtgctattctaagaccttgcagcaacaactgagttaggaataaatcaaaaccgagcatatctaagttcaaataatgagtatctagagaacggacagtatctatctatgcaccataactgccgatcgctttttcatttaagatctaatagttgacatagtaatgcaatattttcgatagaaaaaaaaagaggcaaaattgaagtggccataccttgaacttttccctagaaccttcttcaagcatcatatagaaagttcgctcctcttttgagaagtctattttgctcagctgaatcgtttttggtggcaattttatgattggttctccatcgattagtgtttctgtatttgaacagtccaaaaaatagattaattagacaacatcagaaccagtgaaaacaaaaaaacagccatatgcactgaaactgaaagcacatcttacaaatttaagatatgcaaccaagtattgaagctgaaaacatcaactcaagcaacatataaataaacagaatgttacggggtactcaatatgattccacccaaaaagatagtactctttcaattatgtttcccaccttcacaaattccagattttcagatgtatttcatgacttccataaaatgctagagatccaagataagaggttgcatttttccaagtaaaagttgattttgccatgatatcgtattatcatatatattagctccagcacacacatatataatgaatgaatcaatatcaatatttttaaattttcatagttgtgagtaataccaacgattattgtcaggaattagtaagcatcagaggcaatgggatgtgggtttcatatagcagataactaaaaggtacaaagttgcagacacatatgcagtcatgattttctattttaccttttgtgcgccgcaacagaactatcttcaagacagcttggagtttcttatatccacgagttgcatctctagaaatttggtattttatcatagagcgaaaggaaccatacacagaatatggttcatacttcaagaaacggaaataactatacagatcatcaattgtattttgtataggagttcctgataaacaccatctccgttttgctctcagtccacaacaggctctagccacttgagtattgtgattctttattgtttgagcttcatcaagcacaactctgaaccatcgcactctggcaagtggtccaccatcaaggtcagcatctgaatttttgggtttctttttcttctttggttcgctgtctttctttcttttattgccaatagaaaatgctggacataacccatatgtttcgctgttcttttcctccatatcctcatcaaagttttgtttgggtacctcattggctacaatagtgtatgtggtgacaacaacatcatattttgtcaactcagttggatctttagtccttgaacctccatgataaaccaaaacagacaatttagaactttcagtaaccttggcagccaactcactagcccactgtctaagaacgctggctggacacaccactagtgttcccgcagttgatctattagcagacctcaaagttgacgaaggcgatggtctcactctagccttcttcttgggttcaactttgacagcatttaccattctatcaacagcagaccccggtagactagcccagggcttcagatctgcggcatcacttgctgcttctgatgatggaaacagtgttgaatcctgtagcatattcacagattcacccttcagttgcttcttgtccatgactatcactacttcatcatcctcatcaaggttagctacagatttcatgctgcccacatcagcagacatgaacttagactgctcaaccctctccttttgtataagggcaatagttgatattgtcttcccaagaccctgcgtcacataaagttatgtccctataagataggggatccagtaaaacaagtaacagttatcaaggtagaaaatagaactaacctgatcgtctgccaaaattccacctgaacaatgtgagctattctccctggaaaccatccaagctaatgctattctctttcaataatgaagaacatagcagtgaacaggatcagtagaataaatagaattatcacacaaccaagattttcaaaatataaactttacctggtgcttaaggagtgatactgacataacaccttcaggcaaattttcttccgttgtttcttgactgatttgctgcacaatatatttttttgttttaaaaaggtataatccacagtaagtacaataaaattgaatcaccacacaattatattctataccttcagggcttcatcatacaccaccctctcatcacggccaaaaagcctcttttctatatttaagtggctctgagtgccaaggccattgactccaaaattgttaacagaattgttgtatggcactgatggaggaaagatcctatgtgagtttagacctccatatgcagagacaccacctgcaagtttcaaacagagagaaaaaaattactaatatcgcattttatactagtaaaactatttttatgtgatcacccatcagaatatttgagggaattatggtacatgaacatcatcattatcagttttaacttttcagttgctattaataggtagcttccaacctgttgacattgcagatgtaggcatctcgattccataggcagaacttgtttgaaaaccattgtacttccaagtggattcttcctcgatcttcttgtcacctaaactcgaatgactgaacggaaatggttgatgcagaacctcatagacatcatctgacaggtttcaaaagggaaaaactttagttgtactaatcgcaagttacagcagtatacttttcaagttaatcaaggatagttctactcaccgtcatcatcatcaattgaaacaccctggccataactaacatatggcttgtagccacttgcaatagcaggtgaagggaacccaattccattatagtgcacagtgttaggcttcacagtggggtgtgtactttcaacattgttacctcctgttagagaaagtggacgagacttgtaactgctgctcatgaaggtatgtggaagagtcctgtattgccaagcactattctgacagtcagtgttgacaccgctgctgctttcaataatgtctgatctattctcagcaggtctatgagaggataaagcatgagtgttgtttaaccagttatcgtcatccagcccgactagtagttctgaactattattgccaaatgctgtgttgtgcaaaaccacctggttaacaccatcattgggatcgtcaaaatcaagattgtcttctgtatctgagtacgggctgaagtactcttcactgtctgaacacaagtcaataatatccatattgtgctagcaaacatgggcatcaactctctgttgtcagatatctgcgatgcttagcttcactaatccccaacaagcctggtcagaccacactatctccagcacactgcaaacaaattatcttgatgaacccacttgaatactatcttctgcaaaataatttgtgaattggaagtcagaagtctgaacaaatgatgcattcagtaatttgcagcagtaactgtggtttaattcttcaaggggcactgcaatagcccagataggaaatacaatttcaacttggtgcatacaagggttgcaaataacacctaaaaatatttttttaaaaaaaacacttttttacatcaagaacaatatttgcctaaaccaggcacagtgatgtgcaataaactgatacataaaactatttaaggaagtaaacactaatgcattcctaggctaagtgtattgatcaaaatgcagcaccctattcaaagaaaatcacaaatgaaagattaactattaatccaagggccaaaattttgaaagaaggaagaattgtcacaacatgaactgagtgtgccatcacgcaagcatcgccttcgacaaggaacggcaaagccaactccacaacaatcaaacaattcgactacaggaatgcacaaccctaatcaagcccacgatcgcttaaaacttccccccaaaaccgcccaatccaccaaaaccctacctaagcgaaatccgcccaaagccaccgccttctcctcctcaaaaatgatccgccgcaatcaaaatctcccgcaaatcgcaacaaccctctcacacctccccgaaacaaaacatctcacaaaagcattccatccatttgaaccaaaaccgctaataaccccaaagaaagaaaccagtcttgcaagagagagtagtaaagaagttacctcctccgaatcgtcgtcgtcggcggcgattatccgttggagggatcgaaggcggcggggagcacacgaatcaaatcaaatcaaaatcaaccaaatttctttttgaggggaactgcgtggagattttatctggttcgtgacggccgcgcggcggccgaatcggaaaaactctctctcgcaaagacgagtgggaaacctgggacttatcaaggcgtcgccggtttctccgggggcgcgctcgtgtgtggctgacgcgtggggcccacgtgccgggccccacgtgtcagtgggcgcgggcgagcgggaaagggtggaaatttcgattggttcgcggcttgaaatcgtcgtggaggtgccttgtgttggaaggaaacgggtcgtgtgtgttttaaattgtttttttctcaacgcaaagtatgatgcggtttcggaagaaattcctcggaaattcagatggccccacctgtcagtggctattgggcgttgcaacgggggctgtcaacccctgaaaaatcgactgatattttgaaaggaggaaacgaataagtaattgcaacggtaaaattatcttgttaccgttcaaagaaaaatctcttgttagcaatagcattcggactaaccatcattatcaacgcccatgatcttagttaattgggcattaacatcggacggtcctggtttactgatcgattttttgctgtgctgcaacttgcaactaagcagatataaacagccacgaggattattaaaaacaatataaaacaagagaggattagagtaataagcccttgtttagttctcaactttctcttgaaacttctagcttttccatcacatcaaaaattttctacactcataaactttcaatttttttcttcaatctttcaattttagtcaaacttctaattttgacgtggaaccaaacacaccctaatatacttattttgcacggactactacaggtcttcaaagatgagcactaagggtatgtttagtttttaaacaaaaattttcacgctgacacatcgaatgtttcgacacatgcatggagtattaaatatagacaaaaacaaaaaccaattacacagttcattaggaaaatgcgagatgaatcttttaagcctaattgcgccatgatttgacaatgtggtgctacagtaaacatttactattgactgattaattaggcttaataaatttgtctcgtaatttataatttattttgttattagactacgtttaatacttcaaatgtgtatttgtataaccgatgtgacatgcatggataaaattttttgccaactaaacaagccctaaacacatgaaccgaagaacacttggaatcaaaatcgttatttatatccaaccaaaatgatcatcaacggcacagaaggctagaccagcttaaaatgcagaaactcaaaactgtagaaataattcacagccatcatagtatttcaaattcagaagaagaaaaatacaacagaaaaaaaaaagaagaaaaaaaatatactccgaagcgacttgctttcacccatgggccggggcgaggcccactgcgaacgggctgggcggcccaaggtacggcatgctcgccgtcggcggcgcggccgacgaagcagaggcgacgccggggaacgcggccacggccggctccgtcagcgggacgccgggcggcgtgtcgccggcgccggaggtggccgggagagggtcgccgccgccgccgccgccgccgtaggccggctggagctggcagtcgggccaccggcagtccggctggaccttccgctcgccccacgtccggtgggccagcccgaagcccaggacgaggcccactacgatgagcgccgccgcgaggcacaggaagatcttggtcgccttccccacgtagcagcacattgcaaagctaagctcgtcgtcttcttcttcttcctcctctccggcgagctcgtccggccaccgctctctcacccacaattcacaaagagcatgcgatgcaacgccgcagccgcactcgcagcagagagcacgagaggggaagagaatgaggctggagagagagagcaatggcgagagggatccagctccaactccaactcgcctcgcgtttttggcggtggtgctggctgtcggctttgcactcgtgcgaggcttcacgtgaaggagagagagagatggggatatagagaggttcgttagtatcacgacctaatcatcatattattaaagtgaaatgatcaccatcggtgactgcatgtttctgaacattttaatctcttttgcagtcagtgcagctcactgttcagttagtcagtgttgtatatatgaacagcagaaaacatactacagtaaagttagaaattcagattatggcaagtctcgtttctgcagtttattccagtaagtcagctctgcatcgatctaactaactcaggtacaaacaatagttgctatcatatcacacctaaacttgtctgctgttagtgataggagatgcactactctgccgacacatctagtaaaaaggtagtaattgattgaaggtaattaactggagtctgggacaagatgataaatgaagtgtacaagttcagaataatgctacagtgggtcttcagagaattggatggtgcaggttatgtggtgagggtccatggtgttggtccaataattctcttacttttatttctcttttgcccttttttccccttagcttttaatactctcattttggatgattgaatagtggagcacaaagatgaaggaaggcctcaagacaaccagtggcatgtccatagttggtcacatgttgcactgggccaaagaccagcttgcattttttgttcattcctaggtgtggttaggtatgcagctttaggttagagccttttatgatgcaaattcttttgattgaaatgcagagcttttgctaagctaatcattaattagtagtaccctgcaacagcaagataacggtacaacctactaacatgatctgcagattttacaatgaataaatcagctgctcgtgacacttgcttacacctggggatgtgcactttctgcggtggctgcagagatcatggcaatttttatagctcatcgtcagagtacgctttggaactacaccatccatcatcatgtgaagtgaaaaggcaaagcactactaggcatgccagatactgtcaacaaatctttttagtctaaactctgaagtctgaaccacatatttttcaactggaaacacatgtaagtaaatttcatagagcatggtaaagccacagctgcagcctgcagaacaaactaccgcaaggcacaagcctatcagttcaaagggacaccattcagagtcacaggagcaaagctagaatgtacacatggacgcatttttccggacctgaccaagaagcacccacggtcacagagaagtttctgaagataaaggcaacatctatatatctattccaccactatatcaggaggagcagtaactccaaaggactcagcagaagcgtccaccatcttcttgacctcatctgggttggcaccaacaatcttgttcaccacctccttgtccttgatgagaaaaaatgtcggcatggccttcactccaagcttggacgaaacactctgcatgcacacggtatatgatatagcagcttggctcagtaaactaatttaatgagcatatatgcatagcagttttgtaacaaatggttatgccatgatattcagtagaaacaattgaacatcaaagatgaaagctccgaagtctaaggacattttctagacaactctatgtgaaattatcagtttaggcatccactttctctactttctattcctcaaaagacacttcgctttcagaattcagaacaactcagagaaaatacgaccatgggatgtattccaaaaatacatgcataaacaacacgtcatgagaccaaaaataggagaatggtttccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaaaagaggtgggggaagaacaaggcaaggaagaaaaaacccacagggtggccttcgttgcttgcttgattgacgaacagatcccatgactcctccttctcaaccttcacaactttggaattgccaacccccttctgctgctggatctccatatggcctaagaagcaagaacagaaccctctccctttcactccgtgttcttggtctcctcctcctccttgctcctttccccaagaccccaacaagaagagaacaaaattatcacagactgtctacaggaaagagaagtggcaatcctcctgaagattagataagcatggggatttatattctaaagctggtgggtcctgccttattttggctggtagtttcttctggagtcagtatcctatgcagtacttcaaaagctatgagcttatatcaaccacataaaagatatgcccaacgggaataagggccgtgatgcagaaagggtagcaaattaatagagagcttatctcctagtggaaaaggaatgcttatcaggtgggtactagctctgaaatggtaacgtattctacatgagctggtcaatttattagcaatacaacaaattgtggatgttagaacatattggagatggtaaattacaaagcgatgtttttgtgttcctagctccttgaaatcggatatatcataaagtatcatcattttgcagagcgcacctactgcaatttccatatatttcttattgcaataatcgaataacaaagaacaataagtttgtattctcccgctctagagtaataagttttgcatgtggcaaccttgcaataacatccagtttaaagctaccaagtgaacaaattagggggatcc

SEQ ID NO: 15171 - DNA, 26226 bp, Oryza sativa
  unsure (1)..(26226): unsure at all n locations
nnnnnnnnnnnnnnnnnnnnnnnnnnnnnnnnnnnnnnnnnnnnnnnnnnnnnnnnnnnctgctctcacttatgaaaaaaaaaacagctttttgagagaggaaaccctctagaagttcccttgttccttcaagcaggccacgagtccagaatacttgaaaaagaaagataacatgatgatttgatatggtgcgagtttaataccaacaaccctatccattggtggtcctaattaaaaaaaaaaggtgatggcaaacagacatgccaaaatcaatcatacaaaaaaagaactaccaaaaagagatttatattccaatcccccattagcttgccaaccatggtgactgtagacggtagatacacaaaacctagaaagaaagggggaaaaaagcaccgatgaattgcaaaaccacacgcaatttctcacagcagtgaaacagaccactgatctacaaagattgaagcgtgcgagctgtgaatcaattggaagtacacgatgtagcatagcgtagcatagcatagcatagcgccattctactcaaaactactacacacgatttacttcgattcgagcatgtgggaagtggtaaaaggagatggaaactacagagggttttaacctgaacccgacaaccaaactccacgcacaccacgcacgcatacggaagaaggatccgaccactccgcgggctggggggcagcaaaaccggggattccggtagggaaggggagcgccgcagtcgcagatgagaagactggtggcggaacgccggaaaaagccgcgtccgaaggcctctgatcttcttgtgatgggctagctggcaatcgcatagtgggggcacctctctcattctcgcttttccttttttttttatttaagaaaatagatttactacttcctccgttctaaaatataatcatttttagaattcatagctaaaagttactgtattttgagacggatatagtcattgaacggattatgcaacggataggagcatatacttgcatataggaataaattaaatattttaaaaaataaatttaataatgacttcctctgtcctaacatggaggatacttccaaatgaatcctagtaatattttgagatagatgaagtagtttaaaataagtgatccggaagaaaatgatctgacacatatattaaatatcttaaaggtgctggattagctatcttaggcctcctccaacaaggatgagtcagctagctcataaatctccacatcagcttttgtatgatgtagaagagagagaagataaggagagagagtgcactatctcttcttcaagagctaagctcctaaacaaaatatgagaggggttgtggaacccaaagcattttgaacaatgtgctatgagacaacctattaaaaaggtaggctttttgctatctcttgtatgaggtggacaagcatgagctagtgcactagctcaaccattgaaggaggccttaaaggtgctagattagctgctctcctagcgatttggagaggcgcatccaatacggtgtggacacgttgtttcgttacagtggtcctgctaccatgggccagctgattgtttggcccagcgaccgacggccttttactggccatcgtggcatcggtggcgcggccttgcgtcgtcgtggtttggctgtatgctcagccatccgcgagccaccgctaccgtcttgacgcgtgcccattctccaacccatgtccggctaggattgagcgaaggctgtgtttctcgtccgctccgcttcagcgaatcggcaccgccgcgtgtcggccatcagcgagacagcgacacctccaaggctccaatgcccagcagcccctctctcatccatggtagtgctctgtcatggtgtacgggaatgacagggttggctgctccactaaaaatacgcgcggagacccccatgaggagcagatcgagggtacctgcatcgctcctttctttctttcattcgaagctggttctgttccttacttcttcctcttagttcctgttttttgtggagacggtactttccctagtcgcatcatcccgtatgctttgatctttttcagttgtgcttcgctctggatttcaccattgtgatgtcgatgttcttctgaccatgcctatgctcattgattttgatttttgttttctgccttctaggttgcgcggccaacccttaccgagacgtggttttactgctcgccgagccatccgcgttgcccccttccacttctcggcatccgctcgtcgtcgtcctctccgcatccgcatctcttcccaatttgtttgttcccctttatgttcttcactgtggctgcacgtacaccaagcttgaatagcatcacatactccccatcccgtcctcagcatcggcgtgccgcatggcatcgcagcgtcgccttcttcttcggcatcaaggtcgactcggtggctcactgctagcacagatggcgggcggggagtggatctttcaattcttcctcagcgacttgcccgacggtgttgctagctgacacaaccatttcctcaatggcagaaatcggcgtacggtctacctgtcctcctccggtacggtttcccttctcttatctctcatctagcataaattgaagataatgttctgaatttaggctaaatttatcagatgtttgtttgggaagttcgttcaaagattcagatagaacccagcacatttccgaatattggtgcctccagatttctctctctatttcttttttaaatgttgccttctgataattcgaactctgcgccaattcctcttatggaaagagagtcgatgtgatgtcatgaggcaaaacatgaactggtgagcttccctgaaacctgttgattccctggcaacattgatgttttattaggatgaattctcacattaatagcttccttccattagggctttcaatgttctaaacttttttttagagaaatcatgttctaaacttttgattggtgaaagaagttacaattactaaggagctctcatcctctcctgcgaatgagattctattcatttttctgttcctgtactttaagcatgtcagtatgccactacttcattgtccaaaactgagctccaaagaaaggtcaaagtggccagcttaggattaaaacaagtttagcagaatcttcttacacaaattatttggtgtttttcagcatacaggtaaacagacggctagacttcatgatacatgctaatgttgggaggggcaagccactatgctcagctcatggatcttcaggaacggagctgccagcatattactgacaaacaaatacaaggtaaataggcagaagagatccttcatgtgctttgctctccgatgttctccgtagagaaaagaaaagttaatcatttcaattatttatttttattcattaattatatgtaattagtaaattgttgtgttgtatatgtgttaccattttgacaaaaaaaagagcactccgattgatcattttctgaaccatacaggaaaaatactccatgcttttgtatgagctgttcttagtctcttatagaatgtgctgtggtcttaatctctgaaggctgagctgtgttagattggagcactccgatccaactcttttgcccaccaaatcaacttaccaatgcctgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggcgccgtctaggagccactcgacgtccgcgcgcgcacctgcacgcgcgtgccggcgagggggcccgcggcggcgccgccatctccgtcgtcgccatctctctctcacacggtgggggttagagacggtggggggagcggagaagagaaaagaaaggagcgccggccatggcgcggcggcgcgaaggtcgccggcgatggcgacgccgtccacgcggtcgcgtgagagagagaagagaagagaagctagggttttcggcggccggccgggagaggggggtttttgatcctccgatctcggcgcccggccgtccgatcgaaaccctagctgatcggacggccggcggcggccggaccgaaatcggcccaagtggggagcgcgcggcggcggctttcccggcccaggcccaggttgcggcctgggggaggggagggggcgcttgcccgcgcgcaaagtggccataggccgaccggcaaaggccggaaaagttcaatttaggtccctcggggccgaaaatgaataaaagagaacagtagcaatttttccattttattttgtcgatttttcatgcaaatttcaatagaattttgaatagatttttgcatgttttacctctgtttaaatttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaagaaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggcgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccaaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagagggccttgaccgcgccctgatcgggggcgcccagcccaatggctggtgggcccccgtcacactgcgccatataaaagaggggtggaggccggcacggcacatggtacgagattcaccgccgccgccaactccaccctacaaaccctaatccgatcgagagggggcgcagccagtgacgggaagcgccaccgccgcgccagacctcatcgccgggacatctacgaccgtcactcccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatgccaagccaattgagtgcagcaaagcacaaacaatatggtctttatagcctgtgcagatatagctcttccattggtgtgttctgccaccacatcacttccaaagttgtttccaagctaaaaatcatgctgcagtggtggttcaatcccacacttgaataattggtgtttcctgcactgatgtagtagtgactgccttttctcacttgcataattgatgtacttcgctcacttttttatcttaacatatttcataatatcatatagattctcctcaaggactgcgacaagattgaagctcatgcttagcaggaaaaccattttttttttacggaaagcaggaaaaccatttgaaatacctatggaaatatccctacacatgtgttaaccatgatgatctttttcttttcgaaatactgtaaggcaggtatatccatcatctttgtcatctacaactgccttagctatacaaatattcaactctcaaagtagtttggtagctaattaatcagacaggtgatgtaaatgtatacatcgtccattgattcacagtggatactcagttgttgcatttaaatgtctcttttcaggaaccataagttcatttacatggctattttaagagtccactgctctgattagtaacataacactgactgaaatgaggatctgttcattaatttgagtttcttctactgactcagtaacatctctccatgtgctgacttaattctccaaactttgagttctactgacttagtaacatctctcaatatgctaagttaattctccaaactattaacttaggaatgatttaacttggcacatattttcttagtgttcaagaaatgattttagcagatgcttgccattgcacctggtgatctaagttgactgaattgctgaggcggatatgtttcttgaacagaaagttctcatagtgaagtgtcaagtctcttcttaaaactaatgaatctgaaatatgtagtcggtctttcataccatagttgataaatgcaatactattgtctcatctgactgggtttttggccagttctagagtttacagatattatcttaatactgcagtcctcgcaaacaaaactacgagaaatttaaccatgttccattttcagttagttgacataacgaactgcatcttgtgcccattgatattggatgagtcatactatgcttgccacccctgctatgtattgtgaaattattgtttaaattattaactatcaggaactgtttctggcgacttcagttattaaaaaaaaaactatacaggttaaataatgttcttagtaggtacacaaggaattgactgttgttgttaggtaatcctcttagacaaaccttgcaatcgtacatttctttctgtgcgttacagtcttacatgctacaataccgcgcagcgtagcgcgcgagctcactctagtaatctaaaaagagtatggcctagtccgttaaccatagtgcatcttgaaatcgattggaagaaggaaaaaaaaaaggcatagtccgttcatttctcattgtgatacagtgatactgattttacctcatttttattagcatgtttttcaaactactagacagtgcattttgtgcaactttcttatatagaagttgttttaaattattagataaattattttttaatatttgaagtaataaacctcaattaatcatgtacctgcagttaatcttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtggcataaccatcattttgatgcaggagccagcagcgaagttctgccgggcaaaagtagtacaccattttggaacccacggttgcatacaaagttactccagaaaatacattgcaatgcagttaatattgctcaaatcagctacaacagaaagaaaacacatgatgcatgcgtgttctcttctgctcacagcgcactagcgcagtgccactctccttcctactgtacaagttacaagaagcaagcggcctcatcagcttcagccaaatgatatccccaatgctgatcgattatcatcacatcatgatggccacagcaacttcagccatagctcagcctggaatcgaaggaccgggcttgtgtgtgccgtcttggtattccgatctcgcaagcatttacccttgaagcgaacctcagtgaacaaatcgtctccccaacggatgatgcctccggagaaatgttgacaaacatcagcgttttggaatcacctccaaggcaaggctgcaatagaaagttgatataagaaatatgtttcaaataaattcagggattgcaggtttttgtattaccatccatttgcacaagtcactcacctgcaaaaggtatgtaagttttgagttcctgaagggcacatgatcgtctcctttcgcaattgcaaagataacatcgctaagagctgacaagcttttattgattgcctgaaacataaagaaaacaaacagataagacaatgtgattatcaaataagaatattgtaaatttgtgatgaacacactcacctgagtttccttcaaacgatcacccgtggagccacttttagcaaggcgttcactgccagctaaatcaatcaagttaaggacaccttggacttgttgcccagtgttctgcattaagatcaaaagaaaattagtgacatacatttgctcaagtttcagtggttctgtttagttagcatgaaaatgaaaaaaaaaatattgtgaccagtttgtaaagtttcagcactgtgattaatattctaaaatatgggtgaagcgagtacctcatttgatccagatatcttcagtgtgaaaacaaaatggctccgggaagattgttcattcatttgggtcctacccacagacctggttcaatgtggtgaaaaaaaatttagactcactgttgatatgtagactaggtggctaacagacacatgtgaattcagataataagtgctagcttgtataaaaggtaaaccctcttatgtttctgctctctctaatatatttgagtgatagatgagagaatcatctagacatatccaaagcattgctatttcaaatataacattaaactgataatggtcaatacccttagagcaaacagttacaaggcacaagtgaatgattaaaaatgaataaagcgtatttacctgctttgggatgctttcgctagaagagaagttacgtcggcgctactaaaaacatcagcaacagtaaggtcagtgacggttgtgttcccttgtggatcatgctttatggtgtattgtttactggtagacagatcaaagttattagaccgaccaggtgctaccaaatcacgaattgtctcattgtatatttccaacattgatgcctgcacataggaaaaactctcagcaacactacatagaatgtacacttcagaatctgcattgcactatggatactaacctgcatactgtacttccatccttgagattcaagagactgacttgtcttaaaaatttgctccaaagaacgaggtatgatgcctttctgatcacgccctggtggacccatcattgtataagttttaccagaccctgtttgaccataagcaaatatgcaaacctgcatcatgcaaaaataacttaagcataccaaattgacaagtacttcaaaactgaaataaactagaaacatcagtcagagtttcaagataatggtgattatacaaatgcagaatgcaggtgatatatactagaaacatcaatgtaagatgttcacggcttttagcatgtatttgtgcttatgtggtggtgctgaagagataaaatttggggtgccaccatatcaattaaaacaactttcatttgttcttgaaataaaaaaaataaagttaggatatttgagttattagagacaggaacctcatgaacagattattcaccaatacttcattgttgtagtgaaatattcataccttgtacccatcaagtgcactttgaactagttgtgacatttccacaaacacatcttcttgtgaagcaccgtgatcgaaaactttgtcatatgagaaggaaaatctctgacctacatcaacacaaaacaataaaatgaagtctccgattaactttaccactgaaaacttagtgggggaaacatagtttctgtttagcttcaacaatgaatatgattttaccttggttcatcaaatcaataccacgcccggcagattcaactgatgttggatatgaaataagggcttcttctgcaccactagaatcgttgtcttgcaaaagtggtcggaccctacaaaacactctgatgtttcctttaagctcctgcaaatagaaaggctaatcagtaacaagtagcaatagcaagatgaaaaaatttcagtatttactcaaaaatttcttctgtcagtaaaatagagaaattgtttttagtaagaagtgctagtatgctgaaacaattaccaatattgtattgtgcagtttctttcgtagcttgtcagcttcaacaatttgaaattctgcggatgccaaacgttcttccagatcttttattatcaccttttgttcttcatatcctgtcatcgcctcaattgcagtaacatcagcaagctgcaaaagtaaacaattagatcaaatgtcatataatcatatctcacatgtaaatcagcactgacaaaatattatttctaaccttcagtttatttgttgcaactgcaagttgtttctgcaaagtttgaatctgttcttgttgcatactacatgtttcctgagcagaagcataatggtgagccaaatagttgcgcacagaaagtattgatttggttaatctgaaaccactaacctcaaaggctgacacttttacactcaagctttcacagtcttttgtagacttgcctgctagttccttgtaattagcaagctcagcactcaaggtatttacttgagaaacagactgatcacggtcttctctaatttggtgtagctcaattctaaggcaatccacttctttcataagttgttctttcattctaatggcctcttgttgagaagtctaacagaaatcaaaacaattaaatgtttaagtgaaacaagaactatactgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggtgttgtactcctgcagtcttttgttcgtgtcttggaccattttcagctagttcacaatttccatccatcagaaaggaacattatatatgactcaaattcatgtaagactaatagaacatttctgaacacgtacttgctcactaaaccgttttgcttcatggctgactctttccaggtccaccgacagcaagtcgagggacgcctcagccgattccctttgctgcctctccttctcgtaggactccacagcaagctgccagtttaaaggtcaacaagtgtaagccgtggctgaaaccaatcacacaggcacacagcaacagtacataactatgcagcttattatgcgatagatgagttctaaccatcctgtcggccttctccttgttgaagctttcctccaacgaatcgcactgccgcgtcaagttcaggtgtgcagctttcagctcttccagatcactgctaagctgggcctctggaagtacagtaccccaagaacataaatgaccagaataaactcagtcactacgatgagatggtactctgatgaccaaacagcacacatgaatgctcaaaacccaaaagagtaccatcttgttctcttggtgtgatcaaataaatacaaaaaaaagagaagtgcattcgaattcattacccaacttggcgtgctgggcattctctgcatccatcgtactacggagcttctcctgctcgaccaagtagccgtcctccaactcaatgtaccagcggatgcaagctctcagcttcttgatgtactcactcatctgctcagttctcccctgcacaggtccaaccaaattcaggaaacccgccccccaaaaattctcaaacagaacgaacgccaagaaatcccccaaaagaacccaccttgtagtcggtcttgctcttccccttcatcttctcggcgagcagccgctccacatcctccctcccggtgaactcgatcacaggcgccgccggcccagccccgccctcgccgccgtccaccgacgccgtgtcgctgttcgtgccaccgccattgttgattgccgagaggacattgcggcgcgggccaggcttgacccccatcccccgccgcgcgttgcccaagttctccttcttctgcaacaacaacaacaacaaccacaccccacaaatcgcaagaactaagctcccatgaatcaaccctcccccaaaataggcgatttctttccacaaaagagagaaaattaccgggtaagggctacggggcgtgagggaggaggccatgaactgggattagtggcaggattaggggttatagttagggttctctcctcctcagtggtggcggtgggtgggaggaggggagctttcttggggccggatggagtgagctcgaaggcacaagaatctctctctctcgtggcttacaagcgccgacaaagccgcgctttagatccgaaaaacctcgagaaaaaaactgcggagccgatgaaattggggaaggattcgaagtttttgaagccaccgagcggagattaccctcgatttttcatggatttctcgcctcgctcggatctgagcgagagatgtgtgggagaagagagagagagaggaaggagaagaagaggacgaggcggccgagctatttcgaaatattttgaacgctgacgcatcaggggtacccaccccacccctccgatttcgatttatttacacccaatgccactggtgttagtttaaagcccaagccggcggtgaccaggtctaagtggctggccggctcgggcagggtcattcgcgtaatatgattggttagtcaggggtattttcggtatttctgttgaacggtcaacttcgatgttgtgggcttcgagattcgcgtcgccttgggccttgctgataatgggccgggccgggccggggcatgttgcgacgttgctctcctcgttttctttgtccttttcgggaatcaacagcttagaggtgccacgtcttgttattaagcttttgacagctttttcttcctgaaatctcaacgaatagttaagctagcttgtcagtcacctcgcgcactggaacctgagaatgatcggacaatcgacgcgatgctaattagaaatttgctgtttgttagtattagtaaattggtgtctcgtctcgtcaagttgcgagattaggtcttaattgccttgtgccttaccggtttaggttgcgttcggtagagcgtattcaaatcttatttgtcttacgcaatacgagaagatcattagtttataattaattaaatacttaattattatagtttctttaaaagactattttaaaaatatatatagagaagttttttacaaacagtataaaaagcgtgtcatcataagccaacagacagtaactgaaaagagcttaggctcccattggttcctctatatagaattaaccgctgtcaaaatttaaattttagagtttattttaatttttttcattgaacatatctctactattataaaaatttaagatgtttttatcggtattttggtacgtcatatgtgtatacgtcagtttttaagtttgtttgcttttaaaaatatgtatccgtatttgattcggtttttaaaatcgtccacttttggtaatacagaagaaatcatataagaaatttgttttaaaaaacttgcatgctaacttgagatgattagactcctaaatatagctcatgattttctaaaaatatataaagcgaactctcacagtgaatttcattttaactaaaacatataacaataataagattaaaatcgacttcacccgttgtaacgtacgggcatttttttctagtatatagaaaaatttaacctataaactattcttttctaacgcgccgtacgacgtattttcgacaattggcccacagacgagggccttaaagatggatttgtgaagggggtttggtgtaatgatgcttggcgtacgttgtcagctagccatttactatttctggtgctttattagttgggggaaaagagcatgaccgctgctgtcccctctcaaagctcctgagttttttcgccttaaaaccacgtttcgtccttgccaaacgtggtccactgaagtgccagtgctttgttgtttgagtaatcgagttataattggtacagtatctgcgagcttaatacagatgtcaccgctgttctggattgcaatcctgttttgattagggagtgtattgattaccttgtactcctacataatggcaccgatagtggcctagcgatgcccagtgatgcgttctcttgcagttcacgcaaaacgtgacaatggtatagtcgatgttagaccggtgtacctcttgccaagatgtatgtacagtagaacgccgtaccagactaccagtttctgctagctaagcgtacgtttctgattaatgatagattctagaaaaagaaaacaggtcccatatcgatcaagcgggctgatttaatactccctccttctcaaaatgtttccgttgacttttttaaatatgtttgtacatgactccatagaacgatgacgacgacgtctgtgctgcaaccagaaaaatacaagagaagaaacagaggaaaataatggccttcgttttctttttcagaaagcggctcgtagtactgtattttagtataatgtatgtacatgtcccagccgacactgctgcgtatacacggtagcggaagattgacggatcgatcggtcgcgggaaggtgacgcggcgcgcgcatgtaagctcgggcgtcgctagctgccgatcgatcggtcgccgtcgatcgccggagcgggggcagacacagggcgctgctgcgtgacggcgacccggggcatgatcgagtcactcgttcgctcgccaccaaacctggctttgtcacggacgggggcgtcggaaaggaccacgcgaccgtgggggaagagcagaatgaattatgtgcgcgcgcagggcgtgccgccgaaaacgaccgcgcagccgtcgcgcgtcgccgcttgccggtgccgcgcgtggcgggtgggtgggaaggaaacgctgcgtgatgtcgcgcttgcgccccccgtcgcacggttgaggtcgtgattttcgcgcgatctcacggagaagtcgtcgtgtcgtctcctacgtacgcgcgacgccggcgggggaagcgctggtccggtgggccggctagccgcgaacgattactagccaactgggcctcgtggttcgcgagaggaagaaggccttctttgtttaggcctatgagctggaaagtctaagctcttaaggtgtgtttagttgagctctggctttgaaaaaaatatctgtgggctgtagttttcttaaacgattttgctatatctcactcgaaaatttttttcttatctctcactcgattttctcattcaaatttacagtgcattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatctttcgaaagatgtataggtactcccttcttaaaagtagctggggaatatgtacggtggcttttggaaaagctcatttggttcaatagctgtggcttttgaaataactagtcccgctgacagcgacccccacatgtcatacacacgttgaaataaaagaagagggagagatggatatggcaacggcggtgtcgtcggcctcagcggtggcagcggcgtctcggcgaggaggagcggtagcggcggttcagcgacgaagaggacgcacggtggtgaggagcggtggcgccaggaggatgaggcagtggtgacgccaccgctgtcggccacctcaccaccttcgtctcccacctccatggccgacgagcgaaggggcggcggcgtcgggaggaggaggcgtcggtcggggaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttgggcggcgtcggttggggaagggcgggggcggcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagcaggttgaaaagtccaaccaaacacacccctagtgtatatttatagttaactattgtataaattaactattagattgactatagattatttgaagcttatagtaggctcttaaccttatgagctggaaagtctaagcttaacaaatatgcagttctttcgtttgtactcatcatcaaaaattatgttgaagaagtttttttttcttacgctagatagagttatgaccctactattaaacttagtacttcaatccattagcctataaatcatataaactaaaaaggcgacttaaaaatccaagaaaaaattccctaaataaagaggctctaagtatatttttcttccctcatctcttgcttctaattgaattgtctccttcaatagtaaaattcggatataataagtttgatcacggttaatttaacacatcagtagaaaatcgattttcaaaccatcaaaggagtcgatttataccggtttttgaagttggagagtgcgatatacccggttttgcggttgattgatgcaatttgaccgaggtctttcaaattagacttattttctttgctagagggaggaaaaatgggccttactggtccaaatttagctagattaatgggccggacgtgtactgtaactggccagcccagtcactcgcatcgtcgactacctcttgccatcggttctcccgggaagttttgcggcggcctagggttttagcattctcacctcagcggcggcggcggcgggggacaccggattttccgctccgatgcctcgtcagcacgcgccggcgttcacgccggaggcggcgtcggcgtcggccaccggcggggccggggagcggcagagcctcccggcgctgcaggcgaagatgaagcgcgacccggaggggtacgaggaggagctccgccagctgcggcgccacttcgagtcatcggtgttcctcttccggcagcaggcggcactggcctccacgtcctcgtccggcggcggaggggaggtggccaaggagctcggcgacctcgcgctgttcctcgcccacgtcgcgcccttctacccggacgacctcgctgacttgcccgaccagattggtggcctgcttgacaccaacgcgcgcgcgctgccgtccgggctccgtgtgcacctcgtgcaggcgctgatactactggtgaatcggaaggtgacgcctgtttagttcatctgttcatttcacattaagttaaattttgttcaaatcgtgtggattggaacgggattatcgtatgactgtagagtaaattctcctcgtatacattgctttttgatgtttagattgttgatctggaggacacaatggagttatttatggagcttcaagttataggggaccgggctgtcaaaaaactagcattctcacatattgtacacagtatcaggagaatgaatcagacccacaagaatgaagccaggaatcgtaaactgcaaaacatccttttcacattcctacaggtttgtgacataccactataccacacttgcactgattagtattatcgggtttaacatagtggcaagaatacattcatgattctcttcctacctcgtttagttatgcatcttgcttcgctgtttcccagggcgaggaagagtcgagagcaaagagggcctttactattctatgtgatcttcaccgtcggagggtctggtttgatgaccgcacagcaaatgctatatgcaatgcttgtttccatggttcttctaggtacatactgccagcatctttgtgtttattaataggtgttgatctaaaatatatcttttacatgcagaattatgatagccgctatttcattccttcttgggtatgaaaacgttgagcaagaagatgatagtgatgcatccagcagtgaagatgaagctcaaaaccctcaaattattcttagtaaagaggatgtttacaaggttatttgaatttttaccattatttcgatttatagtgttttacatcttttttctgttacgtgccttctgatataatgtattttattgtcatattactttctcaggcaaatcacaagggcactgctgctactaagaaaaagaagaaagctaaattgcagcgtgtgattcgtagtatgaaaaggcaacaacgtaaatccactgaggacactggctccaattattattcaccactgacgtatttaaaggatcctcaggtgggaaatggtgtaatcccataattgttcagagtgttatcatttacatattgactgttatattgaagctttcgttttttggctgacagggttttgctgagaagctcttctctcggctccagaaatgcaatgagcggtttgaggttggccccattccttgttctgaagattccttgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaaatatgacaatagaatattatgaaaattttcatctttacgaaatgacagcaaaattagcataatgataatataatagacaattagaaaaaaaaaccgttgcacctcacgtgcattatactagttcatactagttttgataataagttttctacctttctgtgatgcagcctcatcaacgagatgtaacaactttacttgctgcagcagtacaggcttgccatgatatggttgaaacacttttgctcttctcctatatttcactacttatatcatttcttttgctttgtccaaattcagctaaattaatatgcttcaatttcaggtgcctcctgatgcagttgaaccactgtttaagcagatagtaaatcaatttgtgcatgatcgttctcgcccagaggtttgcataacactcatcacatatctaatatatttaagtattttccaactaacatggcatatttctaaccaatctcattttaggctattgctgttggcttgaatgttgtgcgagagatctgcatgagaatacctttggtacttaccttgctcaaatctgtactcttgctttctagtgctactgacctctgaccagacaccccttaaatttgtgtgatggattcattaaatttttatggtggtcatgttttgttgtacctaattcctgtgccctggacatgctctagtagaaattgtgatttcatttttttactagtcttaaatgactggttgcgtagtccaaactccaaaaggatgtgatagtcgattgctacaggttttaagcatataagtgtaacttaatgaagaattgaaaaggtataaacatggttttaccaggccacatttagtcttgtgtagcctgacacgttagtcacttatgcatgagaagttgagaacacacatgcaggtttgtatactacattaccacctgaggtactgtgcgggttgtaagatatttaggaagatattcttggtctatttattttattcatctagcaggcctctgttaatccttctgttatacctgcagttgatgaatgaagatctactccaggaccttgttttatacaaaaagtcccatgaaaaagctgtttccattgccgctcgttctctaattactttattccgggaggtcagttcttatccttttgcatattctgtgatttctttttgttcacttcagctaaaccttcttttggtttgggttcagatctgtccttctctgctagtcaagaaagatcgtgggcgtcctgctgatccgaaggctcgaccaaaagcattcggcgaagcaactatcgcttctgatgtgcctggagctgagttgctagatgaagatttttcatcagaaggggaaggctcagacgatgagtctgatgcttttgattctaatgatgagaaagagttgcaatctgctcgtggtactaaacaaaatttggatggttcgtctgaagcaaacaagcttgacacagatgaaggtatgaaagaggaagatcaactatctggggatgaagatgatacagaggaactagatgaggatcaagacatctctgacaatgatagtgaagaaaatgatgatgagctagaattggactctgatatggatgaggagaatgatgtatctgaatctgatgatgatgaggaactcagtgagaaattggatgattctgatgaaggctctgatcaggatgatgacagtgaccaggatgataagtcaaaaaacagcagtcgcaaggcaaataagagaaagttgagtgattatatagggcaacttaatgctgcagatgcaagccttcgagctctgaagaagttggcaggagccaagaaggctgaagcttcgtgcgatgaagctggtaaaatcttatctgatgaagattttaagcgtattaaggagctaaaggtatgggagttttttccagctgtagttcatgctgtggagctttcttttgggaaagaaagtgaagttgtgtatatctgacattgttatgagtttcaggcaaaaaaagaagcaaaactggctctggcacaacatggactcggcaagggccatgacacaaaatcagtaacctttaaaatgccttcttctgatcagcttagtctgaaacgggttgacccatccaagcttgaggtgcattttctctcttcccctcccgcattgcactcgtgccagcgcgctcatgcacacacatccacactttgcttatatgaacatcttcctttatgtaggctcacataaagagaaagcttacgaaagaggagagattagaaatggtgaaggctggaagagaggatagaggaaaataccaagcaagagaaannnnnnnnnnnnnnnnnnnnnnnnnnnnnnnnnnnnnnnnnnnnnnnnnnnnnnnnn

SEQ ID NO: 15172 - DNA, 2581 bp, Oryza sativa
ccaagcaagaacagctgtgaaacagaaaaaggtattcgtttatatgatcctcctttttggtgcttattttgacctatgttggctatatggcacacaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatggtttcacaaaccgtgtatcatcgatttttcaagtgctggtgtattcttttgtgagtggagagaatgaagccggtatatcatcgctcacagtggttgctctatgaatttggacagtactcgtatccagaaggttcagcatcacgtgtcctcctggcccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatccgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcgatgtcggcggttgagaggaagacggcgtgcgtcaccggcggcaacgggtacatcgcttcggcgctcatcaagatgctgctgcagaagggatgtgctgtcaacacgacagtcagaaaccccggtgagattcttcttcttcagttcataatttcgtgcatactcgtgcatagatttgcagtagcatcagtggttttaacctcgtttttcttttctttttttttttaaaaaggaatttggttttagcctctgaaactgctgctacacattgcaattttgagtcgcagaaaacatggagaagaactcccacttcaaggacttgcacgcacttggtcccctggcggtcttccgcgccgacttggaggaggaaggcagcttcgacgaggcggtcgccggctgtgattacgccttcctcgtcgctgctccggtgaacctcaagtcagagaaccctcaggtattacatagccgtctacaacaatttgattaagtttatagaaaatttaataatatttataacatcaaattagtttcattaaaaataactttgaatgtatttagatggtatgtttggtatatgtgagaaatgttctgtattttttttatgaacttatcataataaaacataattagaaaagagttaaatcatcttatagtataaaacggaggaaggggaaacatattttaagattatctttatggatttagctagatggtggttgccactcctcaagtctcttatggttgccaggccattaatgatactaagtattcctccataaaaatgtctctttgcacttcactcttcattgttggcttatgcttacatttacaagctaacatttaaaatttagaacttaattttaagtttgatctttttctcatcatagtttatttttatttactaataagcgatttaaataagcgaaacaatgctactttctgttgcgatgacacagacacatacacagaatcacatacacgcactccttctgtctcatagaaaccaatcagtactagatgtgacatatcctaatactatgaatctgaatatatctctatccagattcgttatactaaatgtatcataatcagttatagattttttttttgtacgaagggagtagttttgttttttacttggtcagcctgatggtaatgacagaaagaactggtggaagccggtgtacgaggcactctgaacgtgatgaggtcgtgcgtgagagccggcacggtgaggcgcgtggtcctcacatcgtcggcggccgccgtctccggcaggccgctgcaaggcgacggccatgtcctcgacgagtcgtcatggtccgacgtcgactacctcagctcaccagccaacaagacatctcccggaaaggtacccccaaaattacagattttatttaacacaggtcagt

SEQ ID NO: 15173 - DNA, 1555 bp, Oryza sativa
  unsure (1)..(1555): unsure at all n locations
nnnnnnnnnnnnnnnnnnnnnnnnnnnnnnnnnnnnnnnnnnnnnnnnnnnnnnnnnnnnnnnnnnntaatttagaaaaaaatatttaaattcggtcaagatttgtttaaatttcaaacttttttgggtccctgatagatttgtgcatatcgaaaatattaagacatggatgcaatgcaggcgtactcgctttcgaaggttctttcagagaaggaagcgagcagggtcgcggaggagaacggcatcagcctggtgaccgtttgcccggtggtcaccgttggcccggcgccggcagcggaggccaaaccgtgcgtcgccgccgtcctctccttgctctccggtgataactaatcgaatcaagaaccggccggtccatggcaaatgcggcaacgaaaagcaattcctgtgaaatttatttgttcatctcttgattttctttcaggcgaccaggagatgatcagcaccgtgaagctcatggagaaggccaccggcgggctaatgctggtccacgtcgacgacctctgccgcgccgagatattcctcgccgagaagccgccgccggcggcggcggcggcggcggcggaaaggtacatctgctgcggcctcagcgccaccatgctgcagctcgcccgcttcctggcggccaaatacccggagtacaatgtcgacgtcgccgcgtaagatcgagctgatctcactgagtaataattccccatgcgtctccatgatcttatcgagagctctgacgatggtgaactttcatgcagcctcggcgacctcccggagaagccgaggatccgcctctcgtcggagaagctcgccggagaagggttcgagttcaagaacaggacgctggacgagatgtacgatgatgccttcttggagtacggtagagccctcgggattctgccatactgataacgatgttgttcccctcgtatatcatctgtttctctggtggtgattgttagactttgctctaggatcacctaggttagatctagtcgggtggttctatttgggtttgatgaacgacattgtagatgaaagggagagggtttagataccgaccggttgaggagttcgtggaggaagaggcgccggacatcgtcgttgtcgtcgcggcttaacgtggatgcggcgccggtgaggtcgacggtgatgacggctgcggcagtggtggtcgtagacgtcccgacaattaaggcgtggcgcgacggtggcgtttcccgtcactggctgcgccccctctcgatcggattagggttttgtggggtggagttgacggcggcggtgaatctcgtaccatgtgccgtgccggcctccacccctcttttatatggcgcaagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcga

SEQ ID NO: 15174 - DNA, 672 bp, Oryza sativa
  unsure (1)..(672): unsure at all n locations
ttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagaagtcatttccttctgaagaaagggtgtccccagaagatacaaaaactgctgagtccgtttgcaagattttgaggacaatttatcgtgtcattgaagttatttccagccctagctctccgacagcaaatatatattttaacgagatatggaaagtcaggacagttttgcaagaagaagcattaaatgatcacagagaaatagctacagtggctatggtgatgcaggaagcattcaatgagtattggcaaaattcatatttgtggttggccatacctgttgtgctagaccctagattcaaattcagtttcattgagtttcgtctgaaacgagcttttggaacagattcggcaagctacctatctgtaatacgtgaaacagtccgggaactcttcaatgaatactgccattctttgaatcaggcaagtgatgttgtttcaaacagtgnnnnnnnnnnnnnnnnnnnnnnnnnnnnnnnnnnnnnnnnnnnnn

SEQ ID NO: 15175 - DNA, 571 bp, Oryza sativa
aattcgagctcggtacccattcagagaagagaagaaaaaaaaatgaaagctaagctcaggggtcctcagtgatgcacgagaggtgcggttgtcacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccggcggcgccgccggtgctcgtccttctcttggcgtcggggacggaggcggccgggatgaggaagtagatctcgccgcactccagcttcgactccggcgacacgatgtgtatccggcccatcgccccctgctgcgacgagcactgccggctaagcacgtggttggggtgcgccgccagcacctcaccggcggacacagcacggccgtacgcgtcgatgcggccggctcggtgcctagggtttcgctgaggataggcggcggctggggaggagactcaccggggagaggcggcggcgcaactgttgggggg

SEQ ID NO: 15176 - DNA, 5920 bp, Oryza sativa
tactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcatatgtacctcgccgacgactctgtcgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatatactgagtattttaagaatttttattaaattaacaatggtattttaataattttcatccattgtgctagtttgcagcggcgcggcacctcatggtggtgaaaataatgcctatctctactccctccgtcctaaaaaaaacacaacctcgtactctctccgtattttaatttatgacgcggttgactttttgactaacatttgaccattcatcttattaaaaaaatgtatttatcatttattttattgtgacttgatttatcatctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagcggccttctggagatcgctgcgtccgacgatgttatgatcacgcgcttcaccgtccccgccttcgcgcacgatctcatcgcgttgagcgttccattgacggcggcttcaaccaaatctttctgccaccatcaacgtcggaaaaaaaaacgaaatggagagcagtagagcacatcaaagttggatgaacatggattggaaacggacgaaaactagctatctcgtagtcagtagggatcttaattagtggtgccaagtactaccttgtaaaaaaaaataaattcctatatacaatcttagatagacacatgttttcaggtttgtaggtaatattagttttttttttttttaagacgaagggtgtaagcttttcacctcaggattctctgaattgaagttcatcggagcagcgacgaggaaggcgtagtcgcagccggcgacggcatcgtccaagctgccttcttcgccgatgtcagcacggaacaccttcaaggggtcaagtgcctgcaagtccttgagatgggagttcttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgcgccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccttagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaaaaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcggcccgctattgggagccgccaccgacgcctgcctgctgtacagaaactgcagcacgagcacgagcaccagc

SEQ ID NO: 15177 - DNA, 5429 bp, Oryza sativa
  unsure (1)..(5429): unsure at all n locations
cttctcctctcccctccccccggcggcctcctcccccacagcgccgcccgtcgccggctgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttagggcatagttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaactcgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggactatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtgccgtaggtcgaggtcctgctccgacggtaggcacgcgaggccgtggttgcaccggaccagctggaggtacgacgtccatggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgttaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacacagtccacgggaccaactggtgctcccgccagcggtagcccgagcaggtacgacacgttctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtggaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacgaaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacgggatatttttgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaaatatttagtccgaacactcattacagcacaacagcattttatttcctaaatcgatagcattgttacaccatggaatcgcctgctgcgcgacgacgccttggccttgcgcgcctgcttgttgttccttcaccaggtggtcgcctaccctcacttgcctgtccagatggactagcatctgcgccgcttggaacttctgcattctttgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggagatatgccacaatcaccgccagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgtatcggccatggacggaccaattttcttgtatcgatccctaaagtacgcttgcgtgccgtgaaggatgaattcaacaatagcaaccaatggaagtacccgaactcctcgcattannnnnnnnnnnnnnnnnnnnnnnnnnnnnnnnnnnnnnn

SEQ ID NO: 15178 - DNA, 872 bp, Oryza sativa
ccttgagcaacaactctatgtgtccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgctaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaac

SEQ ID NO: 15179 - DNA, 11952 bp, Oryza sativa
  unsure (1)..(11952): unsure at all n locations
aaaaaggctctttgcagcacactctttgttcgatccccaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtccgacacaaatataacgaggggccatgaccgttcaaaagccatttccacataccgtctccaagcagcagtgctgtccatcggcattagttcccaaaaataaccttctgttgcacgactcactacatctgatacggacattgtgtagacttcttggtctattctaaatcctctcaacacccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctacaaatttcgttgacggccgtcgcccgagagcgaacggccgtctgccacgtcatttttgccgccctctgggatggcgatttttaaaaatcgccctcccagagggcggtaggcgactacttccgtcaattttcaaaatgaaaaattatttttgtaaaacttttaataaaaaaattaaaaataaaaaaaaatccactttttcctaattggggctgatgccgagcaggcaggggcagcccatcgcgcgcgctagaaagctagcaagccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggggtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtggcagaagtttttaccggttcttcgtnnnnnnngggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactaccagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatacccctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcaacagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattaccaaataatactctagatcgttatttcagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactaccgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggnnnnnnnnnnnnnnnnnnnnnnnnnnnnnnnnnnnnnnnnnnnnnnnnnnnnnnnnnnn

SEQ ID NO: 15180 - DNA, 933 bp, Oryza sativa
gctcctctccccacccaccctatagacttagggcctgcttgaatagaagccacttatatttctgtgaaatcagtctctcccattcaaatagggcattatgttctaacgagccatttggttctgatcaaggttttgaatatcagtttaaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaagaaagaaaagcacatgatccgcacggatcaaaaagaccaaaaacccttaccctaaattttaacctcgtcgccggacgtcgtcgacgccggcaacgga

SEQ ID NO: 15181 - DNA, 755 bp, Oryza sativa
  unsure (1)..(755): unsure at all n locations
nnnnnnnnnnnnnnnnnnnnnnnnnnnnnnnnnnnnnnnnnnnnnnnnnnnnnnnnnnnnnttcatgacgacagttcagcaaataaactacctctgaccaaaagatttttgaatctgnnnnnnnnnnnnnnnnnnnnnnnnnnnnnnnnnnnnnnnttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatcttttgtatttagatgcaaaggtatgtttgtatccagggagtaaacttattccatgtcacattggatatttggatgctaatttagagttttaaacatagaataattccaagacttattgctaaatgagagttaattcacgag

SEQ ID NO: 15182 - DNA, 680 bp, Oryza sativa
  unsure (1)..(680): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtggatgtacctgcagttgtatgaagccgaagcttcatcaccttccttgctcacacgttcttgctgctgccggtgattgtggcatatctccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccaaagaatgcagaagttccaagcggcgcagatgctagtccatctggacaggcaagtgagggtaggnnnnnnnnnnnnnnnnnnnnnnnnnnnnnnnnnnnnnnnnnnnnnnnnnnnnnnnnnnnnnnnnnnnnnnnnnnn

SEQ ID NO: 15183 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnnnnnnnnnnnnacagtatacaccaaggcaaaaacccccgatgaaaaatttggagacagttttgtcttatctaggattgttttttcgacttgggcataaaaaaccgtaactagatctcctctttgcagcatttaatgacccaacaaaggagttagataaagaacactctatttcatattataaatcgtttaacttttttcatagtcaaacttctttaagtttgaccaagtttatagaaaaatataatagtattttcaacacaaaacaaacatattatcaaaatatattcaatgttagatttaatgaaactaatttgatatttgaaactaattttttctataaatttggtcaaacttaacaaagtttgactatagaaaaagtcaaacgacttataatacgaaacagaaggagtagctgatagcagtgtattactagtaaaaattcatagcaaaccaaaaaggagcaaaagaaggggaaaagtccaaaacacagggtagcatggcatctacaagaaaataaatcagggtacatgtagggaacacatacctaggttcctgagttgttctatagtcccctggccaagagacttatcaagcttaaggagacggagaattccagcagtgatcctccccattgcatcagcttcagatctacaaagcatggtgagatgctctaattcttcttttg

SEQ ID NO: 15184 - DNA, 762 bp, Oryza sativa
  unsure (1)..(762): unsure at all n locations
nnnnnnnnnnnnnnnnnnnnnnnnnnnnnnnnnnnnnnnnnnnnnnnnnnnnnnnnnnnnnnnnnnnnnnnaaatccatatgatatgtcctgaagttcaaaagcactcacgttggcctccccagatattccttccaaaaatctttcaccaccaaaaaacattcgttttgcaccatcatcatctcgttttccatcttcactgctagaagagttaaaccgagcatccgtgaacatgtcaggatgaggtaacagatcaactgacagtgattgccattccaatttctgtgaatttgaaagaagaaatgtgtgtggtcataaatcctttcaagtgtagcatttctcagttcattatgtttccaatagaacagttttttttttaagaaatgtcaatagaacagttagcaacataaataaacattaatcttctggagagaaaaggagagtaccaaaccttaaaaatataaatgaatcctttattgttcgaaaaatcccttgcttctttcagatttacagcctatataaaaggcattctaatcaggtactgaagtgcaatcatttactatatttaatgctaatctaatttgcaagagtacctgccatttttcatttgtagtgtacagtacaagatcacgaaatgtgatagccgctagcggtggtgacctgaaaaggaaagatggaatgaatgttcctgtttgcagaaaaacattgcagggaaaagctacatcatgaaacagatattaataagagaaatgaacaagaactg

SEQ ID NO: 15185 - DNA, 720 bp, Oryza sativa
  unsure (1)..(720): unsure at all n locations
cttctcggcgaggaatatctcggcgcggcagaggtcgtcgacgtggaccagcattagcccgccggtggcctttctccatgagcttcacggtgctgatcatctcctggtcgcctgaaagaaaatcaagagatgaacaaataaatttcacaggaattgcttttcgttgccgcatttgccatggaccggccggttcttgattcgattagttatcaccgaagagcaaggagaggacggcggcgacgcacggtttggcctccgctgcggcccccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtaccttnnnnnnnnnnnnnnnnnnnnnnnnnnnnnnnnnnnnnnnnnnnnnnnnnnnnnnnnnnn

SEQ ID NO: 15186 - DNA, 547 bp, Oryza sativa
tgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggtgttgtactcctgcagtcttttgttcgtgtcttggaccattttcagctagttcacaatttccatccatcagaagggaacattatatatgactcaaattcatgtaggactaatagaacatttttgaacacgtacttgctcactaaaccgttttgcttcatggctgactctttccaggtccaccgacagcaagtcgagggacgcctcagccgattccctttgctgcctctccttctcgtaggactccacagcaagctgccagtttaaaggtcaacaagtgtaagccgtggctgaaacctatcacacaggcacacagcgacagtacataactatgcagcatattatgcgat

SEQ ID NO: 15187 - DNA, 1355 bp, Oryza sativa
  unsure (1)..(1355): unsure at all n locations
nnnnnnnnnnnnnnnnnnnnnnnnnnnnnnnnnnnnnnnnnnnnnnnnnnnnnnnnnaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagccctcgacctgacgggatggggcgaggcgtgcgtcagaccgcctgccgccacctaacccgcgatctgaccggtctgtgactggtcacagaccggataaacgagtgcactgcactgcgctacatgcggtgtgacacgctcagccaaaccgcaattaatgtggttaggtgagccccactgtgctcacctaacccatacaccccgagcgaaaacccacnaggggtcggngcgcctctgccctctgngccgaagggggtgcagcccgaccccatcggggggactaaaaggagggcgaacacatcaccctctggcccgacatcccccaagggtgccaagccacgttgggcatttgtgtctgcctcaaacctctagtcatgatactcccgatcccatgtcaccgacaacctgatttaagtatacatcgacataagaattatatatcggtaatatctacagccgatcaagtagatttagtttttccttactcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcannnnnnnnnnnnnnnnnnnnnnnnnnnnnnnnnnnnnnnnnnnnnnnnnnnnnnnnnn

SEQ ID NO: 15188 - DNA, 12733 bp, Oryza sativa
ccaaacttttgactgcacggcagtccgcgaggtcgtgaagggaagtgttgtggaccgtgcaccacttgccggctgggcgctccctgctgggagcgcccgcctttttctttttgtcgctcgctggcctccccttttgggtggaccgcgaagcgccctcgacggggaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaaccccgcgcctgccccttcagggccatgggaaagaaattcgccatgaccctgtcgtcacccccggcggcctcaatcccggtcgtgtagacctggagaaactcggcggggttgatgctgccgtcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgcccttcgttgcgtgggcagcacttcggtcattacgccggcgctcgatgctggtgcgggcgttctggttcccacgcagatcttccgggtcgaaggagtcgacgaaggagtgacggccgaacggcgaacagcggctgccgctcgtcgtgccctccgtcttgacgacgcggagccggtggtagcagcaccagaggccttggtggcggaggaccgcccaccagcatataggcgctgtcgcgccgtcatgaccaatttggccacgtcgtccagccatcgttgggctggagactccgggtcagggacgacaggcgggtggcgtaagagcgcgcccgtagcttggagcgcgccctggggcgtgctgccgtcgccgtagacgaggaggcgacgctccccatctcgccgttcttttccatcgcccgcgatcggtgaagtcgcggatctttcgaccctctcgagcgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggtgcacacgaaagagcgcaagagctcagaagatcactcgcagagtcccctacctggcgcgccagatgacggagcgtggggctcctcaccgggagaccgcgctggcccccctttgccggttcggccggggaccctgggtgagactttaagctcccaatctgtatgtggaaggttcgcgagaccggaagcacagaagacaccggcgatgtatacaggttcgggccgctgagaagcgtaataccctactcctgtgttttggtggatctgtgtatgaagcagctacaaagtgtgagccaacctctcccttgttctaggttccgaatctggaaaaaatcaatccaagaaaaagctcccccttctctcagtggtcaaggtcctccttttatatcttaaggggataccacatgcaccatttccctcttttttctgtggggatttcccccaccttctcagaaatagacggagatttgcatggttgccgttcgagtcaccttctgatggaacggcccgcacctacctccactttcgccgggagcaggcgcgacgtagaatcatggctgtctgctggcgacatgaccggtgtcagaatggtcacaaatcggtcattcttgtccaccacgcgtcagcttagctatctgcacgttggctctccttcacactacattttgcctgtaatggttaggatgaagcctggcatatatctgatcagggctaacgtgccatctctgggaggtaacacgctagctccagctggggacgagcgcctagaagcccttgacctgaccggattgggcaaggcgtgcgtcagaccgccttgccgccacctaacccgcgatctgaccggtctgtgactggtcacagaccggataaacgagtgcactgcactgcgctacatacggtgtgacacgctcagccaaaccgcaattaatgtggttaggtgagccccactgtgctcacctaacccatacacgcggagcgaaaacccacgaggggtcggggcgcctcggccctcggggccgaggggggtgcagcccgaccccatcggggggactaagaggagggcgaacacatcaccctcgggcccgacgtcccccgagggtgccaggccacgtgggcgattgtgtctgcctcaaacctctagtcatgatactcccgatcccatgtcaccgacaacctgatttaagtatacatcgacataagaattatatatcgttaatatctacagccgatcaagtagatttagtttttccttactcattcacgattgccgatcgatacacagatgacatcggctcggatataaatgatatgtcatcggcatctggccgatcggctatcatttatagatttaaccacggttcttttgtctttatttcttgttgattgcaggatcaaatcaactgacacgctcacacatccgaaggcgagttttggacctgcactggagttaagtagatctcccaggcctcgtgttttctgtcaacagccaccccttctccccaccgaccaccgccctcctccacgctgtccgtcggccgttgcgcctggagggaggagaagagagaggagagagatacaatgaagagagggagatggggagagaggtggaagaagaggattgtgagaatgacatgtggggctcacgtgggccccaccggtcttaattatttttttctaactaacatgtaggctaacagtttttattattttccaaattaaattgccacgtaaatgccacgacaatgccacgttatccaaaaacctaattaaattagccacgtaggtgccacgtcagcgaaaaatgagaacaatgttggtgatggatcttgtttgcactggttttgtaagttgagggacccatcatacctagtttttccagtacaaggacgaaaatcagattcaaattaagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttctcagggaacccttcgaaactacgagcaaacaaagattatcgctggctcatcaggttctctcaagaaatgcatgtgtcgatcgatcagtcacttgaaagttgaaactgaaagtgccagttcgtgtatatgtaccagtcggtttggacgttgtactgagggtattttgctgccgcgaaacgtgcgagcgccatcacggtggtgctgaggctgctgcagatgtacctccccgacgccgactccttctccgcgaggaatatctcggcgcggcagacgtcgtccacgtgaaccaccggaatggagccggtggccgccaggcctttcagggtttttagctgcgcctcatcacctgaaaaagaaacaacgtcaatcgtaacacataatggaagtacatactctcttaattctaaaataaacaaatcaaatataaaatgtgatatatcttgaatctgaacaaataaaagagtagcttcttaaatttgacgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattcttcctcatgtcatctgaatacacaagagtaggatcgtcagatgtgaaactgaactctgaaaattcgtagcgttgtcttgagaattgagatcataaagatttgcatccatcgtttccagcatatgtcactatatcagttggaacatataaagattttctatatggtgcagatagaagaactttttctattgttcatgacgacagttcagcaaataaactacctctgaccaaaagatttttgaatctgaatgggagaaagactgtggccctgtttagatttcatttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatctttgttatttagatgcaaaggtatgtttgtattcagggagtaaactttattccatgtcacattggatatttggatgctaatttagagtattaaacatagaataattacaagactaattgcataaatgagagttaattcacgagacattttttaagcctaatcaattcataattagcacatgtttactatagcatcacatagactaatcatggattaattaggctcaatagattcatctcacgaattagtccagggttatgtaatgagttttgtcattagtctacgtttaatctatctattaatctaaagccagtggttatgccagcttttgattgggccacgtggcgcccctagcttatcaaataaatcatgaattttgtctaaggaaaaaaatacagaagatcaagcaaaatagaaaactacagtgttatgtgataattctaaaagcaagtagtaccttagcagtttcttttaagaaaaagttgtaccttaacaacacagcatccagaacatctagctgttcccacccggtaaaaaaaaaaatcagcttccagaagcttctaactgtacatcacttcgcaataaacatagagactttctagaaccactcaaatataaatcataatttaagataagtctagttaaagtatctagatccatagacttatacatctagattatagtcctttgcaacaacatcactcctagaggcattcaaatatccgatagaagaaaactcagaattattaaaaaaaaaaagggaaatccaataaaaaatatgagcaacagggtcctcagctatcgtatcaccgtgtagcaccaagtcaattgaccatttcaattcctccttttttcagtttccagttaccatcgtatcttatgaaccaagtgtacttcctccactaatataaaatattcccaatctttttcttagagagataagtatggagtgaaaaaactataatgccatttattaaataaaatatagttgaaaaatgacagaatggttagaagtaagacatgaagaaaattaaatcaagaggtgagtgatacgacacgcagtgctcaatttggcaggaccttccagcttttctgtagctaaagctcaacaaagttttttctgctctataaaaaagagagtggagcagactatagtgacctagaaaaatgaggggtggagtgaacacaaagaccgtcaataggccactacttaacttcaaattctacttctagcatttaggagttggatccttccacctaatatttgtggacatcaagagtattatggattattgagagcaagctttgtaagtttacgattttctgtaacttttttttattacaatcactcctttttttaaaaaaatattaatcttctaatatttttttcagagaaccttctattatttaactccacctactttctactttcttaatactttatagtatttaattatatcaaaaatttgttagaaactcaacatctataattaatcgtccaccagaaacatagagaacacacaatcccaaattaacattacaggagattatgctcagaacgatatgcaagagaatacaatatttaatggaacatagaagttgaacgaaatgctaaaaatatcttacaaaattttcatgtttcaaacacacgctaaacaatgtatcgggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgtttggagttttaagattacaatctggaaaaattgtgtttcccagcttcattttttggattttacaattatatcttcttataatctaaatcaaaagctgaactgtttagagcaacttctaattctagaatatactgcagcagctagaagctccccccaaacaggccctttgtgggagctagcttgttgatttgattgctgttgctggtgcttctagctcaccggatagcaaggagaggatgccggggacgctcgtcctcgccaccggcgccggcgctgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttttggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccattggataatgagtggttaagcgaaaacactcgctaattagctcatatggtactagcaggccgaggatatgttcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacgaggaatttatgtttgttgctgtactttgggaagagttcaatttgtctagtgaggtggtctggcgtgcttatcagtaagattttttttaagtactaccgaaaagaaacatgctgacatcatgcactatatccagaatatcaccttattgtaaaataaaaccggtgcggtgcgagttgggtggttgattgagacatgtatagagaattagctaagagttattttaaaaactactaatttttaagaaaaaaatagccatccaataaaatagtctcaagttgtttagatccaagggttattttaagagctatttaatctttaatgcactttctcatggagagagataaagagaaaagacattttttagtgggccccacctgaaatagccctaattagtattcttaagggggatagtttttttggatgtgttattttcaaatagccctgaaatagctcacctatttataacttttagattatttgcagctatttgaaagaggactgaaaagtaacccatgaatctaaacaggtcctgagtcggagcgtcgattacgcacgtcagctgggttaaagtgtcaatatggagtggacaacaagatcgtcatatcacgctctcagcaatggtatgcgtagctggtagagtcaaaggagcatgcgtgcgtctggaccgatggattcatggccgtccatcggcatccaactgacgttaatacggccgtgcgtcatacacgttgtccataagccgatcgagagatgggacggacggtaggtacagtgctactgcaatcgcgccgtgtcgtgtgactatccctgtgcaccgtgttcattggggctgatgccgagcaggcaggggcagcccatcgcgcgcgctagaaagctagcaggccgaggtgggccgcgagcccgcgagggaggagaaaattgcatatgtactactcattaaaaactggcttcgctataatatcattctcaagatgggatttgcccaaacgccactcataatatatgggtattcgctgaaatgccacttcaggttttcttccatttcgaaaatatttttcatcaatttcaatttttctcagactattatgcccctgagactctttcttctcctcggttcaatctagcgagcgtgagaaggtgagaagagaatcggcagcgacaccggcgccgcccaccaccactgcgccaccgctacctcagctccagccgccgcgccgaggtcctccccagctgtgccgctcgtcctagtccgcgcaattgtgccgcctcctcggtgacatacaccatgagtccatgacatacaacctcaattcatgagttcatatatataacttgcaagcggtttaattttcatttaatttcgcatcaagcagagctgccgacttgtttaattttgtatgagcaagttcgttcgctttggttaacccaaacgaactttaaaaagaagttgcaaaatgtttttcgaacatacaagaagatactactagaatagaagtcgctttgtgcttgaaaattatacacagttgttgatttcagaatgtaaaatcggcacatcattgacacaaaatgtgaacaaaaatatttaccaggcaccag

SEQ ID NO: 15189 - DNA, 555 bp, Oryza sativa
  unsure (1)..(555): unsure at all n locations
nnnnnnnnnnnnnnnnnnnnnnnnnnnnnnnnnnnnnnnnnnnnnnnnnnnnnnnnnnnnnnnnncaaacatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccatccgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtatta

SEQ ID NO: 15190 - DNA, 470 bp, Oryza sativa
  unsure (1)..(470): unsure at all n locations
nnnnnnnnnnnnnnnnnnnnnnnnnnnnnnnnnnnnnntttatagtcatcacggatagccgatcttctgactctttcagaccttctaggggcctgcacatttggcacatcctgtacctgaggctcttgatgagtctcctgtactggcacattatctatttgaggttgttgtagctcctcctctggtgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaannnnnnnnnnnnnnnnnnnnnnnnnnnnnnnnnnnnnnnnnnnnnnnnnnnnnnnnnnnnnnnnnnn

SEQ ID NO: 15191 - DNA, 515 bp, Oryza sativa
  unsure (1)..(515): unsure at all n locations
cgaattcgagctcggtacccgacttctccgtgagatcgcgcgaaaatcacgacctcaaccgtgcgacggggggcgcaagcgcgacatcacgcagcgtctcctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatannnnnnnnnnnnnnnnnnnnnnnnnnnnnnnnnnnnnnnnnnnnnnnnnnnnnnnnnnnnnn

SEQ ID NO: 15192 - DNA, 1438 bp, Oryza sativa
  unsure (1)..(1438): unsure at all n locations
nnnnnnnnnnnnnnnnnnnnnnnnnnnnnnnnnnnnnnnnnnnnnnnnnnnnnnnnttctaaaaaaatcaacatgattcataatattagaatatgttatatccggtattaggttgtttaatgcatgaaaagaaattccatcaaacaaccaactctacaacgactcgacgattgttccagattttcattttcattgctgaattgctgaacaggcaacgagtaatgttcgtgtatggcaaacatttgctaattggcactttggcaggtaattaatccgtctttaatttttttacagcctcaaaaactctcgttgataacctgatatatacacacagaacgcgctctttggcaacgctggctatactagcaatcgaaggaataccgcgacgacgacgacgacctgtgccgccgcacgccgttcgccgcctccgccgccgccgccgtacccaggctcctccagtcgtcgtgctgcgcggcgccgttcaccgccgcgcgttccagcagcttggacggcgagacggccgccattctccccgccttggcggcggcggcggccgacgcgccggcgagcatgtcgccgccgccgccgtccctccgcgcctccttctcgaggtgctcgcggtagagctcgtagacgcggtggctgagcatgacctcgaagtccagcacggcgaggagctccagctccagcctgttcatctccgcgttgctcacgccgccgacgcgcgcgaagaacgcgttgttgtggtggctgcacacacgcgcgcgaatggtaattaacccaacagaactgaagtatacagtatactccactaattcagaaactgtttttttttcctcactcgagtggaactacgctcatgcaactaaaaagtcactctcttttttttaaaaaaatatcaacatataacatttcactctagaaacattcaaattaaaattctagttctgacatacaaatagagaaaaacaacacatctaaactgctaatagtacataattttttattgtcatatttataatttttttatttctatatgtaggtcgaattttaaattgtatgtttatagttgatatatcttatcaaaatgttttaattttttatagtgacaggcataaaacgagtgtatgtacataaaagtggtaagaagatttcccaactactaggttactgtcacagtgtaagtactaactaagaagcaactaatcgctgaataaatgcaactaactactaatcgaatgatgacacatggtactagcactaatgatcgattactgacgcgaaaaatgacgttaagctgtattgatcatacgcatgtcagtatcagaagaatacgtacgtagggcaaccacctactgacctgatggccaaaggattaaattgagcatcaagaaaaggatggataaccctcggtcatttccatgccttgcaaagtcta

SEQ ID NO: 15193 - DNA, 6476 bp, Oryza sativa
gcacggcgcgcgccaccatgtccagctccggcggcggcggagccgacgccgtcgccttctgccgcgacatctcgccgcccgctgccgcggcggcgtccatggccatgcacggcatcgacagcgtggagtggcgcgcgttagctcaagctgtagccctgtagctgattcggcttggcgcttttttttttcctctttttggttggcgggggattaaccgcgggaacggacggtggatgatgcggcggcggtggggccgtgcccgtccgatgaagctgtctctcttcgattttaggaacggaattttctgtttcgcgattcagacaacaccagaatggactgttcaacccttatttccgattttgtcggcattccgtgccaaaatcgtgatccgaaatggttttttaggagtggtggacagcatgctcatcctctcccactcaccgctctttgctgtccataattttagcacagtttatcgttaaaaaatatacaacttttaaagcgataaactttaagaaaaaatatgtatatttagtttattgatgtcatattattctcatgtttttttttcatccgttcgtcatcgccacttactgaattctaccgtaatttttccccttaaaaattgcacacttggacacttggttcatttaagtccccctctcatgctctaattacgcgttcaccgctgactgaaatttgggttactagaaggattttgctcacaaacttttgactcttctatcagtcaagaaaaaggaaaacctttcactctacttgttaggcatgcggcatcaaagttttcttggtcagttttggacttgtggttggggctgcacggcctaatcaaagtgtgatccaaatgatggttttatgccatcatgggccagtggtgtcactataaattcaggcctgataagcactagtgttctgaatatcttcagagttcagaggtgaatacccaaaatattcagaaatcagtagtcatgagtttatacttttcagctggaacgaatttgctattgctcgagcaccgaatgtaggatcaactacttcacaatctccagaactccagaagaagtttatcactgaacacagttcatggacaaactacccggtaatccgaagaacaacacctgcaaaaaaaagatgtgaaagatcacatgtcaggttgtcttctccacaccgctttagctcacatggctggagaagcgagcatgtcaacttgggaagtgtgctaatgactccatgaaattaaaagatcggaacggtggggacgaagtaattaagcagatggggggctggtgctttctgacctccggaattcatgtctgaattctgaaaacacaccggacaaatgctccggtctgaaagatgacagccgttttttctctgttccttcctcctcgcttttattatggctttctgcaggatggtgcaggtgactgttggctcaattctggagaacgcttttcttggccattcactggcctgaaactctggatgatttgattggattgacatgatgcattgtatcatatgatggcctacatgctaccttgaactcctcaattgatcagagagaatcagttgcatttgcaaaattctgcaatcttctcatttcaggcttcagagatgctatgggctgcagttgcagtatcctggcataaccaacctgacggtccttaatcgtagaattattgaaaatcttcactttatctgcataaaagaggtgacatgtagggacacggacaggcatagatcactcgctcgctaccttcctttggcataggttaagtcaataatcattgtgattctctgcgatttattctctgcttgaagagttgggtgagtgagaataataaactttgatgttctggccgtgcagatctctctccctttctcacgtgccacggttgttcttggtcccatccaagaatgggctcccactgggaaggaaggaacaaaagttcagatctatgatctatcgatctgtgtttcctcacaacgacagtcacagtaagtcagtaaaaaaatactcaggtaattaattactgtcttaagctgtaaataatttttgtttacccggactgttctgttcctaatcatcatcgagaggaggagttggagatgatgttgtggatttcgaggcgagcagctttaccacgagatgaagcttcgtctagttatagccagcgatttgacagtatgcgaataatgtagagtgtgatgtgttgtaattgcttcaaaattaatttgctttttattgaaggtttcggttaacttttgtgcacactcgccagtgagagtttggagcgtagtaacatggtttggtgatcacttttttgtagggcagtactgagttaattataatatttagaaaaggattaccatgtggaaaagggattatggtacaaccaaactgtgatgagcagtaaggtgtgcaagcgtcggttcggtctactgatgttacaacagcaaacgaggaaaaatcatggccaatcgcttgactaaagttggagagaattaaaacaggagaggaaaacacaaagcttaagacaatagaggagagaacaatgctgtgttctttcgagagagttaccaactcatttttcacgtgcacgattttcaaattactaaacgatgtatttttttaaaaaaagtttctatacgtaagttgcttacattaattcatatttcaaaacaataacaaatacttaattaatcatgttattttaaaaataagttaatatgatttttaaagcaacttacacgctcactatacttcaaattaaaactaattaaagttaaatggtcatgtcttaacatgtccagattttaacatgttttactgccttacacgtccactgtacttcaaattattaaaaccaataaaagttaaacacgggtattgatctcacgagcatcatttacaaaacaatgcgaatctgaacctgtcaaattactacagctttgcaaaaaacaaaacaaaagaaaaaaaaaagataaaaaaggcttaaggcgaaaggaagtctcagacctaaaagagggccccacattttctttcaccttctcttccattccacctctccatctcgccggaatctcacctccgatccggcggcggcgccgccaccgacaccgagaaggggcgtcccctccctccgccaccgcgcgcgcggcacgaagagccaccggagcattcaggggaggggcgttgtagaagcgcgggcggggggaaggcggggatggagtcgatcatagcgcgggcgctggagtacacgctcaagtactggctcaagtccttctcccgcgaccagttcaagctgcagggccgcaccgcgcagctctccaatctcggttgggatccgcttctccggttgaggatgccaatttggtcgcctccgggtgctaactttttttttgggcgtgatttgggtgatgcagatatcaatggcgacgcgttgcacgcgagcctggtgctgcctccgtcgctcgccgtcgagaccgcgcgagtcgggaagctccagatcacggtaatggcgggagccctgacccggtgcctttgtatatgtcagtgtgcttactcttcccggcttctccccctgaaggcttaaggggtgcatttagtgttagatttcttattgtttggtttccaaatttagatgattttcgggagagcattgttttgcactttacttgcgcctctgcgtggtagaaatctgtgatgaacttgtgatttcgctctcatgtgatagattatagctctgggtttgaaacgtttgtgtgggaggctaagtgaatgatgattaggaagcagctatttgtacctgtcttgacaatgccatgaaatttggactcccattaatttttatcatgtggccatacctgtgaaaaatctagagaaataaagctgcccttggtattccttgcgcatctggttattgcaagttttggttgggtggtgatctcaggtaaatttggaaaattaaaatctatactccattagcattgacctcaaagcttcaggcaattattgaatagccattgggtacttgcaacttttggtgataagcttatttcgtttccttgctacagcttccatcagtgtcaaatgtgcaagtagaaccaattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaagggttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatttggggaggccaacgtgagtgcttttgaacttcaggacatatcatatggaactcgatgtttttcttttcagtttctcttgaacttccctctttgtgtgcttggcttacacattgctttgaacatcagatcacagtcaaacgaacagagcaaaacaatcctgttgggcttgaagttcagctgcatattactgaagctctctgtcctgccttaagtgaacctggtatttggttacttttcatgatgcttgatcccttccctttctgaatgctgtttgaagtggtatttgagcttgaatgctattttattcaggtttgcgggcttttcttcggttcatgaccggggtatctgtgtgcctaaacaggggtgatgtggatccaaaagctcaacaggtttgccttttccatcatgcattttaatcactgcattgcatgcagtacagaagtaggatgtttattggttttctttgtgtccttatttcttttctgcttttcttttttgaccagcttgcagaagctgcaggatcttccttggtatccattattgtagatcatatattcctctgcattaaggatgctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataa

SEQ ID NO: 15194 - DNA, 10598 bp, Oryza sativa
  unsure (1)..(10598): unsure at all n locations
nnnnnnnnnnnnnnnnnnnnnnnnnnnnnnnnnnnnnnnnnnnnnnnnnnnnnnnnctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataatatttacattattacaaaggcactttaggcctgacaatcaaaaataaacagcagcggactagcgggcctacggctccatcttcacaggcgctcaactggggtataagccaggactccacctaggacatcttctccaaagcttctcttactgaaggggggaaagatagagcaaggatgagtacaactacagtactcaacaagccacaccgggagatgcacgattaatgcaagggggtacaaggggtaataatataggggttaagttttgcagtaaacagcatttaaaagacacttagttgctcaaagctattttgtaaagacgatcctagagatacacaatattattaatcaagaccgtgaacccacacgaacctgccttaacccaaggcgtacgatgattcagaccgaactggcaacccgacctgggtcccagctcgtcccaagccaatccgggccaaccattccacattttagttgttaagcaagttttaagaattaaaccactaacttgggtacattgctaggcttgcccataatcgagggcgcggctattcgaatagattatactctgatcagaggtgtacatctttacccacaagacacatctttactccgcattccatggccgtggaacccgtcataaagaatgtgacataacccctttacccatcctagccatgacaaaagcaccgacccaacctcgcctacggccagaatcccgggataggtaggctaggattgaacccctagcagcagaacaccggccctgtgccatgacatctcgactaccgagccgcagcccgtgtagccttcatttgccctagagatgtccatcgagccccgatttcgtccatctctatccgtgtcctcttgccaggactagactgagcaccgagttaagccttacccattagacatgtggttagtacagtagtgctttgcaatagaggcccgaagactggtccttacggtggccgaggtgctcctaggaaaaccatgcacctcgagcccaacctaaaaccattttgggaggtttgaatagaggggggaggtgtgtgttcggagacctccggaatgacagaagctacgcgaagcacacaagcaaagctacaaccctgtaaagaagcaataccaatacataaaaagaaagcacatggttctttaggttataacaaacattaagagacttgaacgggtcgattcggagttcgtatggccaaggcatggtcatccgaagtttaatgctgttatatggagatttgcggattattataattaagctttgcaactataaaacatgtgtaagctctagcctggaaaagacaagaaggctgcgctgctgacatgcggaccccacatgtcaacctaagggaccacggtggaccgggtacacagagacagtccacgggtcgacgaaagcggacctcgtgtgttaaccgaggcaagtggccgacaaacggactctactagacaccacgtgggctgcacacgtggaaaccacgcggctaccgagcgggcacactaacacggtcaccacacgcacacacgaacgactaccgacaccggtacacgggtactggggtcgacaaccacacaacgggcacggggcaacaccgaaaggacgaggacggagcaacgagaggagggagtgggccgggaaggagaggagggaggggcggcccgggagaaggaagggagggggagggagctggtccgaggggagaggaggcccgagagagaagggaaaagggagggaggagagaaagactttgggctgaactcggcccaaaggaggaaggaggattatttttagttttctttttaataaactttcttaattgttgttgttgcttaataaatatttccggtgctctgaaaattcaagtaaaaatttgagggctccttttagaccaaggagaatttaacaaaaattctccgggccacattcgaatttttcttgtacgtattttagtgtttgccaatttcttttcgaattttaattaattctattattccttttagagaatgatttttatttcgggatgaatttatcaggacgtgacacctaatataagggattttgacattttgcttgcactgtttgatcactcgtcttattcaaaaaattttggaattattatttattttatttgtgatttactttattatccaaagtactttaagcacaacttttcgttttttatatttgcacaaatttttttgaagaagacgagtggtcaaacgttatatgaaaatagtgaatattccttatattagggggcggaggtagtacgtgcatccttgagtcctttttactggagattatatgcacctggaagttcatcgtaattcacttgctcagttacaatacatactaaattcagtgcattttgttgatgcctataagtatcacatgcattaagcccaacagaatttagttgagtgcattgctaggttaccaaaagatgcatatggtgcaaaataggatacattcacagtttaacttttcgtaagtaagggaatttgtgttctacctgtgctagaatttttgtttgagctatcaaagcaattgaagaacctctgttcgatcctcatgtactgacatgttatttctccagggacacattttctcgtccaccatgcacattgatacagccctctatgcaatctgttccacaagaacctccacctgtgcctgactttggtaagactttatgatacctttgctgagataaatgaattggtcaagtctaacgcctcctattgaattgccaggtcaaaatttttgtcctcaaatccatccatttgagaatcagcaattggaattcacgtcaggaattcctttattttccctctattgtcttcagctcactccttccccattacctccaaagtttgcttcaaaaactgtcatcacatgtgaacctcttatggtgtgtctccttaacattgagagtgaagtaatgctcaccctttttttctgcttaactaaacaccgcccatactttctcattcctaggtaaccctccaggagcaatcctgcttaagaattgcctcattcttggctgatggagttgtggccaaccgcagtgccatattgcctgattcttcaatcaacagtatgtcattttatattaaagaatttgatctctctattccattagatgctgaggaaatcacgaggtacagtggaactaagaatgtttgcccgcaatcatcatttatgggggcaagacttcatgtggaaaatctatacttctgcgagtcaccatcagaaaagtgtctgttgctaaaccttgacaaagatccagcttgcttccttctctgggggtaccaacctgttgatgcaagtcagaggaagtgggctactcgagcttctcatctaagcctctcacttgaaacctctagcacttcgaatgaacagagaacagttaggggctcctctccaagtttgtggaaatgtgttgagctggatgacatccggtttgaggcagctatggttacagctgatggtagccctttgttgattgtgccacccccagagggtgttgtgaggattggtgttgcttttcaacagtttacaaccaatacttcagtagagcagttgttttttgtgttaggtctctacacttattttggccaggttggagaacggatttcaaaggttagcaaaggtaactgctctgcgacaaagacatcagctgacaaacgtgagagaaaactgcctagtgacacagcagtgagcttaactatgaatagtctccaactcaatttcttggaatctttatcatcaaatgacttacaattgcccctggttcagtttggtggtgaggatctgtacctgaaagtttctcatcgcactcttggtggtgcctttgcagttacaactaacttgacatggaaaactgtctcagttaattgtttggaaggagaaagtgctatatttggtgagaatggcactgcagttactggtgaacctaatattttgttgcatgaaaatgggcatcccaatatgagagctgtgttttgggttgaccaccggaataagaaccagtctaaagaagctcgatttattgacatagacatcactcacgtaatgccttatgacatgcgggacatggagtgccatagcttgagtgtatcagctaaggtatctggtgttcgtcttggtggtggaatgagttatactgaatctttgctgcatcgatttggtatccttgggcctgatggtggtccaggggaaggtctcttgaggactctgaaagatttatcctctggtccacttgcgaaactattctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggatctgcggagaaggtgattcacaaaagggcccttccaatagaacgttttacggtatgtagtggattattttcatacttttgcatttctatgtggcacttttattttttatccagttcaattctgagacactatgctgcacttgcaggctggaattgaaggtttacaggcaataaaaccttgcctgagagatcaactaattggaaatgcaacatcaaataatcttcaaacaggcagtgtttttgataacacaagtagcattggtgaccaaggtgtcgatgttgaagcgaccatggtcatttgcgaagatgagattgaaggtcccaagtggacaatggataatgtcaagttttctgtaaaagaaccggtatgaacatcttctgaatatttgtccaaacctctcggaaattaacaactgcttcctgaactagttctgtttgtttgactcggcagattgaggcagttgcaacaaaagaagaattagagcatctcaccatgctttgtagatctgaagctgatgcaatggggaggatcactgctggaattctccgtctccttaagcttgataagtctcttggccaggggactatagaacaactcaggaacctaggtatgtgttccctacatgtaccctgatttattttcttgtagatgccatgctaccctgtgttttggacttttccccttcttttgctcctttttggtttgctatgaatttttactagtaatacactgctatcagctactccttctgtttcgtattataagtcgtttgactttttctatagtcaaactttgttaagtttgaccaaatttatagaaaaaattagtttcaaatatcaaattagtttcattaaatctaacattgaatatattttgataatatgtttgttttgtgttgaaaatactattatatttttctataaacttggtcaaacttaaagaagtttgactatgaaaaaagttaaacgatttataatatgaaatagagtgttctttatctaactcctttgttgggtcattaaatgctgcaaagaggagatctagttacggttttttatgcccaagtcgaaaaaacaatcctagataagacaaaactgtctccaaatttttcatcgggggtttttgccttggtgtatactgtcaacaaatgccacctgggagttattttgatctgatgctttgtgcttcagcaaattatgcagcaatcactattatttggttatatgccattgcttttctttcttgtttatgttactgtatttttatattccctcgtacaatttatgctgttaaaactgattcttttttggaaaatgcttacctacttcattttctcaaaacaattttagattatcttatgaaattgtgatgtcccaggaagcggaggaatcgacaatactttttcacctaggaagttgagcaggcagaacagttttggcagcataggtactcctaggactcctaatctgcactcaactacagatgcaggaacgaaagagttactggaatcaacagttgcttcattacaaatcgaaatcttagaatccaaggccaaatgtacagccctcgtttcccaggcgagcggtgtggaggatcagaaatgcgccgaagacatcaggcaattgaatgacaagctagagagcatgcaatccttggtgacaaaattgagaactttgatctaagttgcacatagttttttgtgtataggttcgtgcagtccaaaacttggaagtggctaatgctgtacttcctcttcattattctttttgtgtacatctttatgttccttggggtgtatacaggtggattctggaataatgagctgacacgcagcaaatataaaattttgtagctggaatgtcacatgtagcactgtgttcaaaacttcaagtgcagtcattaggaataacatttttgtcatctgtatgtgactcatgtagtatcatatgcaaagttttgctgttgtcacatacaccatctttctactggtggactgggtgttttgcgaccaaaatatgtatacataaataattttcaaaaagaacatatgtactaccaatatactctctgttttatattgttttatattataagtcgttttgatttttatcttagttaaacttatttaagtttaaccaaatttgtaggaaaaaaatatagtagcattttcaacaccaaacatactatcaaaatatactaaatgctagatttaataaaactaatttagtcttttatatattactaaattttcttaaaaattaaatcaaacttaaaaagtttgtaaaaaagtcaaaacgacttatagtatgaaaaagaggagcaagtttttcctctgatatctcacttagtactaatatcagcagtgaacctttatttttgtcatgtttcaattttttgtatggatttatcccgtgcaaaaattttagtaatgagaacaagatatgaggggataaatttgtaacaaaaatatttgaagtacaataaacctattggacctagatatatgtttgtatataggtgtattttatcggcatactcaatatacacgaaggcaaatgggtcattttcatgcccctccatattggcaatgtgacatgtcctacatatgctaaattggcaatatgtaaagatttactcttcaatgacattttttgtaatttcatccaaaaagagtggcatctcaatagtctagttgtaaaaatcgaactgaaccaagggtttaaccaaataaaccaaaaccaatgcctagtccgaagatataactgacttgagaaaaatcatttaaacccagatggtttactacataaccgaaagaaaattggggtggcgtagggattgaaccccccacggtcaaggcccatgggttctttcacaaccttacataacccttaaatattttcataccaaaaatgtataaaaaatgaacgcatcgtattttagacctaaccctcaaattttctaatcaaaatagttgggctcgttgctacctctatttgcatacatgcgtgcgcacctgactatttaagttagttgctataatgggtttagaaaacgaaacaaatatatattttatgttgattattaaaccaaaattctttcaataaaatatataattttattattttattattgacccgatggttgaaccggtgaatcggtggattcattcaccggttcgaacaccggtcgggtttagagaggcaattcgccgccggcgcctgcgccgatccccatccgccccgcgagcgagcaaaggcggcgctgccgctcgtcctgctgcttccgacgcatccacatactttgccgccgccgccgccgtctgcgccgatccccccatccatcccgcgagcgagcatcttgctgcttccgccgcatcctggttagcacatcctctttcccatctctccctctctctttttttttatcgaatttgcgttaaccctagcttctgttgcagaaatttggcttaaccttgatgtttgtttgttcccaaaaagtttgggggtgttgaactgaaccccccatgccccatgttagatccgcccatgaatggatcatgattcactccaaaacactatggagcatcctgttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagttttggtgaatgagaacgatccagtttcaccccacgatccggtcaatgatgttattacagagacgcttagtgatataaactcggtaacacccagcggtaacagattcacgtcaaaggtgtggaaggagtttacacctgtctatattgaggggaaactccaggctgcagattgcattcactgccagaagcgcctcagtgcgaataagttcggggggagaagccatctgagtcgacatcttataacctgtgcaggacgacgtggacgtggagggggccaaattcatcagaagggtttattttatccttctagcgtgcctagtttgaagtccagggtgcaagatgagctctcacctgccttgacaaatgggaaggttcagatcgcagaatactctagcaagcttctgagggcaagtagctctggtgactcgacccctaagcccattcgagtggtaccagcagagcattccgtgccgactccagattatacaagcctgatgaaacagaggacctcatttgtgaccactccagctggtcaggaaacatctgatccagacctagtcgggatgatagctttgcatggttatcctttgtcaattgtggagcacgaagaaatgatgagatttgtaaagaaactcaaccctgtggtcaatttagtctctcgcaatgctatggaagaacattgcttgacactatttcagaaggaaaaggaaaatataaagggtaaaattgcacatttttcccgacgtgtctctctgtcagcaagcatctggactcctgatggacctgagacaacagtaaattacctctgtttgacagcacattatattgatgaagactggaaagttcataggataataataaaatttggaatgttttggtccgcgcctgctgatttggaaaggatgatacattgtatggaagcctgtgtcccagagtctgagagcggatcatataatgtcatattggatgccattagagattggaatcttgatcagaagcttttaagcttgacttctgttggtgaagttaggggtgacaccaatacttcattgctaaaggaaatgcttatagagaagaagtgccttcctattggagggacgctattcaatgttgcctgtgtggactatgtccttaacagtattgttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagg

SEQ ID NO: 15195 - DNA, 747 bp, Oryza sativa
  unsure (1)..(747): unsure at all n locations
nnnnnnnnnnnnnnnnnnnnnnnnnnnnnnnnnnnnnnnnnnnnnnnnnnnnnnnnncaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctcctttcacccaaaaacacagtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtacgccgccgtctcaacatgcctacaaagtggtggaaggcctgtcgcacgcaacctgtatagagcaaacttcaaacataagtacaacacaaagcaaagttgagttgaaatgtgaacatacgcgtaccaaagaacgtgacgggggtcgacacgcaaccactcgcgcgacgtgcgtggacggaaggtgcctagctttgcaccctcgactgctgacaggaaccagcg

SEQ ID NO: 15196 - DNA, 577 bp, Oryza sativa
  unsure (1)..(577): unsure at all n locations
tcgagctcggtacccttatattcaggcgctgcagtgaacactgcaccagtaatagcagactgggatgacaaagacagttcaagattcaattcaggcttatacaaagccctcctagaatcacaggcccggttatcaagcctggaagtaccttctttgcccaaagtaaaatgattcaaatccaaatcaatagaagaaccatcatcactacccttagcagaagatatggtgcagccagtacccatgctttgcttgctagattttgagcttgatgagttgcccagccctagtgacaagccatcaaactttgtcgtggtccctctaggcaggttgtatgaactgcaatgagctagcacatcaatttgactagaagctgtaggatgactgactgtgaagatgacagggaacttgcccacataggcattgggatttgaggaatttaagaacgctgaccgcccaagtagggggtccatagctagagattttctcagaaaacaaaacacagccaatttttttgccaagtannnnnnnnnnnnnnnnnnnnnnnnnnnnnnnnnnnnnnnnnnnnnnnnnnnnnnnn

SEQ ID NO: 15197 - DNA, 984 bp, Oryza sativa
attcatcggtgcttttttccccctttctttctaggttttgtgtatctaccgtctacagtcaccatggttggcaagctaatgggggattggaatataaatctctttttggtagttctttttttgtatgattgattttggcatgtctgtttgccatcaccttttttttttaattaggaccaccaatggatagggttgttggtattaaactcgcaccatatcaaatcatcatgttatctttctttttcaagtattctggactcgtggcctgcttgaaggaacaagggaacttctagagggtttcctctctcaaaaagctgttttttttttcataagtgagagcagttaaaccccaaatcttgttgaaacgattaaacttgccaaagctctcctagagactggattaatttctcatggttctgttcagtatcaaagtcttcaactaaaccgtaacactgaacttgagattttttattttttatttatttttctgagtaagagatattttatatgaagttactatgatgtccatcaaatttgaacacatccagacttgtaaatttcttggtctcgtctctacttttagttaacgcagaaaatgacaattcacagttattacttgctttgcaggaattctaggaatggcagcaaactaatcttctaacctcaggcagtccatgtttttgaggtgattctgtgacatgtgtgctaccttaagtaaaacaagctacgttttcccttccgtatggatctcctaatttgttcacttggtagctttaaactggatgttattgcaaggttgccacatgcaaaacttattactctagagcgggagaatacaaacttattgttctttgttattcgattattgcaataagaaatatatggaaattgcagtaggtgcgctctgcaaaatgatgatactttatgatatatccgatttcaaggagctaggaacacaaaaacatcgctttgtaatttaccatc

SEQ ID NO: 15198 - DNA, 548 bp, Oryza sativa
  unsure (1)..(548): unsure at all n locations
ggcgaattcgagctcggtaccctttgtgcattaaccgtgttgtgatgacatgatatatacttggttggtagatttgtcgacgagtgattctcgcggaccggatgagtagagtattgaggtacgttgaaacgaggccctacatagtacgacatcaagcagacaaaagacaaggattatactggttcaggccccttatcaggtaacagttctagtccagtttatatgagattgatgatgatgagaacagattacaaagagagtagtcgaaacagatgacaccgacgagatcgtagtctaaggttttgacaagatctcccggcggcttggctccgtgtacttcggcttcataaactttggtgggtgcgttggtgatggaattcgataccctaaacccctcccagggggtcccttttataccgtggatcatcttgacccccaagaaaggtttgaggatataggacctgtaacggtataacataaattctatcgatnnnnnnnnnnnnnnnnnnnnnnnnnnnnnnnnnnnnnnnnnnnnnnnnnnnnnnnnn

SEQ ID NO: 15199 - DNA, 757 bp, Oryza sativa
  unsure (1)..(757): unsure at all n locations
nnnnnnnnnnnnnnnnnnnnnnnnnnnnnnnnnnnnnnnnnnnnnnnnnnnnnnncttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtttgacgtgtcaataggcacgtttttcataaaagcggatgggaacaaattcactgctgttttacacatacttatttttgcaagagccgtttggttgcgaagctgggtagtaacagcattgtcgtcggcgtcagtagtgcagaatcccgagtgccatgccgtactccacgaaggcatcatcgtacatctcatccaccgtcttgtacatgaactcgaacccttcactggtcagcttctccgacgagaggaggatcgtcggcttctcagggaggccgccgccgagtctgcatgttccgccgccaccgtcggagtcagctcgcaatggacacgcataatctttgagaccagttcatgattttgtcttacgcatcgatgtcaacgttgtggt

SEQ ID NO: 15200 - DNA, 464 bp, Oryza sativa
atctaaacagggccacagtctttctcccattcagattcaaaaatcttttggtcagaggtagtttatttgctgaactgtcgtcatgaacaatagaaaaagttcttctatctgcaccatatagaaaatctttatatgttccaactgatatagtgacatatgctggaaacgatggatgcaaatctttatgatctcaattctcaagacaacgctacgaattttcagagttcagtttcacatctgacgatcctactcttgtgtattcagatgacatgaggaagaattcccatctcaaggggttggaggcactaggcaccttgaaggtcttccgtgccgaccttgacgaagatggcagcttcgatgaagccgtcaacggctgcgattacgccttcctcgtcgccgctccggtgaatctccagtcagagaatcctgaggtgaacagctagcttagctaattaatcgggtac

SEQ ID NO: 15201 - DNA, 719 bp, Oryza sativa
  unsure (1)..(719): unsure at all n locations
nnnnnnnnnnnnnnnnnnnnnnnnnnnnnnnnnnnnnnnnnnnnnnnnnnnnnnnnaagctttcgttttttggctgacagggttttgctgagaagctcttctctcggctccagaaatgcaatgagcggtttgaggttggccccattccttgttctgaagattccttgtctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaatatgacactcgaatattatgaaaattttcatttttacgaaatgaca

SEQ ID NO: 15202 - DNA, 624 bp, Oryza sativa
tgatttaacttcattttaataagaatgttttcaaattactagccagtgcattttgtcacttttttatatagaagttgttttaaattataagataaatatttttttaatatttaaagtaataaccctcaattaatcatgtacctgcagttatctttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtggcataaccatcattttgatgcaggagccagcagcgaagttctgccgggcaaaagtagtacaccattttggaacccacggttgcatacaaagttactccagaaaatacattgcaatgcagttaatattgctcaaatcagctacaacagaaagaaaacacatgatgcatgcgtgttctcttctgctcacagcgcactagcgcagtgccactctccttcctactgtacaagttacaagaagcaagcggcctcatcagcttcagccaaatgatatc

SEQ ID NO: 15203 - DNA, 465 bp, Oryza sativa
cgctagagttggtttatgtgcatctcatatggccagcatgactcacacacccaacttgtagcatatccggatgtccgttcgcaatcatgtcgggtgatcaagccgacggtgttcgcgaggaattatccgttaacaaccttttctcgagtagtccagccatggccggtgctatgagataggtcgtcggtcttcgttggtaggtcgggtgcgataactccgcatttgtcgagaatgttctcgataatagagtgtactcgaccacaaccttctcgagtgctcaattgttcctgaaaaatattttctagaagacaaagacatatagtagataatatcgagtatgtactggacataacgagcagatgtaaatatcagatattatgtagaccgtaaacaagcatgatttatatagaagaagacagagcgagcccccagtgttagatcgtagtcgatttaacatcggggaca

SEQ ID NO: 15204 - DNA, 785 bp, Oryza sativa
tttggatatcatgctcctttgttagcttgggttataacatgattagactttggctaggacttgcttaccatgcttagttcaactagcacacattggggatctcatttaaaacctagactataggtttatatgataatgttggtttaataccaccactctgatgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgtttaatttttacaactgttttcg

SEQ ID NO: 15205 - DNA, 1351 bp, Oryza sativa
aagtttggattttggttaaattgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgtcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaagatgagctcgagcttattagtggcagcttgcgccgtctcttttgtgctgctgtgctcggctgctacgtccccagcatcggctgcagtctacggagttggcggagggctcttgtctatcccttctaatgattccctggctcattgcccctctcgttgcggagatgttggcatcgactaccccttcgggatagcgccgggctgtttccgggaaggcttcgagctcatctgccgcaacaccgccaaaactcctaagctctttctgggtgatggtactactgagatcacagacttgggttataggtatgttttggcccagatatacttcaacattacggtgagaccaggtacggatacctacaacatatcctgggtggccccaacagagggtattactattgatcattacaacacatttta

SEQ ID NO: 15206 - DNA, 551 bp, Oryza sativa
atatatagaaatttctttaaaatatcaattatataaatttattaagtttgtaataatcaaaatttaattaattatgtgccaataatagctttttcgttcttcatcagtttcaaacaccatctaattaggctaggccgatgggtattccgcattgtaattgtcccccttagtcaggccgtctttcggcccatttatctcccactcccccgcgtccgtccctaatattgggccgcgcacgtgcgaagtcattgccgggccaattttcacgggttaggcccatttaagaagagagatcctcctgcttctcccctcccgtgctcccctttcttcccctgcgccctcccaccgggagtccacacccctctactcctcgcccgaaacctcccccttcgtgccggcctccgaccgagaaagcgcggcgtctcccaagccacgcgctcgtgtcgggcgaccgccgcgccctatcctgcaggtacgtgcccctgcttcccccacgttcccctcccgtgcgccgtgcgccggggctctctcgggcttccgggccgagacgg

SEQ ID NO: 15207 - DNA, 342 bp, Oryza sativa
cgaacctcgaatcaggcagcgacgccgagccacgccctcctcaccagcagcaccacgtggtcccaccagtacgctgaatcgatatcgtctcctccccgtcgacaccacgccagcctcgccttgcctcgcctcttctcccctcgattggggcctggtcatctcggcgtcccaaattcgtttcattgcccctcctccgtcgcgcccatctgcgatgccctgttcctcgccgccgctgctccagcacctgtcgtcccacccgctgccgccacagccgagaaaagaaaaggcaaaatttgctacagaacactcaaagattgtggtctttgctgtgagatacccgaa

SEQ ID NO: 15208 - DNA, 480 bp, Oryza sativa
tttttgaaagaataaatagaaactaccaggaacatagatcactgtaccttgttcaacaatttgagaaaccccaacgcaagcttcatggttactctggaggggatgtcctgctggtttattgtggcattcttcttccaacaaaagcttgttattatcaacaaataaatcaacccgtgagattggagattctgatcctttagatggaactaatgaccacaaatcagaacacttctcgtggtcatctgggagtgcctccaaattatgcagagcagcaccagctttgtagtgtgaaaagttttttgaagtccaaactcggtattgtgatgtcttgtcttgaacttcagcttcccaagtcaaattgtattttttaagcatggatgacactcgcttatgaagcctttttgaattgttgtgcccaagacgtttcccaagctacatggaagttacatgaaaacatgagttgctaacttcaagaaatac

SEQ ID NO: 15209 - DNA, 770 bp, Oryza sativa
aacgaaggacaacccacaaattatggaagtggtgtaataaatctggatcaactctgaatttatattgcaatcagttctgcgatctacacttatctatatgatcacacttatctatgtagtacgatttattttatctacaatctgaatggcctcgtaatttctggttcccaattttaagccatttttgcccgaaatcgctaataagcgactagtcgcgcgtgtgagcgcgcgcggcgagttcacccctactacttctagcctaacactgtttctataaacccacgggtctctgttttttgggcttcttcgtgtcgtgggctttcctgaaatgggctaatagccctcccgcgcgcgacacgacagaggaggcggcggtcggcgcgtatgggcgtacggtttcccttttttttgtttttttttccgtatcttttccggttttatttttttccttttttttcttcccgtatatttttgtgtttgtccgttttttaatagtatatgtatgctaaactctgtgtacgtataaatacaaactttatatgcatgtatacaaactttgtatatacgtatgcaaacttttatatacgtatatacaaagtttgtatgtgtattttttggtttttatacatacgtataccaactctgtatacatgtatataaagtttgtatacacatatatatgtttgtatacacttattttttaggttttttatacgtatacacacaaactttatatacatgtgtatatctttttatacattaaaagtgca

SEQ ID NO: 15210 - DNA, 397 bp, Oryza sativa
  unsure (1)..(397): unsure at all n locations
nnnnnnnnnnnnnnnnnnnnnnnnnnnnnnnnnnnnnnnnnnnnnnnnnnnnnnnnnnnaacgttagaaatgctcggctcaataggcccagtaatggccgctccctagtccacaaaacctagtgacgcggcgaaacccaaaaacccttctgcactcgccgccgctcgcaacgaaaatggagcgctcgcctccctcctcctactccgccgccgcggcgggagccacgccgccgacgctctcctccgcgcgctcactaccgccgctggagagcagccactcacggcgtcggcggccaagacccgcctccgccgggagcacgaccccgaccgcgtcgtctccctcttcgaggccatcgacgacgcctccctctcggcctcctccacccgccacgcgctct

SEQ ID NO: 15211 - DNA, 483 bp, Oryza sativa
acagatgggaagttatttgatccagcatcttgtgatgtaaaggatgattctgggaaaccagaaggttgtctacaaggctgttccctgttgcacattgcttgccaatatggccattctataatggcagagcttctgcttctttttggtgcggatattaataagcaagacttccatggacggacaccgttgcaccattgtgtccgaaggaaaaatgatgcacttaccaagcatctgctaaagaggtaggattgaatttctagcagtatggaatatagataattacagctatccttccactgttgccaagctgaagtatcgaactctttacataaaggctattttttttttgtttcattcagcataaaagtacagaatgagacactgaggcatatatgatatgttctggggtcctgacaatgtctttagtaatcttatcaatataaccaaaattgtataaaatcaattggatgacttgttcgccaa

SEQ ID NO: 15212 - DNA, 1315 bp, Oryza sativa
ccaagtgtaacaagcgttactttgctaacccaatgagtacatttctgctatagacagatgcgctaggctctctagtgttagttgatttgtgcatatcgtcactctcaaacgatttatattacagactagttgtacactttgtgattcgttattacaggactgtttatgctgttggtaatcagatttactacaagcccatcaacatagctacggctgtgtttagtttccttcaaacttctaacttttccgtaacataaaatgtttggacacatgcatggagcattaaatgtggaagaaaaaaaaccaattgcacagtttgtatgtaaattgcgagatgaatttttgagcctaattaaacatttgctaataacgaattaattaggcttaatagattcgtctcgcagtttacaggcagaatctgtaatttgttttattattagtctacgtttaatactttaaatacgtgttcgtatacgagagaactaaacaggcatatgataccctacagaggtatctatttttggtcgaatggagggagtagattccagtacagcgagaggtgtggaattgactaaagtcagggttgctccagtctacacgcacgaccggttcacatcgaaattgactcgttgggtgccccggttgtccgggagatgaataatgtcacatacggagaagctgtcagctgtagtcatcgccgaagaacgttctggttaattgcttgcaagtactgtactacctccgtctccatctaatcctaggttatataacatttttggatggaggaagtattatcttagcatgaacacaactgcacaaggcacaaggcacatattatcttagcatgagcacaaagcacatatacctggtcatacatggcatgccgtagtcatgcccttcaagtccaaactgaaagttaatgaaaagcttcggaagattttcagctaaaaatttttctcctgtcattctagctggttgaggtgcacgctttcgatctatgtggacttgcttagctatgtaatctctttctactctcaatttcaaaataaattaacccagtacgagatataatatatcctattgccatgtaaagagatctcgtactaggttaacttatttgggacgaagggattattacagtacatttcagtgtgttacattgatcacacgtggactcggatcaatcaacgccccacatcggtggatgaaatagtaaccatacacaagtatgcttagaaaaatttggcagctctaaaagagtgatacatacacgcgaagaaccagactttgaacatgttcccacctaaattggact

SEQ ID NO: 15213 - DNA, 636 bp, Oryza sativa
  unsure (1)..(636): unsure at all n locations
aaatgcattattaaatgatttttaatcccgaacgaaaatcagggcgttacacgtgctgtatcctccttaaactcggactcttctagataaattttctttaattgatccgactccaccaagaacacaactgctggcgatttgacgattcccatcggctgattccaagactctgaagccgatactaactctagaccgatgattactttgggcttaccaaattctggcgttaacaatatctaaaaacaacattaatatgcttgcgtgtagttatatcttattaataacttcaataaaaaataatatgaatgtgcttcgatactgtataatcatatcctaaacaatgtcaacttagatgaagaatggaagtatattgttagtgaaaatcagctcaccgccatggtcgaacccttaattcacctttaattctatatatggtttttatttataagtgccaatagatcaccgagggtttcgataaagatgtcactctcgttaagttcaggggcaggggtagaatgaaattgagaaggataccacttgcttaatttactctactttagatcaaatttaagttgatgtnnnnnnnnnnnnnnnnnnnnnnnnnnnnnnnnnnnnnnnnnnnnnnnnnnnnnnnnn

SEQ ID NO: 15214 - DNA, 644 bp, Oryza sativa
  unsure (1)..(644): unsure at all n locations
annnnnnnnnnnnnnnnnnnnnnnnnnnnnnnnnnnnnnnnnnnnnnnnnnnnnnnnnatcccccagcgtacttgccaaatgcaacctggattttgttcttcaggacatttaatactccctccgttctaaaaaaaactcaattcctgggtttctgttaggtccgtatctaacgtgttcgtcttatttgaaaaagttatgaaaaaaattaaaaagataagttatgcataaagtattattaatgttttatcatctaacaataatgaaaatactaatcataaaaaaagcattattaagtctttttaggacagagggagtaagtttgatgatgtcgattggcgaatccgctactgtttatttgccgctacacttcgtagtggcaggttcatttatactcggaataagatcactttgactccctcaactgaccaccgaatctaaatcgtatccctcaatcgcaatactagaaatctcgaccccctgaacttgcaaaaccggtgcaatttgactccctcaccggttttgggaggtggtttcgccgatgtagcgccatgtggcgcctatgtggtgatattgaccgagtcttcggtccacgtggcattgacgtggcacttacgtggcattagaattataaaaatgcgtggga

SEQ ID NO: 15215 - DNA, 888 bp, Oryza sativa
  unsure (1)..(888): unsure at all n locations
nnnnnnnnnnnnnnnnnnnnnnnnnnnnnnnnnnnnnnnnnnnnnnnnnnnnnnnnnnnnnaacatacccttgatcttctttcggaagcatagcttcccaaatggaattagtgtagtcatttccaagttcatggaacaagtccattatcactggctcccataccttgacatctaatcgcaaggatcgaacctacatcaaataagtacatcaaaagcaatccttaaatatggaccacactactgctaaatctgaaaatcaaatgatatttgaaatctacaaatcacaaagtcacaagagagtgtattgcaaaattaatgttcttagctctgaccatcttatatgcattagaaaatacaattgaaaggtacaacaagaaacacaaatgagcaaaaatctaaaataaaatagttaatctttccatcaaattatcattaaggtattatatcaagtacatatagcattatcacaagaaactgtgactgataactacatggagttggtaatagatgcataagtatcaggatatgtgaaaatggttttggtagattgttcatgaaaaaaaaaacactttcatacaattatgtttttaatatttctataaatatatagtcagaaaataatgataaaacatgtgaattagatactgtgaattgcctaggttggtaccacagcctggatctcattttaagagtcgaaggttaacagaggttggagtcgatattcttatgatcttatccaagctttctgcttctaatttgatttattaccaccaatccaccattcctttttactcgatgttttggacattgacaaagtttacaacattacattaagccccaatcatttcagtaatgattaatggcaatagcataagcattaaactttaa

SEQ ID NO: 15216 - DNA, 642 bp, Oryza sativa
acacgcacctccactactcctggatattgcatggtatatccaataatacgacgacttaaccttcgtagacagtgttattcatgcttccatcaccatttatccatggcaatattgggtgatatatatgcctttcgcaagcatgacaacaatcactgcccctgttgtcttgtgctggagtaaacgaccttttctgacctacaggactttgatagcgtatctgaggagagcttgacttgctttggacattaagaaccgtcacagtgtgcccgtcaccaagcatttttacactcccttgcacatcactagacattgcatgcttctctctcagtagattttctgtatctccagtctcggccatctcaaaagcagaagctcgcaaacaactgcaatgacttgaatctgcaagtgtagttatatgatattttgacttatgtatagagtcaacaatctgcacaccatcatatgcattgacctgtgaagcaagaaaatagagtgacacctatatatgagtagggaaataaaaaaatgtggacaagaaagcagcagtaagtgtagcatcttatatgcaagtattccactcttaatcagtttgacataaatatttaactatcccaatgatgttttaaatgtttatataaaatt

SEQ ID NO: 15217 - DNA, 487 bp, Oryza sativa
cttacatttaaatgctgcaaaggttgaagtggttatttggcatctctactgtcattctgtttgtgctgatattaggaagaatcatttggccttagtggcatatatacattgaaccctattaggaatgatattgtacctctctaagacaaagggaatgatattatatgctcaatttttggtacttagtcagtatagttaagctttatgttttttttttaaagtgtgcttgcaatttaaggcagcatttttcaactgttcatctactttcctcctattttacaggtaactggagatggaacaaagccatacactctttctgggaaattcttttttaatgcttcgaattcacccttcccatttggttcagggaaaaaagcttctgaattttctcaatgggtagggcagcaaaagaataccatggatgatggagtttgtttgtatccagatctacaatgtggggaaattgtccagctcttttctcttgttt

SEQ ID NO: 15218 - DNA, 623 bp, Oryza sativa
tactgggcagcaatgaagagagcaatggagatgttttgcaagaagatggggcttttggtgtaaatgacaaaaatgatatatctattcatgattatcttccagcaatgaaagccatatgcgataaactagaagaagctagtggaaaggtcaactgttccttcttttcttttccatttggtattctcctggattttattttttctctatagttttctaactctctgctattatttcatcgatagactcttgttgtttcggatataaaagtagatctcaattacaggatgacatatgggcacagagcatggagaaatgtaagtttgctcagaatcacttactgcatatgctctctagtttctgctcttctggttttcctccttatagggtattactgagacactgtttgcttaggtactgcataggctaagagacgcacaacttattgaagaatttgatgccaaagttgatgataaggtgacattaatctttcctcctgttctgttggcattttcaattaataatgtatgctctattcagtaatagttttgggcttgtcagtgcttcctgtcaggaactggaaattagaaaagactttataaattaccatgtccatatgtacccct

SEQ ID NO: 15219 - DNA, 582 bp, Oryza sativa
  unsure (1)..(582): unsure at all n locations
tccttctttaaaaaaaaaacagagagaatggttacctggacatcatcaacatccacatagaggaacagtatctcagggtgtgtctgagctagctcctcaaacttgtagttcatggacagcgaagtcacacaccatgaagccccaaagtgggcaacaacctacacaaagtcgaggggtcaataaccaagttaacttctgagtgagtaaaaagaaatttctggtgcaactgcagcggataattatcatcaggaaaattttcaatttggaactcagtttgtcaattacagttacagtgaaagaaaaacgagaaagacccagaaagaacgaaaagaacatgattacagaaatcaggttgcatgaagcatccatccccacaaactattatacatatatcgttctaacaaaattataatctacaaacagcaattacaaaaatcgtgggccgaccaaaatatgacttgagaataaacaacatcaatattcatcatgagagacaaagcaggaaagatgtgggggaagcccggcgaaaaaaannnnnnnnnnnnnnnnnnnnnnnnnnnnnnnnnnnnnnnnnnnnnnnnn

SEQ ID NO: 15220 - DNA, 282 bp, Oryza sativa
ctgttcaatgccattaaattttggtagataaatataactattttgccatgtgttgactaactgttggcacttatcttttgatgatgttaacattatcatctagttgctgtattttgtgtgtggtttttgccaatctttaacctttcttttgcaggttagctgaagctcttgacatgcagccccccgtgatgccagatgatggaaacacaactagagttactacaggaagtgatgtagccccgtctactgcaaaagaaccgtctgcactggaacctatttggg

SEQ ID NO: 15221 - DNA, 561 bp, Oryza sativa
ctatagcattcttgacttaactcagacttgaaatttccaatgggatattctgtcttgcactgaaatggatcagtttcattatggtaggtgaatataatcagtgtagctaaggaaggtgttctatcatttagaaatgttaatgctaataatttcattcacacgttcaagataggttagctttattatcttctacagatgagttggaagatctctcttttaatctgatagtgccaatgaatatatttcatacattaatggcattggcatcagacatgttcattgtgtgtggaaaaactaagtttgctcctttctcctatctattttcttcttgatgtgtatgcagaataaacgagtttaatgatgctattcttttcattgaaaagcctaaacctactgatgctttttcaataaaggaaaggtacatacagacaaaggtaaattattctgtccatcctttttatgctgaacctagcaatgctttcttgatattgatgtatatccttgttagtcatgtgctagttgaagattgaattccaatgtaacccttgccttttattttat

SEQ ID NO: 15222 - DNA, 742 bp, Oryza sativa
tcgtgttacttatgtgacctagctagaactatatgcttagccatgcttaattaccactagctcagtcgatgggataattgcagtattagacattctagtatcttgttgagccgcgtgctcgagacatctggccatgttttgtggtttaattatccaactaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtg

SEQ ID NO: 15223 - DNA, 1264 bp, Oryza sativa
agttctaggatcgcgttacaaaatagctttgagcaactaaacgtctttaaatgctgtttactgcaaccctaacccctttatggtaattcccttgtactcccttgcatttattctgcatttgtgggtgggtcttgttgagtacggtggttgtactcagtcttgctcaatttttcccaagcccataagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcaatattttcaaaaataaaaatcctttgttatttgtgaaaactgtctagtctctctctatcttgctgcttcatttatcgccaaaatctgacctttaaaatgttgtcttttctttttgtttttgtttgtagatggccggcagcgtcacccgtcgtggtttgcacatgactggcttcgtcttggagctgcgaggcatgtgcgtggtcttggggtatccacatggagtggactaccaggccaggccgcttccggagcaggagggtgacgatgcagagccccacgctggttgggaggtcactgcagtgatcctctctggctctcccgagcggacttcgctggcagtcaccgcgggtggagattccttccccgccgcttgccagaacgtcgctctcctcgccatcggcactcttcaccagcgctacccggacgagttgcagcactcgccctaccgctaccaccctcgtcgcggaggagcccgcgactacgccacctttcgggatgctagctcggaggatgacgctaccatcgtgcacctggcgcgcatggtggaggcgtacgacgcggctcgcatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccaaggagaggtcttgccgcccaagcgtcggcgcgtctgccgcagccagaagatcaccgc

SEQ ID NO: 15224 - DNA, 1000 bp, Oryza sativa
ttagctcgccgccgctgtgggctttctcaagccgcgccgccgcgccgcttcaaatgtcgccgccgtttcccgtcccccccgttaggtgccccgtggtgagggaaacctcggccgcccgtcccctttcgccgccaaccaccgaagctccaccgtcgccgtcaagccgagccgccgccgccgtccttttcgtcgccggccatcatcgttcgtcgttgtcgttgtggtgagtaccgttgggttcgcctcgtcgtcctctacgtgtacatgccctccaaatccccggccaaggtctctatctccggcgagctcgcaaaccctagccagctgccgtggggtgacgtcatgctgacgtcatcatctccttcttttttctttttttccaattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccagttaattattggccgaagatggctttattttcctaggggttataatttgactagcatgaaccttatatattggtttggttcagctaaatgctatatataggtttgcttagccatgcttagaaacattagctaacttaagggattaattataaactatgttatattattattaataatgatgattgtattaaatggtagctcacgatggtaaatcgtgtgatgttaattaattgataattaaaacctggttaaggtgggttgtg

SEQ ID NO: 15225 - DNA, 1098 bp, Oryza sativa
  unsure (1)..(1098): unsure at all n locations
nnnnnnnnnnnnnnnnnnnnnnnnnnnnnnnnnnnnnnnnnnnnnnnnnnnnnnnctttttctttattagtaaaacacaatttatcttctaaaattcataagtaattcatccgagctccgtttaagtctatttaagtctcagtaaatcaagaaaaatgcaaagaatccattaaaaatggttttgtttcctgtttcagtagtcttatagcatgtttggcttgtgtgctttgtttgtcgcgtagatttcggccgtttcgtcgatccgcggtttctcgaagacgttgctgaggtctcatcagtgcgagagcaaggcaagtcatgcattacaattgatcatattgtacccaatttacaaatatcccgtatttctattaaatgttgcattcttttacaacgtcacgtgggatgggtcttattacttagccatttattgtttaccttatgccattgataacttgggtatcaaaatgactagatgttggtttagaaattgcttagccacgcctagctgaactagtacacaaatggggatcacattattacatagactttgactatgagcatagttttggattggtgccaccacaatggtgttagctaattaaaatgcactgaatggtgggctgtgggtgcatggttttgctggtcgcacccatggcagttaaggaccgggtcacgggaaaccctgggagacttaccgtgcttaccacaagcgggagtgagtaactgcttgatctgaggtatagctcgaccctttcctaggcaccggtggcaagggtgagcgtgatggagttgggtcggccagggtgtccggttgtccagctgccggattcaccggggcgcaagaggggaccgcccacttgcctttgaggggtgggggtgaaaccttagcgtggtgtggattgttagggaagggttatgcgaagggtcttgtcacgatttccccctttgcagtatcatggtgatacttcggggcatggtgacatgtgtggaatcgtgtcttatgggtatagttgtacacctctggccagagtaaaactattcgaatagccgtgcccgcggttatgggcgatcaaccagattcaccgtgattagtct

SEQ ID NO: 15226 - DNA, 529 bp, Oryza sativa
tagaatcttttcttatatctgcaagccctacattggggtagagcccttccttgatctctaccgcttttactatgacttgcgtcggatggaacccaacagtgtatctggatgtgtcggattccgacttcgggattgcctgaagtcgcgttacatccccttccagtgcccctcttcttgcagcaaatggcgggcgagatggttctatcttcagatagaaaactcggatcccgtccttgttgtccctgaagaacaactagacaaaatcccagagtggactgccaaacccgccctgactccctctctccggtctttcatcgacatcatcgatgacctctgaacacaggggttgccagggtacgaagtcgttgccgactttgtaggtaggcggatccaaccgctccaggcctgcgcccatccagcctttgactactctgtgccagaggacgcgatccgagtttctcctcggggtattttttcttgtatttcgaattttactccgagtgcgtctgtttctcctgacttaccgagt

SEQ ID NO: 15227 - DNA, 702 bp, Oryza sativa
ctcagtcctgcctgcctgtcccgggggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaactaaaatgtggagtggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaatgctgctttctgcaaaacttaacccctatattattaccccttgtacccccttgcattaatcatgcatctgccggtgtggcttgctgagtactggggttgtactcattcttgctctatctttctcccccctttaataagaaaagctttggagaagatgtcttacgtggagtcctggcttatacccccattgaacgcctgtgaagatggagccgtaggcccgctagtcc

SEQ ID NO: 15228 - DNA, 1139 bp, Oryza sativa
tctaaaccaacatcttagtcattttgatacccaagttatcaatggcattaggtaaacaataaatggctaagtaataagacccatcccacgtgacgttgtaaaagaatgcaacatttaatagaaatacgggatatttgtaaattgggtacaatatgatcaattgtaatgcatgacttgccttgctctcgcactgatgagacctcaaaacgtcttcgagaaaccgcggatcgacgaaaaagccgaaatctacgcgacaaacaaagcacacaagccaaacatgctataagactactgaaacaggaaacaaaaccatttttaatggattctttgcatttttcttgatttactgagacttaaatagacttaaacggagctcggatgaattacttatgaattttagaagataaattgtgttttactaataaagaaaaagtccttaattttttattgcgcaataaatacccagggctgacgtcatcaaaagggggggcgccgacaggcgggctccgcgtgtcagcggctcaaaaaaaagggagggggccccggcaagtgggccccatgggtcagcggcacaaggcggccggtccaccgtggaccgggaccacgcggggtgtccaccgccggtccacgagaccgatgatccagatcggtcgggaggccgatcggacggtgcgggcggtggctaggcatagctcggcccggcacaaagccggccgggggatcctctagagcggcaacggcacacgaccaccaacggtgactggcggcgcgggtagacggcgtcggacggcgcacaagccggcggcgaacggccggagcggcggcacggccaaagccggcggcgcacgcgtgaaggggagaaaagggaggggggaggcgtcagccgggctcggctcggccccaaggccgaccggccgaccgaggcgaggcggcggcgaggcacggccaccgacggcggtgaccggcggcgcgcgaagcggcggcgacggccgaatggtggcggcgcatggccgaagcgcggcgacgcacgtgcggagggcggcggcgtgcacgggagagagaggaaaggaaggaggagagagaggtagtcctcaccggcgatgcgagggaatcggggttcggcggcggcggacggaaag

SEQ ID NO: 15229 - DNA, 814 bp, Oryza sativa
cttcagtcaaagaattacataagctggtgcaattggggggcctgctccaacaggttcacctcactcaaaatgtctatgacatagtctgaaatgggactgaatctcgaactatacaaccaaaagtgcctacttataccaatttgttggttcatacactacaagcgattttacctcactctggaaagcccgggctgagcctaaaattgaatttttcgggtggcttgtcctccatcaaagaactttgacggctcaaaacttgctcataagacattggccgtgtgattggatttgctgcttgtgtacctccgccttcgaagacaccaatcatctgttcgcggaatgcccgtttatgagacaagtatggtctacagtacattcgtggcaaaacctgcccccggttttcaattcccttccatcctgtgtctctacctgctgctgggatgagcttaaggatgcaggaacagaagataaaaaattactcgctcgaggtgctatcctgacaacttggtggaacgtttggctagaaagaaatagtagaatcttccaaaatttatctagttcggagttgtcagtagcttatcgggtaaaacaagacttggatttgcgcaaagtggctttctggccaccctaattgtcttttgttgtaacgtttcccaggccttcctgggtgatttttttttgactcccttaaattaaattccggcaggtcttctgccatcgttcacctcaaataaaaatatgctgatgatactcttattttaatggaagcttcagcaccatagctctttgctctgaagggggatcctctagagtc

SEQ ID NO: 15230 - DNA, 3354 bp, Oryza sativa
taccctttcatactcgcaaataataaaagattacagaggtagatagttcctctcaaaaaaaaatttcattctacatttccggtgctctgaaaattcaagtaaaatttgagggctccttttagaccaaggagaatttaacaaaaattctccgggccacatttgaatttttcttgcacgtattttagtgtttgccaatttcttttcgaattttaattaattctattattccttttaaagaatgatttttaatttcgggatgaatttatcaggacgtgacaaatccaccccccttacaagaatctcgtccccgagattcgaggaggctagcaagaagataggttgggcggtcttctcttcttgtctaacttcttccgctccgtcttctataacaaacttgcctaacaaaacttctccactctggactgcttggctcgatctcctgttgcagatggaatcttctcttcacctgacttttccctggttgtacctctagctgacttcgactgggatgcggcattggaagatggggcttcagttccagaacttcttataactcgtatctttggagtcaacctcatacaagttaccacttcatgtcatgcgtcaacactagcttgtcattactaggataccatgtttgtcatcatttagcattcaaagtattcctttacacattcagccctgacgtattctttttagatttctcttatcaatcacctttcgacctacttctttgcctggtaataaacatctttttcgatatctcctatcagtcatcttttgacctttgtcactaagtactcttcactccgagagttgtggatgcttctggtgacgaggtggtacttgagcctgctgcctttcagagaaaccttcaagtgattcgttcaaaagctagactggcggttgttgcctttgatccaaagaagacacatctgaaactcttagtccaaacaaaagtctctttggctttttaatctaacacaggtcgcttcactttcttttctatcaacaactaggttacttgatttatcatagattatgagcttacggatatgagaccctaggtctcccttgtcagtaaacaattatacacataatcccatatcagcatcttccgaaataatcctcatagcacttgtttttattacacatgtctcccttattacatgaatgcaaggcctggccttaaacaaaaagggaaggtgcttaacatcggtacattgcatcctccacatgaatcttccataaacataacaaactcattgtttataatcatgaatgtatttatttattacatgattgctgcaaactcccgattacacaatgataagtagcgaactgaaaatcacaaacgtggctgctcattttgattctggagagatatagctcgcattgttctagtgactgcatccttgattggttctgtgatgatgtggtaggactgcgtattgctatcattcacaggagaagcttccttctgattgctgtttgaagtggatgacggttttctgcttggtatcgccctcctgaggttgattgccctttgcttggcctggagtaggtcggggagagacacaacttcttccatcgacgacaattctttgctgaggctgtcggtgcagagaatggttggtgctgaaggtattatcgctatgatttactgcagagtcaggtgcagcaggaggagcattggtgctgtggatgatatcgtcgatgttgctgttggagctgactagctgatgagacaatcgtagggttgttcgttggatttctacggtcttggtcaacaacacactgagttggcaatccttgggcacatggtttgtaccttcgcacagaaaacatgtgaccttgcgggtgagacactcccctggtggatggtcttcttcacaatgagtgcagagtgtgagacacatgctagcaatgtgtccaatttccccacaacgggggcatgcttttgattccatctcttcctcgccgagatgtcggagagactcatcttcataatccgaggagacttgatctgacccttcactatcagatactctgccgtcatggcttaggaggtgctgggtcaactgtcgtgcacctcggaaagtatttcctctttgacgtctaggaatagttatcccagctggaggccattcggtgctggtaatagtcatcttacgtacttcttcttcagttcgcatcggcgcttttctcttctgattcttactcttcttgcctttggcttgcttagtacgtgaccccacgtggtacgaaaggctaggaggaaagcacttcccgggattcaatggattctctccattgggctctctactttgcacactaggctgcaagcttgacttggtgcgaggaggctggtttagcgatgtctgccctgttaaaccaaatgaaggggcttctctggcatatacccatggacaattcagggcatagtgtccttgttctctacaatcgtgacaaaaggggacatcctcttctggcattggaagttcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggagacatacccgctgacattctttcctttttctctgttaaacatctgttacaggaattgaggtgagagaggaaacaagctaggaaagaatagaccagaactagagataggaccttaaaggaactaactcttcttgttgatgtgttgtttgttttgcttattctgcaagttgattaagcaaacaacctagcatggttacatcacaacccaccgatgcaaaccacgcgctacacacacaagcaagaaacacacgactaacgacactaccctagagggtggcttaggttctgcgacgggttctccaagatcttcactgcttccttcactttactagcggatcctgcagccttctggaatttcgacaaacaactgacgatgtcttcttcttcactgacctgaccatctagtactagttgaaatccgaagaaggaagaagggagtaaaccttttgcagatagcacaggggaaaggagaaaaaaggaactttcacaaatagttttatttataaaataggtccttaggttatatccacttggcttatcctacagtcgagatggctcagataccagcttgtcgcgaccgggaaaattgccttttcccgaacgctagtgtattaatccccgtcccaggaaaagccggggtacaccatacaaacatgatataaaagacacatctttattacatc

SEQ ID NO: 15231 - DNA, 719 bp, Oryza sativa
  unsure (1)..(719): unsure at all n locations
nnnnnnnnnnnnnnnnnnnnnnnnnnnnnnnnngtattatcgctatgatttactgcagagtcaggtgcagcaggaggagcattggtgctgtggatgatatcgtcgatgttgctgttggagctgactagctgatgagacaatcgtagggttgttcgttggatttctacggtcttggtcaacaacacactgagttggcaatccttgggcacatggtttgtaccttcgcacagaaaacatgtgaccttgcgggtgagacactcccctggtggatggtcttcttcacaatgagtgcagagtgtgagacacatgctagcaatgtgtccaatttctccacaacgggggcatgcttttgattccatctcttcctcgccgagacgtcggagagactcatcttcataatccgaggagacttgatctgacccttcactatcagatactctgccgtcatggcttaggaggtgctgggtcaactgttgtgcacctcggaaagtatttcctctttgacgtctaggaatagttatcccagctggaggccattcggtgctggtaatagtcatcttacgtacttcttgttcagttcgcatcggcgcttttctcttctgattcttactcttcttgcctttggcttgcttagtacgtgaccccacgtggtacgaaaggctaagaggaaagcactttccgggattcaatggattctcttcattgggctctctactttg

SEQ ID NO: 15232 - DNA, 623 bp, Oryza sativa
gtctagtcataaacaaaagtacacggattggagatggatgaagtcgggcgtcgatggacattctccagggcaaatgaagactacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgcccgtataccgtggtggtatgtggcacgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgct

SEQ ID NO: 15233 - DNA, 681 bp, Oryza sativa
  unsure (1)..(681): unsure at all n locations
nnnnnnnnnnnnnnnnnnnnnnnnnnnnnnnnnnnnnnnnnnnnncatctaatccagtgatcatggtggtgttgatcaaagttggagtcatcggtccatggttgaacagaaaggcattgatggtgctggaccagaaataggtagcggcagccatcagaggtccgtccttagctgagttggctatggtaagggcaagcgcttggccgattccgatcttatcccaatgaacttttttgttggccatacgcgcttgtaccatgtaatccagctcttctcgggtgggttttctcaagtgatggccaagatttaaaggtgttcttccagtgatgtagatctgggttggctaatctgaaaggaatcctatttgtttcaccaataatgaactcggtgggatcaaggttgccgattggaccaagaaaataatgattctcgtgagataggcttggaattgcgatcaaattagaaagatgttgcaaatccaaaagaaccgagaagaagaaaacaagatgaggaaaagggaaatcaatccgatacgggaaaaggagatctaaccgatgggaactcacctcatcgtactctgttgacggcacaataagcaggttggtggaggacgacatcactgcaggcggagatctggccggagatggaatcgccctgggatcgccttttgcgtcggaggaa

SEQ ID NO: 15234 - DNA, 1103 bp, Oryza sativa
cttcggaaccttcctcaacggaaacgctctcctccggaacgttggaaactaaagcaattaaacaaaaatcaacaaaacagtacaaaaacaagcataaacagtacatgtggatatttttaacatgtagatcttgattttagaagaatttagcaacttgaaccacctgaaacggatctacggttatttagttatgattttccgaagttttaatctattagaaaattggaaaaaagaaaaaagaaaggggatgatgacgtcatgctgacgtcagccctggctggctggctagggcttgcgagctcgccggagctacggcgatcggccgggaaattggagggcatctacacaaagaggacgacgaggcgaacccaacggtactcaccacgacgacaaccgatgaacgacgacggccggcgacgagagaaggcggcgcggcggctcggcttgacggcgtcgacggggctccggtggtcggcggcgaagggggacgggcggccgaggttctcctcaccacggcgcacctaacggcggcggcggcaagcggcgacgacgacggaggcggcggtgcgacgcggccgaagatggccggcggcggcggcgaacttaaagcgcgcggcggcggctctacggtgcacgagagaggacgggagagagggcaaacaaaagaggacgacgaggggatgctttatatagcattggattgaagagatcgaactccaaacgagaggaatcgactcgggaagaattcaaactcggttttagggattaaatcgaaacgaattcgattcgggcaagatactcaacggattgctccgtttcttgaggggaaagatagaggagaacgagaggaacaaaacccctcaaaaatccggactcggagaggagagatcgaggcggatttggaggcggaaaggaggcggctcgagctcggcttggcgtcggccggctggaggtaggggatggatccgacaggtgggccccacctgtcggtctcccgaaaggaggaggagcggctcggctgggccgacctgggccgcgcgggagagagagagtattgggccgaattcggcccaacggcttagggaggggttttttgaactttt

SEQ ID NO: 15235 - DNA, 744 bp, Oryza sativa
  unsure (1)..(744): unsure at all n locations
attattgtgagaggtgtgagattaatcacgaaaaacattgctcaactcgcccaaacccgcgggcacggctattcgaatagttttactttggcaagaggtgtaccactgtacccacaagacacagcctcagcatcatgtctaccatgcgtcgcgatactggaaagtacccgaatagaggctgtgacaataccctctgcataacacaactcaccacagtgcaccattcgtggatcataatcaccccctctacaaccagaggcatggactccccagcgacccccacggacttctcgccgcttctcagtctggcaccccgcaatgaatcatgctatacaaaaggtaaagccgttgcccatgttggcttgtggttggtacggttaatgtttcacaacagtagctcgcgaaccggtctttaattgtcatgagcacaaccgtcaaaaccacatgctcacaacccaccttaaccaggttttaattatcaattaattatcatcacacgattaaccatcgtgagctaccatttaatgtaaccataaataataatgtagtatatatgactcatcccattagtgagctaatgtttctaagcattgctaagcaattatatatataacatttagctgaaccaaaccaatacataaggttcaagctactcaatttattacccaaggtatcaaggaatnnnnnnnnnnnnnnnnnnnnnnnnnnnnnnnnnnnnnnnnnnnnnnnnnnnnnnnnnnnnnn

SEQ ID NO: 15236 - DNA, 584 bp, Oryza sativa
  unsure (1)..(584): unsure at all n locations
nnnnnnnnnnnnnnnnnnnnnnnnnnnnnnnnnnnnnnnnnnncgggtactgatatatagagtttagggttgtgcaaccccctctcaacgcaaccctaatgggttccaacacgatacacgggccaaaggcccaaatacggtgacacagcaccgctacagattctggacgtcaacttgtttggtcaatttacattgacccgaaaagaatttggacatgggaccaaaaccattggaaaggatatcttgttagctttccatccatataaagaatgccccaatccgagcacgtatgcgacctgggcgcccattttagtgcagactggtcctggactccgaattgcacccggcgtcgacttggtttgggcctccaccttgacttggtcgtactcgatgatcctccatggctctaagtccttctccaagtgtctccttgtcccctccattgttcctaatcacaatataatcattaggtagcaatctattctcgaattcatacaaagaagaacataggaannnnnnnnnnnnnnnnnnnnnnnnnnnnnnnnnnnnnnnnnnnnnnnnnnnnnnnnnnnnnnnnnnnnnnn

SEQ ID NO: 15237 - DNA, 1794 bp, Oryza sativa
  unsure (1)..(1794): unsure at all n locations
agcatgggtgtgctgttcagtgttgattaaaatttctgattaattactccactgttttactctcttaaatttttgctaaatgctgcttttgcaaatgagccgatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgagagtggagcttgaattccgctagattttatcttccggttcccttttcttcttgatgaggactaagtgcctcataagtaggtatttatcgttttagttaatttgatgaatctgtatattaaattgttagtttgtgtacctcggttgattcctggacgaggattttatgcacaaattagttcggaaattactagtgaatttccgggcgtgacacctcttcctcgaatagaccaattggtgaactcaacagctagatgtgagttgttaagcttccttgatgcttactctggctaccaccaaatcagcatggcgaaagaggacgaggagaagacagcgttcatcacgccattcagcgtattctgttatgtcaaaatgccgtttagactgataaccgcgggaaacaccttccagctcacggtccaaagggcacttaatgaccagcttggaaacaatgtcgaggcctacgtccatgacattgttgtcaagacaaagacaagcgagtcattgatcgatgacctccggcaaacgttcgacaacctccgacgatatcgtctcatgctcaacccagagaagtgcacgttcggagtaccatcgggcaagctccttgtcacgcccggaagtttccccctttttcatgctttaaaattttgttaaataaatcgtctggagaaattgttttaattaacctagagatgagttccttaattaatgaatgcaattaataattggaattggcattgtgggatttttcttgagttccacatgtcacaatatattaacaggatttttagtggaattttcagagccttggaaataattttaaccaattaaaaatcaccaaagtgcaattttaaatcccacgaaaaatcctttcccctttttcccctttttcccttttcttttcctctttttccctcttcttgggccaacggctcagtccgcctccccttcctcccgcacgcgctcggccttcctcttgttgggccggcccatgcgcccctccctcctctccctgggtcaccgacaggtggggcccacctgtcggtcccgtcttactcctccagccgcccacgccccaccgtcgaaaccgtcgctccccacgccgtcgtggccacgtcgctcctaccgcgcccacctcgtcgaccacctcctccacctctcccgcatcagcgcgcccgattagaggccgtgattcggtttgaatcctgtctctcctctctctctctcttcctccctactcccccacgtcgccggccaaatcgagagggttcccggccacgttctcccctccctcgcctataaaatccttcccctgagccccctctatcgtttcccactctcgccgccccctcccgtgcctcctaccgagcccgcgccgcacgctgccgtcactagagccgtcgcttcgccgcgcaatcaccgcctttagcttcgccgccgcgagagctacctcggccgccgctcgctttccgtccgccgccgccgaaccccgattnnnnnnnnnnnnnnnnnnnnnnnnnnnnnnnnnnnn

SEQ ID NO: 15238 - DNA, 1179 bp, Oryza sativa
  unsure (1)..(1179): unsure at all n locations
nnnnnnnnnnnnnnnnnnnnnnnnnnnnnnnnnnnnnnnnnnnnnnnnnnnnnnnnnnnnnnnnnnnnnnnnnntgataacttgggtatcaaaatgactagatgttggtttagaaattgcttagccacgcctagctgaactagtacacaaatggggatcacattattacatagactttgactatgagcatagttttggattggtgccaccacaatggtgttagctaattaaaatgcactgaatggtgggctgtgggtgcatggttttgctggtcgcacccatggcagttaaggaccggttcacgggaaaccctgggagacttaccgtgcttaccacaagcgggagtgagtaactgcttgatctgaggtatagctcgaccctttcctaggcaccggtggcaagggtgagcgtgatggagttgggtcggccagggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggtgacatgtgtggaatcgtgtcttatgggtatagttgtacacctctggccagagtaaaactattcgaatagccgtgcccgcggttatgggcgatcaaccagattcaccgtgattagtctcacacctagtttagtttaatgaactggtgtagttcaggaggttggttgggcctgttgcaacgtggtgtagcgttggacagtgattgattaatactgcttaattactacaactgttttactgctttcaactactgcttttaaatgcctgctttatgcaaaagaacctttagccttctttggttatatcatgcatcatacctcctcttctggtatgacttgctgagtacagtgggtagtactcagtcttgctctcttttcccccacactagagttgatgttcttctcagttggagccgtctcagagaggttggtttcatcgctgccgtcaaggattgcctgtggagtggagtcgccccgctaatgaagtcaagtttccaagtctagctcgttttatcttttccgctgcaattgcaatcttttctgtttttgtaagacgtggatctgtatgtcaacaa

SEQ ID NO: 15239 - DNA, 5874 bp, Oryza sativa
  unsure (1)..(5874): unsure at all n locations
nnnnnnnnnnnnnnnnnnnnnnnnnnnnnnnnnnnnnnnnnnnnnnnnnnnnnnnnnnnncttaattactacaactgttttactgctttcaactactgcttttaaatgcctgctttatgcaaaagaacctttagccttctttggttatatcatgcatcatacctcctcttctggtatgacttgctgagtacagtgggtagtactcagtcttgctctcttttcccccacactagagttgatgttcttctcagttggagccgtctcagagaggttggtttcatcgctgccgtcaaggattgcctgtggagtggagtcgccccgctaatgaagtcaagtttccaagtctagctcgttttatcttttccgctgcaattgcaatcttttctgtttttgtaagacgtggatctgtatgtcaacaattgccgtttgtgtaccctggttggtcctggacagggatttaatgcacattcagcttagaaattctagttcgagaatttctgggcgtgacactcctcagattcctcatctctggaagagggatcgaagcaaatcccgagaagatcaaggcaatcgagaacatgaagtcgcccacaagactcaaggaagtccagaagctaactggatgcatggcggcactgagcaggttcgtcgctatgatgggagagcgaggacaacccttcttcgcgctgctgaagaaacaagacaaatttgtgtggacacaggaagccgaagatgtgttcatcgcactcaagcgctacttgtcaaatcccccagtacttgttgctccccaacctaatgaagaattattcctctatattgccgccacaccatattctgtgagtaccgttattgttgtcgagagagagaaggtgcaaagaccggtttattatgtcagtgaagctctccacgacgcaaagacaagatacccatatatccaaaagctgctttatgcagtaatcatgacatcgagaaagctacgccactacttccaagcccacagagtcacggtcgtttcctccttccaccttggagaagttgtcacgcccggaatttctatccaaaattccaaacgcttacatgtgtgttaaaccctcgtccaggaatcaaccgaggcacacaatgacaatttgataatagagtacaaataaataactatttaatactcgcaaataacaaaagattacagaggtagatagttcctctcaaaaaataacattctacgcagcggaaaaaaaactataacaaactacggaacagctatggcgactccactccacaggcatcttaaccaagaacaagctcaatcctccagatcatcaccttcactgagatactcctcttctgatgaatgaatattgcaagaatgagcatatgacatactcaacaagtcacacagcaaatatgcaagtgcacaggataacgaaggatggcataatatagctcatttgcagaaacagcatttaataaatatttaagagaatgataaaaacagttgaataattaatcagtattaaataaacaccatacaacacacccatgttgcataggcccaaccacatttgaacaaccaaccccagttgaacaaattaaacctccaaaccaggaattatccattccaaaccaggagtcaaattaattaccacattataatcattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggcatggactccccagcgacccccatggacttctcgccacttctcagtctggcgcactataatgaatcacgctatacaaaaggtaaagccgttgcccacgcttgcttgtggctggcacgttaaatgtttcacaacagtagctcgcgaaccggtccttaattgtcatgagcacaaccaacaaaaccatatgctcacaacccaccttaaccaggttttaattatcaattaattaacatcacacgatcaaccatcgtgagctaccatttaatataaccatcactaataataacagtataacatagtttataattaaaccctttaattagctacgtttctaggcatggctaagcaaacttacatatagcatttagctgaaccaatccaatatataaggttcatgctaatcaaattataacccataggaaaataaagtcatctccggccaataattaattgggaaaggttcaccacccgatgacattcgaaaacaatgcacagttgaaataaaataatagctttaaacgggatcaacatgctcaaagggttgtttgggatctgtgtgacttgccttgagcttccgcaaacgcttcggaaccttcctcaacggaaacgctctcctccggaacgtcggaaactaaagcaattaaacaaaaatcaacaaaacagtacaaaaacaagcataaacagtacatgtggatatttttaacatgtagatcttgattttagaaaaatttagcaacttgaaccacctgaaacggatctacggttatttagttatgattttccgaagttttaatctattagaaaattggaaaaaaagaaaaaagaaaggagatgatgacgtcagcatgacgtcaccccacggcagctggctagggtttgcgagctcgccggagatagagaccttggccggggatttggagggcatgtacacgtagaggacgacgaggcgaacccaacggtactcaccacaacgacaaacgacgaacgatgatggccggcgacgaaaaggacggcggcggcggctcggcttgacggcgacggtggagctccggtggttggcggcgaaaggggacgggcggccgaggttcccctcaccacggcgcacctaacggcggcgacggcaagcggcggcgacgttggaggcggcgcggcggcgcggctggagaaagccgacggcggcggcgagctaaagcaacgcggcggcggcgctacggtgcacgggagaggacgagagagggggcaaacgaaagagggcgacgatgtggtcctatatatagcattggattgaagagatcgaactccaaacgagaggaatcgactcgggaaaaatccaaactcggttttagggataaactcgaaaacgagtttgattcgaacaagatactcaacggattgctccgtttcttgaggggaaagatagaggagaacgagaggaacaaaacccctcaaaaacccggaagaatcggggtcggattggagcggaatcggaggcggaaaagggcggctcgggctcggcttcggccggctggaggtaggagatggatccgacatgtgggccccacatgtcggtctcccgagaggagggcacgggcggctcggctgggccggcttcggccgcgcgggagagagagagtgttgggccaaattcggcccaacggcttaaaggaggggatttttggtctttttaaaataaaaacaatttgtgaaatgttgtttcaattattaaaaatacttcccttgctcaaataattcccagaaaaatctagaaaatagaggagcaagcatagtatttaataaaattttatctagctcatttttatgttgaaaattttcctagaaaattagggtttagtttgtaggcttttaaaaataatttctaaaaattccaattaaacatcagtttatatatttaggatttttagggcgtgacagaagtcgtgagaaacaaagacatcgtcggccgcattgcgaaatgggtagtcgagcaaagccagtttgatgttcactttgtgccccgaacagctattaagtcctaggtcctcgccgatttcgtagccgattggactatgcctgacaacatgtcagatagtcagactgacagcgagacatagacaatggcgttcgacagcgcactcaatagccaaggagcaggggtagggttcatcttgacatcacctttaggagatcagttcaagcatgcaattcacctcaacttcagggcgaccaacaacacagccgagtagaaaggattactcgccatgataagagcagcagccgcactaggagccaaccgactaatcgtgaatggggattcagaactagtcgcaaaccaggtgcacaaagactacaagtactctaaccccgagttacccaagtacctcgcagaagtcaggaagctggagaaaaggtttgatgggatcgaggtccgaaacgtataccgcaaggacaacatcgaaccagatgacctagcacggcgtgcatccatacgagagccactcgaacctggtactttcttggacgccctgacaaagccatcgatgaaagaagaaaacgacgaaggtagcatagttgtccccgacatcagttcgggggctacaggggcagaacaagtcgttgccgacatcgagaccacagacgactggcggaccctgctcaacaaattcctgagtagcgacgagttgcccgaggacgacgcagaagccgagaaaataacccgacaagccaaaaaggggccaaacggggtacttctcaaatgcatttcgttcgacgacggcaaacatctcctcctggatatacacgaagggatctgccggtcagacattggtcggaaaagcctttcgacaagggtttttctagccaactgtcacgccctaaaaatcgactaaattaaaaatgcatattttaaatcatttttagaaattattttaaaagcctacaggctaaaccctaattttctaggaaaattttcaacataaaaatgagctagataaaattttattaaatactatgcttgctcctctattttctagatttttctgggaattatttgagcaagggaagtatttttaataattaaaacaacatttcacaaattgttttatttcaaaaagttcaaaaaacccctccctaagccgttgggccgaattcggcccaatactctctctctcccgcgcggcccaggtcggcccagccgagccgctcctcctcctctcgggagaccgacaggtggggcccacctgtcggatccatcccctacctccagccggccgacgccaagccgagctcgagccgcctcctttccgcctccaaatccgcctcgatctctcctctccgagtccggatttttgaggggttttgttcctctcgttctcctctatctttcccctcaagaaacggagcaatccgttgagtatcttgcccgaatcgaattcgtttcgatttaatccctaaaaccgagtttgaattcttcccgagtcgattcctctcgtttggagttcgatctcttcaatccaatgctatataaagcatcccctcgtcgtcctcttttgtttgccctctctcccgtcctctctcgtgcaccgtagagccgccgccgcgcgctttaagttcgccgccgccgccggccatcttcggccgcgtcgcaccgccgcctccgtcgtcgtcgccgcttgccgccgccgccgttaggtgcgccgtggtgaggagaacctcggccgcccgtcccccttcgccgccgaccaccggagccccgtcgacgccgtcaagccgagccgccgcgccgcctcctctcgtcgccggccgtcgtcgttcatcggttgtcgtcgtggtgagtaccgttgggttcgcctcgtcgtcctctttgtgtagatgccctccaatttcccggccgatcgccgtagctccggcgagctcgcaagccctagccagccagccagggctgacgtcagcatgacgtcatcatcggg

SEQ ID NO: 15240 - DNA, 14947 bp, Oryza sativa
  unsure (1)..(14947): unsure at all n locations
nnnnnnnnnnnnnnnnnnnnnnnnnnnnnnnnnnnnnnnnnnnnnnnnnnnnnnnttttgatggttgtgctcatgacaattaaggaccggttcgcgagctactgttgtgaaacatttatcgtgccagccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcgcatggtgacatgatgtggggttgtgtcttgtgggtacagtggtacacctctgatcagagtttaaactattcgaatagccgtacccgcggttatgggtgagttgagcaatgtttttcgtgattagtctcacaatactcattaatggttataatgtgataattaatttgactcctggtttggaatggtaaattcctggtttggagggttaatttgttcaaccggggttggttgttcaaatgtggttgggcctatgcaacacaggggtgttgtatggtgtttgtttaatattgattaattatacaactgttttactattctcttaaatatttattaaatgttgtttttgcaaatgagctatattatgccattctttgttatcctgtgcacttgcatatttgctgtgtggcttgttgagtatgttatatgctcattcttgcaatattcattcatcagaagaggagtgtctcagtgaaggtgatgatctggaggattaggcttgttcttggttaagatgcctgtggagtggagtcgccatagctgttccgtagattgttatcgttttatttttccgctgcgtagaatgttatttttttttgagaggaactatctacctctgtaatcttttattatttgcgagtattaaatagttatttatttgtactctattatcaaattgtcattgtgtgcctcggttgattcctggacgagggcttaacacacatgtaagcgtttggaattttggatagaaattccgggcgtgacaccaaccgcgctcaaagacgcttgtgacatggttcagcggtgtgaagcttgtcaatttcatagcaaatacacaagactaccagcgcaagcgctccagactgtacccctcttacttggccgttcttgtgctgggggctcgacatactcggaccattcccacgaggacagggcggctacaggttccttttcatggcgatcgacaagttcacaagtggattgaagcgacgcccattggagaaatcaaggccgacaatgccatcaagtttatcaaagggatattctgcagatacggattgcctcaccgcattataacagacaatggctcccagttcatcagtgccgacttccaggattactgcattggattgggagtcaagatttgctttgcctcggtttctcacccttagagcaatggacaggtcaaaagggcaaatggcatagtactacaagggatcaagacccgtgtctacgatagactcatgtcacatgacaagaagtgggtcgaagaactcccctctattctctgggccatgcgtaccacaccgacaacatccaataaggagacacccttcttcctcgtgtatggcttagaggctatgctccccacggagctacgacatcagagcacacgagtacagaagtactccgacgaggaacatgaggagcagcgaagcgacgatgtgaatctactcgaagaacatcgagaaagagttgacgtcagagcagccaactaccagtaggcccttcgccgataccatgtgtggagattatggttatctcatatctacatggcggttatattccagctggatatgtcgcgtcccaaatcgactctaaaattcatcctcgaaattgtgcaaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaatgaacaaagttgaaaaggtttataaaaagaaaaccctaaaagaagtctgtttccccccccttttccctcttgggccggctcggcccattccctccctctctctctcttcccccgcggcccatcggctccccgcgcgcgcgcgcgccgctgacaggcgggcccgcccgccactctcgctgacgggtggggcccacctgtcatcttcctcctcctgccgcgcccgccgccgcgcccgtgccctagcgccgccgccgccgcggattgcgccgcatcccgccgtccccgcgcgcattaaagagaggggaatcattccccgtgattccctctcccgtttcccccgatttcccctctctctctccctcggattcggtcgaatcgtggccgcattcgtcgccggcgcaatctatggcgcccgagatctccgcgcgcggtttcctctctccccggccgcgctctctccctcccgttgctttatattcgatccccgagctccgctctttcgtttccgccgctcgccgctcgctctcgccgtcggaatcgtgctcgcgccgtgctcctctctctccgccgtcgccgtcgaccttcggttcgccgccgccgccgctccggtcctcctcccgactcggcgacccctccgtcggcttcgccgcatcgtcgccgaccccgtccgccgctccgcttcgcccgtcgaccgccggagcaccgtcgtcatcgtcatcccgagccgcgccgccgtcttcctccgctccgtccgccgtttccgccgccttcgccgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgcccccgcggctgccaggtggggcccggccgtcagccgcccgcgcccgcgggtgcggctgacgcgtgggacccacggcgccggccggcgccagccgcgtgcgcccggtccaccgtggaccgtgaggctgacgcgtgggccccacttcccgtggacccggtccgcgcgcccctcccctcggctgacgcaataaatccgatttttaattaaaatttaaatgaagaaattcgcaaatatccatttaaagagcatataaacttcaaatggctataacttggccatttgaactcggaattggaccgttcaagtctctaatttttccttaagaagtcaagaacccatttttgtgctttgtttctgctgttatgtggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttaatttaaattaatgcattatcgctttatttaaattcccgcgttatcactgttttatttagccatgcctatttacctttgttatgacctcattattattgctattgttactattaccttgttcaccctaggataaacaaaaccccaactagtgggtactctatttatggttccactagtatgaatttaggtagatgcttcgctgattaattaggcaatattaggtggttttataactttagactttgggaattctcatatcatttggacactatgaaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctgggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggtagcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaggatatacgataccaaatatagatagaatatctttatgaggactcgggttagattctaaacttgtatgccaggaaaatacccgggatcctagtcggttacgattgtattttatctgtaatcccatattccgttaggatatggactgtactttgtattacggatcccttcccctatataaggaggggtccgggttcctctcggggcgattctttttctcccaatcatacaatcgataacacactcggcggaatcatccccggacaggagtagggtattacttcttgaataagaaggcctgaacctgtataaaattccttgtctccaaacccatccactttcctagcttgatagccacctccttttattattgccgaaatcttgtttcgacagttggcgcgccaggtaggggtagcgtcaagttctcgccgactaagtgcgatgggtttcttttctggcatcgacgacttcgccttccctcccgggcaggcgttccagttcggcagcctcaacttcatcaccaacgacttcggcaagatctctctccttgactcggactcaaaccagtcggggagagaccaggtccccgtggcattcggaattccgaactcggccgaggcctactccaagatcatctctcccgagtcggctttaaaccactcggacgagatccaatctactctttcgcgaccagatcaagacgacgggtcctatccctcaatcctgatgaaacttcctgatgatttggccgttgtcttcactgccaagacatctgccacccgaagatctaggcgagctccggcttcggccccgatctaatctagatccagagaggttggcgttatactccaacctcttgggacagtctcaacggaagagttggatggttaccttagctcccccggcttcagttctcgaccaaccgagatcctcgactatgacaatttcggctaccactacgaccacggtgacctcgacaactttgacgacagctatgaggataactacacgcccctcttcttcaacgtattcatggctgacaacgaaacggaggaacagcgtcaagcccgagaagcagaccaagatagcgcacggcaagaagctgaacgtcgccgactagaggaagagcgacagcgacaggagcgagaacgactacagcgtgagcaacaagatcgcgaacggattgcaaaggaggctgaagatcgacggcaacgcgccttggaatctggacgctgagtgagagagctcattgggcaacaagacgtcgatggaacagcggtctttcgcaccccccagtagaacgcggttgcagctatcactctcctcgacaccctcgtcaaggaagacgtactcaaccaagctgatcatgttgtcaacatcttgaaccagacgaagaccatgatcgctgcctcggttccagccaactctgcaagcacccacaccccgactggtagccgagtccctcagctccaatctcatgattatcatcagccaagcctcagcatcatcggcataggatctagtcgcaggagcaggggtcacgacgaacgatctgttcactcgcctcccgaacgtcacagggagcgccgagtcgaacggcctcgctctccacctcaccagcgtcccgtcgaccttcgcgacacgatcaaccagcgccgtgcagcacgaggtcaccgccattcaccaaatcgctacgacgacgacgtggatggagtagctgccttcactaatgacctgcgtcgagtggattggccagccggctttaagccgactggaatcgagaagtatgacggcaccactaatccggagtcttggctcaccgtctacggactcgctatccgcgcagcaggaggagacagcaaggccatggcaaactatctacctgtggtcctagcggactccgcccgatcctggctccacggattaccccgtggcacgatcggatcatgggcggaacttcgtgatcacttcatcgccaacttccagggcacctttgaacgccccggcacatagtttgatctctacaacgtcgttcagaagtctggagaatctcttcgagattacatccgacgcttctccgaacaacgcaacaagatctccgacatcaccgacgacgtcatcatcgccgccttcactaaaggcattcgccacgaggacctagtcggcaagtttagacgtaaacctcccaggacggttaagcagatgttcgaaaaagccaacgagtatgccaaagccgaagatgctattaccgcgtccaaacagtcgggcaccacttggaagccaaagaaggacacgccgaccgtaggagggagtggaagtaacaaccacaaggatcgcaagcgtaagcccaaagagcttgtggcgaccacctctccatcttcccgacaacgttcccgcgtcaacaccttcgacaagataatgaactcccaatgtccgcatcatccaaactccaaccacgtggccaaagattgcttcgtctacaaacagttcgcggagcaatacgtcaagaacgcacgtaaaccttcagacggagatcaaggcacatcaaagaagaaagatgatgaagacgatgctccgactggttttccagatcatcgcaaagaacttaattacatcttcggcggaaccctggcttatgagtctaagagaaaacagaagctaacagaacgggagatcaatgcggttcagcctaacacgccccaatatcttcggtggccagagatagcaattaagttcgaccgctcggatcatcccgaccgagtagtccacctggggcggtaccccctggtactagacccagtggttcgcaatgtcaagctccgacggactctcatcgatggtgccagcgcactcaacatccttttcgctaagaccccggacgatatgcagattcctcgcacggaattaaagccgagtaatgcacccttccacgatgttatcccaggattgtcagctacaccagtcggccagatcactcttccagttaccttcggcactcgggagaattttcgcacagaaaatgtttgtttcgaagttgctgatttcgagacagcatatcatgctatacttggacgaccggctttagctaaatttatggccgtcccacactacacctacatgatgatgaagatgcctggtcctggaggagtcatatcactacggagcgacatcaagcaggccgtcacatgcgacaaagaaagttgcgagatgccccaaacccacgagactactctcgcccgcgaagagatccgactggctgcgaccacggcaagcgagggagaagtgcctgcaaccaagctgacgaagaccgaagaaagtgatgccaaaacgaaaaagattcccttagatccctccgatcctgataagactgctgtaataggcgctgagttagattgtaaataggaaagcgcgctcatcacctttctttagaataataaagatatttttgcgtggaaaccatccgatatgcctggtatccccagagaggtgattgagcactctttacatgttaaggaagatgccaaacccatcaagcaacgactccgtcgttttgcacaggacaggaaggatgcgatcaaggaggaattaaccaagctgttagcagcgggcttcattaaggaagtccttcatcccgactggctggctaacccagtcctggttcggaaaaagacggggcaatggcgcatgtgtgtcaattataccgacctcaacaaatcttgtcccaaagacccttttgggttacctcgcattgaccaggtggttgactcaacggctggctgcgagttactcagcttcttggactgtaactcgggatatcatcagatccgactaaaagaatctgactgcttgaagaccttgtttattacgccctttggggcctttggggcctactgttacatcaccatgccctttggattgaagaacgcaggagcaacctatcaacgcatgattcaaaaatgttttcaacccagatcggtcacaatgtcgaagcttatgttgatgatgtagtcgtcaagaccaagcagaaggatgacctgattgcggatttagaagaaacttttaaaagcattcgtgctttcaagatgaaactaaacccggaaaagtgcatcttcggagtaccgtcagggaagttgctcggatttatggtatctcaaagaggcatacagcccaacccggagaaaatcaacgccatcctcagcatgaaaccgccaagctcccaaaaggacgtccaaaagctgactggttgcatggtggcgctcagccggttcgtctcacgactcggcgagcgggggatgcccttcttcaagttgctgaagaagactgacaatttccagtggggacccgaagcacagaaagcctttgaagacttcaagaaacttctcaccactccaccagttttggcctcgccacatccacaagagccgctactgttatatgtgacggcgacctaccaggttgtgagtacggtcctggttgtcgaacgtaaagaggaaggccatattcaaaaagtccaacgtccaatttattttgttagcgaagttttagccgactccaagacaagatatcctcaggttcaaaagttattatatggtgtcttaattaacgtaggaaattatctcactactttcaaagtaactcggtcacggtgatcacatcatttccactcggagatatacttcacaatcgcgaagcaaatggacggattgcgaagtgggccttagagttgatgtctttggacatatcgttcaagccacgaacttcgatcaagtcacaagctttagctgatttccttgccgagtggaccgagtgccaagaagacatgccagaggaaaagatggaatattggacaatgcattttgatgggtcgaagaggctcacaggcactggagctagggtcgtcttgatttccccgactggagaaagattgagctacgtattgtggatacatttttctgcatcccataacatggcggaatacgaggcgctactccatggattaaggattgcaatctctttaggcattcgccgattaatcgtccgtggagactctcagttggttgttaatcaagtcatgaaagagtggtcatgtctagatgataatatgaccgcttaccgacaagaggtatgcaagctggaagataaattcgatagactcgagctcacccatgtccttcgacataacaatgaggcagccgatacactggccaattttggttcaaaacgggaagcagccccttctgatgtgttcgttgagcatctttatgaaccaaccgtgcccaggaaagaagcaattgaagccatggatactcaaggcataagcatgattgaagccgactagagagaacctctcataaaatttttgaccaaacaagaactccctcaagacaaaaatgaagccgagcggatttccaggcgcagcagactttacattattcatgaagctgaactgtacaagaaaagtccatcaggaatactgcagcgctgtgtatctttggaggaagggagacaattgttgaaggatatacattctggtatttgtggtaatcatgctactgcacggaccattgtcggcaaagcttaccggcaaggttttttctggcctacagctgtgtccgatgcggacaagattgtgtggacatgcgaaggttgtcaattttttgccagacaaactcatttgccagcccaagagttgcaaaccatcccgttgtcctggccctttgcggtctgggggcttgacatggtcggcccgtttaaaagggcagtcggcggttacacgcatctctttgtggctatcgacaaattctccaagtggattgaggctaaaccggtcatcacgatcacaacagataaagctagagattttttcatcaacattgtgcatcagtttggggtacctaatcggatcatcactgataatggcactcaattcactggcggagcatttaaagacttttgtgaagacttcggcattaaaatttgttacgcatccgtggcacaccctatgagtaacggacaagtcgagtgcgctaacggcatgatacttcaagggatcaaagcacgagtttttgaccgactacgtccctatgctggtaagtgggtagatcagctgccgtccgtactttggtctttacgcactactcctagtcgggctaccggccagtcgccgttctttttggtttacggcgtagaagcaatgttgccgagtgaagtggaatttgaatcactacgatttcggaacttcaatgaggagggctatgaagagggccgagtagacggcatcaatcgattagaagaagcccgagaagcagctttcattcagtcgactcgatatttgcaagggttgcgtcgttatcataatcggaatgttcgatcgcgagcctttttagtcggtgacctggttctgatgaaaattcaaacaacacaggatcggcataaattatctcccttatgggaaggaccattcataattgctgaagtcactcggccgggttcttatcgactcaagcgcgaagacggtactctcatcaacaattcttagaatattgaacaccttcgtcgattttacgcttaggcatttcgtttgtatctttcctctttgactgctaacttcaagtttttccttgaagttttcagtcagggggctactataataataatggagtgtgatttttatcaatccaatttgcttacttgatgtatcattgccctgtttgatttcttggcttagtcaatgaggactgaaagttttttaacaacttttgcgggttttaggctcaacaaggtttgacaaaaacttttaagaaatcaggaactaagttaagatatcaagcacagcataaattcatcagtattgtacaaattgtgcctccatcatcattaattatcaacatcattggtacattaatcagtatcagtcttttcatcatcagaattatcaggaccagtcggtcgaagatcggtgtcctgaaatctctcaactacatcagctgctatcttatcagcagatttttgtgcatcgctgatgaggtcaagagcagctccttcgctcgtcccgtctgcaaagccatcaatggcatcaacgtcaaccctcggataaagagatttggtcatcgccaacgccagacttgctctcatacttccagcttctttgatgctcttgaaatatgtatccagagcaactctcagcttgtcgaaaattttagaagcatcaagtgcactcaggccgttgttattgaagaacatcgcttgaacaattggggcagcagcgttagcaacctcatcccgggctccttcaagttttttgatcttgccaaccaggacgtcgaattgagcttgagatttgatcttgcggtctgcatcaacagatccacattaataagtcagcatatggaggataatggcttttgaggtattgattgttgataccttcaacttcctttaaagccaggtctctttgtcttgccagttctgccttgtcattttccagaatttgaatctgcttccccaactgagatatcttggcagcttgcactacattgattacggttaatcaagattgcaaagataacagtacgagtcagttgagcagagtttgtgcgtaccttttgatgagccactcagttcaaaatttgattcctggagctcagcgatccgatctttcagataatgttcattcttcctggcaagttctttcgcttcgtgcagttgattcctggtggcttcgagggttccgagatgagggactaacctttctaaggttaccgttttggcttcgttcctaagatgaatcctctgcaagacagtttaattagcgcatgaattaaatggcaaacaagatggttgagatcatgtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatccggaggatttcttattcatcaccaattattggccctagtgtatccatgaatgaagatgaagcagccaaataaagtctgttggatcaagatgatttcagatagcgtgtctacctgtgatgattcccggtcggggatgagtggactttggtgtcttcacaggagatttggtttctgattcactgtcagcatccttcccgagaggactgttcgtttgagcttcaacctcaggaatcttttggtttggccctgcatccgactggtttccagtcgggggctcctggttagcaccgacttcagattcggccgactggttcccagtcgggggctcgttgctgggttctacattgtcggttgtcggttgtttgtcactcggacaatcctctgcagttggcccggtttcttttgaagggtttgcctttatgtcagccggctcggggtctttttcagaaggatctatgtcagacggcttcctacgagtttgagttatgctgttagtattatttcaacagtgggtaagctgcaagacaaggaagatggccaaatgatttgtacctggaagactttctgatttttggcaaaggatgactggaggttttcttcttcggattagttggcttcggggattttccggtcgctcctttgtcttcgagccttccggtgtcatcgccttcctcgtcgcttagaaccagcttcctcttgcgagcatttgactggccgactggatcagaagcacttggtcgagcgtcagatcgaatttttggtcctccactcgcctgaccagtctactggcgaggtaatcgacgttgagcaattggaggatccgatttcatcaaagcaaattcctgggcatgatatttcgaactttcaattagcttaacagagggtaaaagcatacttttgaggaaggttgaaatgtttgagtgcataccggtggaggagggttgaatgcattgaatggcacaacgggcagcagatgtgaatagctgacaacaatagcgtttgagaagatcttgtacattctttctttcatgaccttaaagtcaagagaatctggatcttcccgatttggatcatgcttgccatcaaactcaaaagctatgcgggatctctctttgattggagctaatcgacttttgatgaagtgcggagtgatctgttctccctgcaaaccttgttccttcagttttagcatgcgttccatcaattccactgcctgagcagcttcatctcacataggcaatgagttccatgtgtcctggtaaaccggaggaagacagcagtactcagggagtgcgggctcaggattttgaacatagaaccagtttacatgccagcctttgtttgaggttttgaagggcatggagaaatatttttggctcaaggttcctctgagttggaaaccagctcccccaacaacgcacggtttgcttttgtttggctggggcttgaggaagaagatgcggcggaacaaggtgaaatgaagcctaatgcctagaaaagcttcgcaggcatggataaaattggcaatatgcactatggagtttggattcaagtgatgcaagctaatcccgtagaagttcagaatcccccggaagaatcttgaggttggaagagaaaatccgccatagaagaaatgagcaaataccacgatttcgtgtgtgtcaggggtcccgaatgcttcgccgaacgccggttgccacccgataatctccatcgctgggagaacgccgtgcgccaccatctccttcagattatcttctgtcacatcggagggcgcccactgactnnnnnnnnnnnnnnnnnnnnnnnnnnnnnnnnnnnnnnnnnnnnnnnnnnnnnnnnnnnnnnnnnnn

SEQ ID NO: 15241 - DNA, 4839 bp, Oryza sativa
  unsure (1)..(4839): unsure at all n locations
nnnnnnnnnnnnnnnnnnnnnnnnnnnnnnnnnnnnnnnnnnnnnnnnnnnnnnnncctttgtttgaggttttgaagggcatggagaaatatttttggctcaaggttcctctgagttggaaaccagctcccccaacaacgcacggtttgcttttgtttggctggggcttgaggaagaagatgcggcggaacaaggtgaaatgaagcctaatgcctagaaaagcttcgcaggcatggataaaattggcaatatgcactatggagtttggattcaagtgatgcaagctaatcccgtagaagttcagaatcccccggaagaatcttgaggttggaagagaaaatccgccatagaagaaatgagcaaataccacgatttcgtgtgtgtcaggggtccggaatgcttcgccgaacgccggttgccacccgataatctccatcgctgggagaacgccgtgcgccaccatctccttcagattatcttctgtcacatcggagggcgcccactgactctcgaagctttctctttcttccgccatgaatgtgaactggatggtttaatttggtccgagatatggctggagaggaatggggaatcggagtggtggacgcggggagaaatttcgtgaagtttttgagggtgggttggagcagattgatgaaacctagcttcgtcggcgcggttctgtactgtagcacggagtggggaatggcgagagtctcggcggggaagactaaacgacgtttggacttcggtgtttttagggtatcgggagtactaatgggcctgggcctgtacagtacttcagcccaattatgttttcagcgtggcctgttgtgatccctagggacttaggcgccttttgctttggcaatatgtgctcacaatgatgcggcccgatgctgttaaaatcctttttaacgcgattcaataattctttggaattaatatgatgcacatgaaaaggtgcccgacagaaaggtattataccatttttgtaagcttttttaggctacaaaagctgttgggttaatttgggatgactggttcattagtagtcatcctcctagcatgttatatgtttattttgattatggtaagggttatagcctaggctaatgaacttcttaattaccatgatctttatcatatttggtggatcattttaagagtttcttactcggattcctaccaaatatatctatttttggaccttttgagtgtttatcattcggcccttttcatatttttttgtccttgatatattcaagtgagaagcagtcggctgagtatcttattgagtaccatgcatgcttcgatataaaatcgctcggttcttgactatatgtttagtttttcaactaatcacatagtcgggggctacacctaattaggtgcatctacttgatgcaccatgttttattttcgcccttcacagtcttttagcattcggcaagccggagcaagttgaattgaagcactcagattattgttttttgtttcgagaagactattttggtcaactgcgaaggtctcggggggctactgtggagattatggttatctcatatctacatggcgggtatattccagctggatatacggtaccaaatatagatagaatatctttatgaggactcgggttagattctaaacttgtatgccaggaaaatacacgggatcctagtcggttacgattgtattttatctgtaatcccatattccgttaggatatggactgtactttgtattacggatcccttcccctatataaggaggggtccgggttcctctcggggcgattctttttctcccaatcatacaatcaataacacacttggcagaatcatccccggacaggagtagggtattacttcttgaataagaaggcctgaacctgtataaaattccttgtctccaaacccatccactttcctagcttgttagccacccccttttattattgccgaaatcttgtttcgacaccatgagaagcgcatcagagcatgcacactttcgatcgacgattacgtcctccgatgggttcaaagccaagcagggcgcaacaagctctcacccaaatgggaaggaccatacacgatcacacaagtcttgcggccaagtgcattcaagattgcagatggtgatggatgcgagttagcaaattcctggaacattgatcaattacgtaaattttatgtataaatcaatagtgtccatatttgtaagacatcttacgatttcaataaagttgatttcaggtaaagattacggtcaaagtgttccttcccgacgatcccttaccatgacgacacctagagttgaaacctatcctcatgtccgtttacaccgtcctgacaaggcctctgaggaacctaagggaacttcggctggggacgcccagagcggataaggccttgtcggatcatgtagagacaaacgaccatgtaagaccttgtcatgtaagagttctcaccgtgcgtattaaccaagccgtgtaatcggaaattgagttttccaacatcacggctgggcgctagggtcagtgctttttcaaccaaggcaggtcaagggtccaagagccttgtcatccgagaacgattctctgacaacaaggctgggggctagagagagtgtatggctcaactgactgatcaaagtcgcaaagtgagaaaacgctcatacacaacacacctagagtaagaaaacttagttagatagattccttctctattttacaagtgtttcttacaagtcataaatattccaaaatattccatgtttccttgagatattttttacaagattcaaaaactaccaggacggccaatgccaatccatggactgaaaaaccttctctgcaagcggtgccatcgattgcgcgagaccgtcgatctccgcgggagtcctccgagaatgcgagaactgttcgtggaggaactcgaggtgtagctgcgggtggtgatctcggatgcaggccagcacatgtcctccggcgtaccggcttgatcgacgacactcctgcttcagggcctcgtcgagacgtttgccgatcccttcgagctgtgcacaagccccattcagccacgagatatatccggccgccgactcctcgggatctccacggggaactcgaagctccttgtagactcccgtcattgccgtgcagcagctcttaaggtatgagttgaaccacacctcgcgacctcgaagagcttccacggcccggtccttcttcacttccaccatggtcctctcgagttcagccacctcgagcttcgtattccaatattggattcgacgatctcggtcagccaacgcatcctcgaggtctgcccagcacagaaaggactaagtcaggctgttcttctctcccaagaacacaacaaatcaagtcaatccgaatataaggagtgaaggagactaagacgcgatcctagggacgtcatcgccatatttgcctctgcggacgggctttgactgacctcctcccgcgacacgaatggctcgagcgcaagcgccgaaatgatcaccggcatgccaggctgcccgcgctgctggacactctcgatatcaacatctctacaacgacaacaaagtactttacagcatgatgtttaagaggtacaggggaaaacaaatatcctactcttcaaaaagggggaggacgaactcccccaagtcactgacttcttccatcacgcacttgcgtgtgtcatcagcggccccctgatccaaaaccttcttaaggtccaggtcagggtgcgccagcctcacgcacgcgaggacgtggcacgccccgttgaagaccccgttggacgtctcctcaccaagcctggctgcgtgcttggaggggatctcctccatcgccgtggccaactccacgagcgaggacgtcagtgagaactcatcagggttcgccgggatggtagtcgtgacaccacactccccagcgagctggtgtaggccggtgtacgatattcgcagtgagcctcggatttctgacagattgttctcgagctccgatatccgatgctcgagcccttgccgctgcctctcgttgccggccaccagcaccctcatcttcaggaggtcctcgcgggcctctgctaggtcacgtgccagctggtcggcacgctggtttgctgacgacgttgccgccttggtcccaccttgcgccgccttcgcccgcgccgccctacgaagagtttcctctctttcataaagctaggcgatcaagatttcgtgaatgagaagacttcaaaaacgtccacttacttctcgctgatcatcaccagcctttgccttcgctgaggtgggggagacgcgtccgattcctaagtaagatacgacggtgtgaggaccagtcattctgactacacgttaaaaaataagagggaggtttaccgctaggtttggcgccttacgacgggtcccgagtacggacgagaatttcctccccttcttcaaaacattgctgccacttgtggtagcagcagcagcggcaacgtcggacgcttctttggtgacgccctccttcaatgacgccgccacctggtggtccgcgagtggttcgatgacgtctgtcagagggagagcctgcataacgtgaagtcacaacgcgatctcgaggagaaggatgcaaaggagtcatcgagtacacttacattaattgcggtggcacgttcggtcggacccttctctcaaagggggatcgggatgtcgcccgccactgagggggcgctgatcatcacctggctgacgcggtgtcccacggtgtcactttccagacctgtaaatcaaggacaagaactcggtaagtcaggagaaacagacgcactc

SEQ ID NO: 15242 - DNA, 22213 bp, Oryza sativa
attcgaaatacaagaaaaaataccccgaggagaaactcggatcgcgtcctctggcacagagtagtcaaaggctggatgggcgcaggcctggagcggttggatccgcctacctacaaagtcggcaacgacttcgtaccctggcaacccctgtgttcagaggtcatcgatgatgtcgatgaaagaccggagagagggagtcagggcgggtttggcagtccactctgggattttgtctagttgttcttcagggacaacaaggacgggatccgagttttctatctgaagatagaaccatctcgcccgccatttgctgcaagaagaggggcactggaaggggatgtaacgcgacttcaggcaatcccgaagtcggaatccgacacatccagatacactgttgggttccatccgacgcaagtcatagtaaaagcggaagagatcaaggaagggctctaccccaatgtaggccttgcagatataagaaaagattctaaggaatgcaatggagttggggttcaaatgaagcaaagaaaggccatagaagttcaagacgagaagaagaaattcggaaggcggaggaagaaaaccgcaagaaatataatcttcgaccacaaccatatggcccaagatgggttcgggttcaatacctcctgtctccctctgcatggtcccgcgaccagggagggcgccgtcgtcctacaatttcttcaaagacgcggtggttgaggtggacttgtcaagatccatcgccgccggaggatcgccagagaacaaagcaagagaaatgggctagggttttctgtgcggagagcggagaagacgaggagcgctagaaggcaggagaagttttctggcaaacggacttttaatggattcccaaaatccctttaaataagcgcactaccgacggtgcgtattccaaggaaaggagagagattgccgccgggaaattctgggtccgttgcacgcagtagttttcaagacttcaatttaaattcactcatgaccgttgaacttcatgcggcgttgtcgatgactctttgtctctacggttctcatgccaagatcgaccagatgagaacgacaacgatttcgacatcagaagtcgtgattgattacatgagttcatttaagcagaagtcgggggctactatcagggttacggataaggtataccctttatccttggataaacgatgagtactgatacggtatgcccgcgcttatacggataattcctatatgcgttaaggaaatatatcacatgatagaaacataatccacgtatggaaggagtcctactcggacgagactgggtctttaccatatcgtgaggggttcgatatctccgagtcctacttggagatcaactgacccgcggtataaaagggaccccctgggcaggacctaaggcatcgaatatcaccgctaacacatccaccacagcctacgaagccggagcctacaggagctaagtcgtcgggtgatctagtcgaaccaactcgactacggtctcgtcggtaccatcgagttctgttattccctttgtaatatgtggtttccatcatataatctcataccaactggattagggctattacctaccaaggggcctgaaccaatataatccttgtcttatgtttgcttgatgtcgtactacgtagatcctcgtaccaacgtaccccaataccctctatatccggtctacgggtatcccgcgtcgacaatattcccatgcatttatgtcaggtctacctttaaaaatggtaaagcatgaaaaaatggttaatgttttggaggaatcccaattgttatcctacttcagacactgattctaaattcagagtacaaactagtaggttatgtatattaactgatggaaatataatagtatcactatatgaacaaggatgtaaagatattcaataatcagataacctgcttgctattgaaccattgaacttgattgtgcaatctatgtccatgcctatataatggtatgcaccatagtgcatttattcattctccaaaattgtttacatagtatggtaccataaatattacaccctggtccctgtattagcaggtacaactttgagcatgtaaaaggatgctccctcactagaaaattctacggcatatagttttggggctcatagaccaaggaagccaactattttatcttaatacctccatttattcttgttgcatgcacggtattaatgcatcacctcactaaaatcatctaactgcatgcatgcatacaggcctctttaagcatgggcactgggtaaatcatcgacagggaaggaaggaaggaaggaagggtacaaggagatctgtgcgccaaccgccccctgttgaggtaaggtgaggtgaggatggcgatgatgaaccggacgcgggatctgctgatggaggggttcgagggcctcgtgcgggagggctccttcacctggggcctcccccgccgcggggcttcgccggtgggcgacggcgatgaccccgacagctcgtcctcctccggcaagcaggcctccgtctccggcctctcccccaaggccaacgccgtcgtctctcgatgcgcccggtaatgacctagacacatgggtgagacaattgccttctactgaaattttgcctcgccttcgggatttcttgggtttctagggaagggaaatgctctgggacgaagcattttgtttctgatatactaggttaattgaatggaaagccactgcgttggatgtgacaattcttagaaaatctgcaaataagtggttgttcggtggctttatcagcaaccaatattacattgcatatgtttgaagatcgattattataatatgtagtgctcaggatgtgcagtagggcctatgagttcgtgtttgatctgaatgggtttggtttatgatgtccaaagtccagacatgaactgttgtgtgcaatgtagttcgttgcgtccattgtatacttgttccaagggaattctaatatagaatcaaaaccatagctgtttaagatctccctaaactgggtttttgttaagatatctggatgttggtaaatgaataacttgtgtgagctaatatagtttatgtcctttgagaacgatctgtaattcttttattagcttgattggaaacatgttgatgagcatcctgcttcacggaaccaatatgatgttgtttgcatttgctactgttctgttaagctaataggcataattatgtaatactccatccgtcccaaaatatgaaattttatataattagtattttcattgttatttgatgataaaacatgaataatactttatgtgcgacttatctttttaaattttttcatatttttttcaaataaaacggacggtcaaaacttgtacacggaaatgcataaataaacttattttgggatggagggagtattagttattcaaaatctctatgtcatgtaaaatcaattcccttttcatgcaaaaacatatgtaataccagtttttctttaattaggtgctgaacttatgccttttgtgttaattacatttcagggtacttggtacttccacggatgagcttcgatatgactttgatatgcaagcatctgattccataaagcagcaaataaattatgcaagaaattttttggaatattgttgtttgagggcacttgcacaggcctcacaaattgcagggtatctttctgacaaaagctttcgtcgcctgaattttgatatgatgctagcttgggaggttccctcttcttcaagccagctcactgttaaggttacaattttcttttctttacttgcttaaatagttttcttttgttcacaccttatataatttgttagcgttgcattaataaattttcccaggttacttcctcgtattaagggcttttaagaatctttctacatattgaatttcatctcctttcccttgcaggttgaagtagagagcacagtcagtttagaggctttttcaagaatagcacctgcaattccaacaatcactgatgtggtaacatgttcaaatctatttgatgtactttcatcatcaagtggaggccggcttacatttccagtatatgataagtaccttacaggattggacaggtcactttctctactggtctgtccattcaattttatttgttcatgttttcgttatttacacatggttagcaatagacagtgacgaactgccttttttaatttcatatcagcagaataaacaaattgaatgttatggaagttctcttgatgaaatgtctaccactagtaatatataatttatctgacaaatctaaatagttactatatgcctcttagttgtcaaagattgaatgcttgtaagcaaatgttgtaaactgatgtccttttgagaatacggggaggcagggagtattacttaccataattatcatacacattgacttatactttctcttttgcttaccttccaatcgtacatatagaacttagatttacatggcgcggtgtagcagaaacaactagtttcttgtcccatgatgaatatttttttccaaaatgaaatgcttctcttcagtgcttattcttatcagggataagcggataatccactttcttgatttaatatagtgaaaatttgggcaaccattataggtctatagctcttcatttctagatgtttaacctgctgttacaaccttacaatagatgccattatcttcctactttgcactgagaagtatatcacctgtttgagttaagattgatgtagtagatccccttcttaactactccctccatagaaaattatagggcgtatttcctcaagccctctgttgaagattatagaaacacacatacttcccaatccatattttgttggtaattttcccatagttcccatacttaaagaggcctgtatgcttgcatgcagttagattttagtgtggtgatgcattaataccgtgcatgcaactagagtaaatggaggtatttagataaaatagttggcttcctcggtctatgagccccaaaactatatgccgtacaattttctagggagggagtacccttttacatggtcaaagttgtacctgctaagagcaagtttaataatatagcgcactactagctccaattcatttatagccaatctaatagacaattcataaaataattgcttactatactattaatatatggtcccacctgtcatacacacattacgtcttggagtccgtactgcagctggctacagatctgtagcccgctgctcttctctcttatcttttatctcattaaaatatgtctgtagctagctaatattctactattgttcctgctctaatacagtgaccagggtgtaatgtttgtggtaccatagtatgtaaacaatattggagaatgaataaatgccctatgctgcataaaattatataggcatgtacatagattctacaatcaagttcaatggttcaatagcaggcaggttatctgattgttgaatatctttacatccttgttcatctagagataccattatatttccatcagttaatatacataacctactagtttgtactttgaatttagaatcagtgtctgtagtaggataataattgggattccttcaaaacattaaccatttcttcatgctttaccattgttaaaggtagacctgacataaatgcatggggatatggtatagcatatttgccaatttttgttaccaaaataagttcagttatgctcctttttctgaaggtagggtatgcaagcatataactttctgttggatcttgtttcataaagtcaggactgagagtatgttttatctcatgtagagcgattaagaaaatgaaaggacaatccgagtcctcgctattatctggccagcggtctcagagaggagaaaggattgtagaaatagatggaacattgacgactcaaccagtacttgaacatgttaggatttcgacatggccaggtatgtctagttttctcagtgaggagaaacgatttcttgttgtttacatgctggcatgtttttttaacttgccttgttacggttttatatcactgggtttcagcttttcctttgctggcacaggaaggttaacacttactgatcatgctctttacttcgaagcacttcgggttgtgacctatgataagcctaaagcttatgagcttgctgaagatctaaagcagtctgttaaacctgagctgactggtccatggggctcacggctatttgacaaagctgttatgtataaatcagcaactttgtaagttctttcacacgtagcaaagctaataagcaatagagtacatctatactactaaaaatgtcagtagtggtggtgtccattctgcaacaccacccctaccactgatatgtaggcccaataatctatagtattacaccaacctccaatgagtcctctcctgtttcgctgttggtttatcttaaactttgaaatcacctacttattcactctacactacaaatgtcagtagtggtggtgtctgttctgtcacactacccctaccactgatatttacgccccacaatccatagtattacaccaacctccaactagtcctctcccatttcactgatggtttatcttaaacttcgaactcatctacttattcaattaggaaaaacataaaagtgttaatttgactaaatatgtgcctaattgacttaataagctagaaactgaattccttttccgttgcaacgcacaggttcttggccagtaaacgtaatagctgattcctatagtggtattttgctaattagttttaatttacaagtcattgctatccattcctttttattcggagatagtagcaacatgtatccctataaccttatatctttatgactagcacatagatttgctcttattacctttagttacatgttttttctttttgttaatgcaaatgcagaacagaaccagtgatcttagaatttccagagttggctggccactttcgtcgtgactattggctggccattatatcagaaattctttgtgtccacagatttgttaggaagtttgacataagtggaattgacaaagaggaaacaattttgaaagctgtactaagcattctgcggctacaagctattgaagagttagccattccagtttctaatcgattcgagtctcttttgatgtttaatctatgtgacaaacttcctggaggtgatgtaatacttgaaacactagctggttctatatcattgagaagatcagctcaagttaaccaacctggcattagcagtgcaaggcattcaatgtccccatttactgttctgtcgaatcttggagtggtatcaccaattaataagggtgagagactctttgttggcgagatagttgttggggaaatgagtgccttgcagaaggtagttactgagtcaatgaacaactataagaaggttgaattggcccaagccacagttgatggagtcaaagttgatggcctagatacaaacttggcagtgatgaaggtatactcacaacagaattagccttttctcaactgttaaagatctgttcaattctatgtttggggtttagttactccctcgtttttcatgagcagtcttcctaatctgtgacggtgcctaattaatcagaataaattgtggtttatccaaattgattccggcaccattttgatctgttaaattattcagaacaaatctaacatatttagagcttgtgcatcacaaaaatataaagtaatttttgctgaagtatatatattcatggaaatcgaaagtaatctgcaatcctttatttgtgaccatcattcaccaaatgtggtttttagacctcaccgagatccttattccaatgtaatatttttgctgaagtatttcgttgcagaaatttgcctgatcctacctatattttccagcttttgcatatttctgcatgatatataaaattccaaaattatttcctctattttggagattgtatatgaattagagcttaccatattaccacttgttttgaaaggtgtgaatgtagtaatttgaattttgatgaagagagtttattcgcttatggaaatttagaaggtatacgcatattcactgcaaatcccattgtgtatgtactccctctgatcatatatatttgatgtttaggacaagatttggtccaacttttcaaactttgatcatcagttatttctcaatgcttagtttaaaaaggaaaaaaatggtaagcatagattttccttgaaaagtactagcatattttttttatgattttataaacttattctagtataaagttgatggtcaaaatttcaaaagtttgaccaaatcttgttttaaacatgaaatatttatcaccagaagatgtatattgcttttagccagaaggtttttgttcacagtattttatactatgattgcttgaaacatgtctagcaactatacagattcatgtttcgttttttttttgtttaatcctcacttgcatttaggaattgctatctcccgtaagtgagctatggaggtttttggtgttgctggcatcttgggatgagccgattaagtccatggtattttgcttttcatcgtcttatatcattatcaggtatgctaaactcacatggatattttctttttgactttattctgcatgatgcttttttaactgtggtacactattgtgatttttttttataattttgtgcaacttactaatataatgcaatataaatatatatcactagctcctttggagtgaatgttgcttcgattgcctctaatataatccttcccaaatttaactagttcacgtgctttccatccaccttgctgctgctccgttgacttgaattcaaggataccatatactcccatttgagttgcaccatggagtgatgtcatctgaggtggtggaacagtcgatggtgctataggaagctcctcatatatattaaggccttgtttagttcccaaaaagtttttttcaaaaacatcacatcgaatttttggacatatatatgtatagagtattaaatgtagattaaaagaaaaactaattgtacagttaggggggaaatcacgagacgaattttttaagcctaattagtccatgattagctataagtgctacagtaaactacatgtgctaatggcggattagttaggctcaaaagattcgtctcgcggtttccaggcgagttatgaaattagttttttcatgcgtgtccgaaaacctcttccgatatccggtcaaacgtctgatgtgacaccaaaaaattttcatttcacgaaccaggccctaagaagagcggtgtggatgttcctcatttctttattaaacacttgaatgatgattatgccttcctgcttataattacgatcagcgtaaaacctacctgatttaggaaggaggttaaactgggtagagggtggaagccaaacactagaaaagtcctctccttagtgcttattacactgcattgcaatgcatacaaaaagtgattctcaacagtacatcacaaattcatcagtaccttattgcagtgacacattcagcctagtaccacaccatttctaaatgctgtatccaacatcaatccatcctaaacagatagcctgattacctggtgaaaacaaccgtaaccactggattttgacattggttgaatactgagcatgtattaaattttttcaatgaacaattaagaatcatggatcagctgtgaggcatattttcatagtttacacttgcagcaaattacagttaataggattttagcattgctaataattttatctctaataattattacctaacaatcttagctataatggcattcttttgtaataaaatattttccttgaaatccaaggggacatgcaattcttgctgttcctagaagaatgtgtccataatatgatgaatatttgttcttttgtgatgcatactacacaatttttgcattcttcacatttgtaaattgtaatatcctctgtttctgtgatggcacagggggtggttagtctattttcttgttttggtgctcttgttttcggcaactttcatgttctttacaagactaactagccatgtaaatccaatgatggaggtcaaagtgacatctccacctccaatgaacacgatggagcagctcttagctgttcaaaatgctatttccaaagttgaagagcttgttcaggatgcaaatattgttcttctgaagattagagctttattgttggcttctccctcccaggtaactatatttcttagttcttattcttcaatccttttagggagctagtactttgttcattcattttttgtgcttcctaggctaacaatatatgtgcgctattcgttcagcttgttgatgaatgatgctatggaaagaaaataatgatatgtgaacacaagaaaaaaatagatacaactagaaattgatgaggttaactaatcatttgaaatcaaatttactacccactctgttttttctaagcgtagtacaacatatgcatctcgtctgatgtactgctaattattccacacatttagcatatcaacattttgtcttccaattatttttcttcatggtcgatagagacttttaaaattttccaattaaattccttttgtaatttcaaccctcataacagattatgcatgtaacttaatgtttcaaatttgtgtagttctatagaaacgagtggatatgcttctgtgtttatgttacttttgagttccatttgattttttttcccttagataaggtatattcatcaatcatgaggcataagctattgaagttgttttactttctgcatctacaaatattcagataatgattatttattgttattctggaagagcatatcaggtcccaattgctctccctcttaattttgtgaattggatgagcaaacaatcatttcatatttagttggaaggatttgaaaatttgaactgaaaagtagtataaattagaagaaaaaaagtagtcatcaaagaatatatgacgtaatgccaggattgcagatgatatacagtctttccttcttcatccaatctaacttgcagtttgtacaccttactatgtgactctgtacagaccattctgccttgctggacattggtctcacctttagtgttttgattgcctcatagaatcagaagctagatggcatcattaggggtgcaaaacttagatgaatatgttgaaactgttgataaaacttctgcatttttctaaactttgctgaaccttgtgagatccaacatattttgacagatttcaactgctttcttttacctcatatcttgcaccttcaggctatctatactcctttgaaaagaatcaaatggtggtgcattggatctgccacgccacctattcccgttatagtttgtacatattacacgataaacttcttaacaatatgtaagaaccaaatctaaatggagagccacatataaaattaaattaacgtgagtattacttatagctaaaagttgtgtaacatatttcatgaaaaatatgcttttacttattataggaaatgttatgggttttcttttcgttctatcagtggctagttgtttgtaaaagataaacatagcacatagcaccctttgtttcagggtctcaatgacacctgaaacaaacttataaaatgcatcaacctgggatgtttctttcctagccatgcctcaatcaaagacaaaattataaaaaagaaacataaaagctttaataaatgtgagactatttcataaaacgatgagttgtgccattctagcgcacatggtacgtttgaaacagtatgatgagaagccatgctgttgcaattgcaaatcttgccattgccagattcgctagcaaatgctatcttgcgatttaggtatcatagcaagatccccaatatgttgttttgaccttgcacatgtgcacgtcgcttcgctcacctacattattttggttgtcaatttcacaggccactgataaaactatacttgcgttggtagtgatggctctgagccttgcaatcgtgcccacaaggttgcttgtcctgatgatgtttctagaggtattcacgaaccactccccacctaggagagcaagcacagaaaggtggaccagaaggttaagagagtggtggttcagcattcctgcagctccagtagtcgtggagaaggataaagaagacaagaaaacaaaataaaaaatgtatatgtatattcaatgtaattatgtgccttgtttggccgatgggttggggtggatcaccaacgctcgtcttgtacagtagcagttagtatttttaataaaaatgcgagttctcacctagaaattaattgcttacctcgtattttgattatttcatatgtagtatcatcgggtgatcagggatgttttttttatcaaaacacagtgagggaggctcccacgatatatattaaagaataaaagagtatatacaatggcaagcaaaaacaaaaaaaaagaaatattacaattgatcaatccatgattgcactaaaggtttatgcacatccttgagtctagataaatgtagactcgatctgacttcaagtttttcttccaagaagaaactgaaagcagaatgccctgaaaaattagaccattcctttccttccaaatattctaggccacaagcagaaagagttccatgaaacaaggaaaaggaaatgaagcattttgagtttgaatcatttgatgaaagtccaaagaggtcgaccaaatccagcccaaactactccaacaggcaaaactgaaactgctgaggaaaaaaagatgatctctggtctccttgacatttagagcacaattagaacaatttgctgaggcattcagaggagcacaatgtttcctatccaaaagatccctggtgttaactatgtccatgaaaaataaccagcataagactttaatattcatgtttattcagctctgccagatccatttgaaagttacgggaggagataaaagaccagaaaattgagcttataaaatttctcagaagaataatttgatgaacccagatataaacccaagtgtcaattgaatcaaacagagtaaccagttaaagatcatgcaagagaatctcatattcatcaaacgcctgatgggataaaggaaagtgaaactggtcatcaggatcccttgacaagtgccgagcaacagaatcatatttatgtttagcaaaggagcacaatctagggaatttattagatcttacacaaccttcccaaagatcatcccaaaagagaatggcctgtcttgagccaagcactggcttagctattcccctgaaaagtatatcaaactgaaacacatccttccaccaaaatgaaccacaacatgttgccgcatgagggacctcaaaagaatagtaggaagaccatatcagattcacccaagggacatttatctttttgtagaacttatgcaaatgcttaagcaacaaagccttattctgaattctcagaaaaattacacaaagaccccatttttcttctcggttgcacaatttggacgatgcaaccaaatatttcttggtagaattaagatcacttcctctccaaaggcaatgccttctggttctatcaattgcatcaattacagagatgggcaatgatgtgcactagggttcccaatcttccgaaaaggttctgataaacaacaatttgggcggaatcgcgacacaaatcaatccggcttcttgaacgcgcacgctcttgagccccgtaatcgcagcaccacgtctcctctggttatcacccgtgttgaaacgcggattacctcgccgagaaggctaatctctgtttgccaattgaagaacacaaacaagaacgagatagaaaacaaccaaaattgcagatgaatgattaagctcacgagttggggtcttacaaaccgatctagcggcgaaactgttcttgacagattaatctaaggaaaacccaaaaacctaaagatggcggcgggtactgatatatagagtttagggttgtgcaaccccctctcaacgcaaccctaatgggttccaacacgatacacgggccaaaggcccaaatacggtgacacagcaccgctacagattctggacgtcaacttgtttggtcaatttacattgacccgaaaagaatttggacatgggaccaaaaccattggaaaggatatcttgttagctttccatccatataaagaatgccccaatccgagcacgtatgcgacctgggcgcccattttagtgcagactggtcctggactccgaattgcacccggcgtcgacttggtttgggcctccaccttgacttggtcgtactcgatgatcctccatggctctaagtccttctccaagtgtctccttgtcccctccattgttcctaatcacaatataatcattaggtagcaatctattctcgaattcatacaaagaagaacataggaacgaactcacctctaaatttaattgtcgcgcacaagctcttgttatcgctcattgaatgaccgttggaggattgttgtgtgtatccgaggtagtgatgtccccatcaggcaaagacaaagagcacatgtaataagttggaagggatgacataatagaattgaccaaagtgagtctgtctccataggataggaaggctgagctagctgttaatcttctctcaattctatcagtgagtggggagaaatcgaccactttgggtctagacgttcctaggggtaagccaagataagtaaatggtaaggtcccaattgagcaaccaaaagttgaggctaacatgcacgacttctcctctgagatatttaatggaatcatacaagatttggcaaagttctccttgagtccagaaggcaatgcaaaagaattaagtaaggccttcagagcaaagagctatggtgctgaagcttccatgaaaataagagtatcatcagcatatttttatttgaggtgaacgatggcagaagacctgccggaatttaatttaagggagtcaaaaaaaaatcacccaggaaggcctgggaaacgttacaacaaaagacaattagggtggccagaaagccactttgcgcaaatccaagtcttgttttacccgataagctactgacaactccgaactagataaattttggaagattctactatttctttctagccaaacgttccaccaagttgtcaggatagcacctcgagcgagtaattttttatcttctgttcctgcatccttaagctcatcccagcagcaggtagagacacaggatggaagggaattgaaaaccgggggcaggttttgccacgaatgtactgtagaccatacttgtctcataaacgggcattccgcgaacagatgattggtgtcttcgaaggcggaggtacacaagcagcaaatccaatcacacggccaatgtcttatgagcaagttttgagccgtcaaagttctttgatggaggacaagccacccgaaaaattcaattttaggctcagcccgggctttccagagtgaggtaaaatcgcttgtagtgtatgaaccagcaaattggtataagtaggcactcttggttgtataagttcgagattcagtccaattccagactatgtcatagacattttgagtgagttgaacctgttggagcaggccccccaattgcaccagctcatgtaattcttcgactgaggtaatttgtctgaaggatgaaagccagttattgttcgtcaactcgaactgaacccttctattctttctttttgctaaagagaaatagaagggggctaactcttttgggcacctcttgtgcagccaattatcatgccaaaaactagttttagtgccgttctccaccgagattgtggttgccgcctgaaacaattttttatctaaatcatcgcaggggatattcataccaacccaaggtttgtcgtcggatttccaagaaaaccacagccagcggaggcgcaaggcccttgcgaatctttcaaggtcaggaagaccagccccccctagagattatggtctgcaaactagttgccagttaatcaaactgtcacctggattagtatgatcagggtcctcgcctttccaaagaaaggatctgcgaaaacggtcaatccttttaaaaacccacttgggagcgcggagggccgttagatggtgaatcggtatagagcttagaaccgaatggcctagagttttacggccatcagaggtgaagaaccgccccttccatcccagtagacgtgacccaatcttatcaataagcgggatgaaatcaatcttccttagttttcgatagtgaagaggaagtccaaggtatcggcaggggaaggatttaatcatccccgggaaacttgaaagaagattgttcaaatctatctcatcacatctaataggaaagatttctattttgttgctgtttggatggagcccagaaatttttgcaaagaaatcaaggatgtgagagggaagacagttcggcactatttggatttgcaaaaactgccacatcatctgcataaagagaacatctgaatcttgcattgcgtccatttaccggttgaagaatagtagcatcttcagccgctttaagaattcgatggaaaggttccatggctaaaatgaagagcataggggacaaagggtcaccttggcggagtcctctagcattgttgatcaagtgacctggcgaaccatttagcaggacctgagaaggggatgttgccaggatatgagagatccagtttatccatctgttcccaaaatcgaaatttcatagagcttcaagtaagtagggccagcaaacagtatcaaaggctcttgctatatccaccttgatgaataagctttgcttttttgatctatgaagcagctgtatcatgttttgaacataaagaaaattgtcatgtaacgctctcttccgaacaaatgcactttggttctgggaaaccaactcattaagtcttggagctagtctattcgccaaagttttagtgattttccttgcaaaactatggaccagactaataggtcggtaatggtcagcgccagaagcgtcatctttctttggaatgaaacatataaaggccgaattcagtttttccagttgagatgtgttaaggttcatgaacgaattgattgccaccatgatatcatccttgataatctcccaggagactttgaaaaaggatccaataaaaccatccggacccggagccttttcgggaggtaatgagaagatcgtcgcttttatttcctcctccgagaaatcctcctctagttccgaaagatccaaggactggagccctaaagcagcccagtttagacccaatgatctttggttatttgtcccaggtctggatttgaaaaaacggaacagctcgtcttccttgtcttgtgccgatattgccactcctgagggagtttgaagtgattggatgtaattttttcttctcctagagtttgctttgatatggaaaagttttgaatcaacatccccctctttgagccaagtgagcctcgagcgctgcctaattttaattttattaagggttgagagacctagaaatcttgatttgagattggagaggagtaggttctcttgatcagatagtgacctggattctcgagctagctaaagctggaaaattacttcagctgcaacagctaattgcaatttgatgtctcccacattgcagcggctccatctcttaaggtcacgggctaaacgccgaagctttaggcgaaagatggctagtcggttagatgacaaaatcggcttttgccaagagtgttggaccacttctagaaaacctggaacttcaagccagtaggattcaaatatgaagttggaagatttgctcctcttttcattacccagtaaaaagagaggtgtgtgatcagagcatgcagaggacagagggtgcataatggagctctcaaacatcaagtcccaatccacagaagcgaaagcacggtcaatctttgtttgtgcaggatttgatccctcacctgcccaagtgaaacgccggcctggaagaggtaattcttttacctggatcttgtctaagagtctgcggaaatgttgcatcatcgctctgttaaggcggctattgtttttatcacaggctttgtaaataagattgaaatccccaataattaaccaagcaggtttcaaagagacttgaatattttcaagttcagctaagaagtttattttgtcagcatcaagttgtggtccatacaccacagtgatagaccaatttagtccttcttctcgcatggacaccgtagcagagagggagtactgaccaagaaccacttcggagattgaaaagaaattttcatcacatgctagaagtatgccgcccctagtaccatctgccggcagaaaagcatgttgctgtacaaactggtgacccaaagtgttgagaataatttgattggagatagcagaaagtttcgtctcctgtaaacagacaatcgtcggtttatattgctagatgcaaactctaacagagtcttgctttactttggcattcaaacctctcacattccagttaaacaggtaaacattgtcttgtgacataggaccaaaagggcacagcaactctactctcgcagaaacactcccaacgacgatgagagaaacacagcaagagaggtacaaaatagggacagcccaatacaacacaggaaactagacagtaggaagcagcttgacatagtggcaactgagacttgaacatcagggttggagacgtcatggatgttatgctcgatgacatctcagtagtaggggcgcttacaggggtgccacgaccgccttcttctttgcagccttcaagcggatggctttgcatccacccttctccactagctcggagattgtcttcaaagaggctggggataaaggcttgttgaagtgctgcaagtaaagctttttgacattatcatcaaaagaagcgtgatcatccatgaaaccaaattttttagaaataatttcttgagcaaaattctctaacttcgcgtctgaacgccgcttggaaagcaaacgagcactatgtctttgcgctgaagcaattgcaggaactgctactttaacacaggcatggcggtgagtgttgacgtcgggaacaggaagaagcgccggccggattggggtcgaaagctcagcaaggaaaccatccatctgatttccggaacttttgatctttggatttggactgacgagccaagagccatcccgaggggtggtcctttctcccttacatctgctgatgaagaagggttgccgacagacatcccgctccccgacctagagccccatcgcaatccgccgccctctgagcccaaagaaggctggacctacaatgtcctgatccatgtcgacacacttgaagacctccactcgcgcaaggcccgtgcctacaagtgggactacgaagttcaagatgatgggtcaaggtacaaggagtatccgctgccttgcagagcggaacctgatcctgctcggggtcccagggacgacaatgatgacaacgatgaccagtccagggggcgccataggagtcgttccctttggaatcgccttggtggacactcctcaagtcgcagtagggaacctgataggagggatgtgcaaaggcgtgaccaagagaatattggatgttcatcagcatattggatcactgggaaattatcatccccgtgaacagggataggcaaagataatatccccctctaatgtgcttatagcctgaagaagatctgctcctatggcaaacagaaggggggacaaaggatatatcgatccccttgtcttacacccctcttacattgaaaaaatttaccaggaacaccatttaatagaacaactgttgaggtagacgagaacatactcgtgatccattcattccattggggagggaaacccatagctgtcatttcattcagaatagcatcatgatcaattgtatcaaaagctttttcaaaatcaagctttagaagaactatctccctcttagacagcttacattgatggatgtattcgaaagcccatgctaagtagtcctcaatagagtttcctttaataaatccatactggttttgatggaccagctttgtcaggattgattgaattctatcagcaagaactttgcacataattttcactgagaaattcattaaggaaattggcctaaaatcattaggaggctgaggagccattttctttggaacccatgtgatataggaatagttgattgcagaaagatcagctgagttcccacaaaagtctgcacaaagccgatagaaatcttgagcaattagtccccaactggacttgtaaaagcatccattaaagccatctggtctaggagcttcatcaccagggatccttttcaccacttcatctatttctttggtagtgatttgtaaacaatgggacataaggtcacatttatcctcaataagttcactcagatcaaaaaccattttaggtttcatagaaacacccattctttccctaaaagcattccaaagaatggcagctttcccctcatgatcagaaacttggtttccaacagaatcaatgagagaagagattgcgttaattctaaacctctcagtagccatagcatgaaagaattttgtgttttctctaccaagaagaaccatttgtttatatctctgcctccaatattgctcttgccagttcacgaagttcttccaaacgatcaaacgaaagaattactttattacaattctcaatagccttagagagccagaagaaagaagaactccattttttttaagaaaccttctgagcttcttgaacttggcatagattagtttggtctgatcctgaatatacccaatatccacccaagcattagagacctgctccttgaaaccaagctaggaaatccaaaaatttttaaaacgaaaaatattggattttgggatcattgtagcaatctgaattttaattggggcatgatcaaacacatttttggctaacaccaaagcctgagtgttggggtatctagaaatccaattggagaaggtgaagacccaatcaagttgctctaaaaggggatcaccctgcatgttactccaagtaaaagcacggccttgaagagggatctcaagcaaactgagaaaaatgatgaattcattgaaaataaagatatcattcatgtttcctcctgtcttatttctgttcaaaaccgatctataaaaattaaagtccccaaggatcatccaatagtcattatcaatctggagatcatgaagccaatcaatgaactcatctctctcaggaccatgggatgggccatagacatttaccaaaacctattcctccccatttattttaaaaataaattgaacctctagggcaagttgagtctgttgcaataatacccccagaagctccaaccgaaggagaaaacaaataattatcaaagcgtcttagagccaaggatctaatgaaactatggtcaaagtgatctttttttagtttcctttaaacagtagatcgaacaagaactctcatcaattttctgcttcacggcttggcagcgaactggagaatttaggccacgaacattccaacataggacattgcaagatatatttggaggattcatatatcaaatatagacaggttacccaatcccatgcgaagcatggaacaaaagcaaggaagtgtatatttaaaatttataaatgatctctgatggagacaaaacatatataaaagttgtagatatagatgacatctacaattttgtagttgataaaattttcggttgagcacatatatgctgctaaatatagattataaatttggataacaataatcacaaaacaatagcatggtaagaatctttagaagcatgtctatgaatatgggttgcaaaaatcatttgatatgtgggaagcgaagtgtgaccttacaggggcgtaatgaaaatatcaaatattttttcatgtttcttagcgcctataaaaataacgagacaattgcatatttgaccctgttgggaaccctaactaccaatttgaccctacttcttgaagtttgcttatttaagcctccttttcaaaaacgaagctcccgtatgaccctgttctgttaagggcatctaacggtgttaactgaagtacaaaa

SEQ ID NO: 15243 - DNA, 1302 bp, Oryza sativa
tctgatgaagccaaaccatatataaaagtggtagatatagatgacatctccaatttggtagttgataaaattttcggttgagcacatatatgctgctaaatatagattataatttgggataccaataatcacaaaccaatagcatggtaagaatctttagaagcatgtctatgaatatgggttgcaaaaatcatttgatatgtgggaagcgaagtgtgaccttacaggggcgtaatgaaaatatcaaatattttttcatgtttcttagcgcctataaaaataacgagacaattgcatatttgaccctgttttgaaccctaactaccaatttgaccctacttcttgaagtttgcttatttaagcctccttttcaaaaacgaagctcccgtatgaccctgttctgttaagggcatctaacggtgttaactgaagtacaaaatgtctcttctgcccttactcatttgaccctattacatgtgggacccacccgtagttctctcttctcctctcctctcttctcttccttctcctctcctctcctccattgggcggcgactgatggggcagtggcggcggcggcgctctgagggggcgtaaggagggagcggcggcggcggcggcggtggcggctgacggagggggcgagttgcggcggcgcacggaggtggcgagcggcctcgctggctcatggagggagggaggaatgacggcggcgcaggcgaggaaggagggaggcggcagcggcggtgcaagcgcgcggaaggagggaggaggcggcggcgccaggtctgagggggtggcggcgccggctccgggtctttgtcgtcgtcaacacagccggctcctgctcttcgtcgtcatcatcaacagggcgctggcgccggctccggctgttcgtcgtcgtcgtcagcagggcaccggctctagctcttcgtagtcgacgagccaccactgccactcctcgtcgtcgtcgtcgtcaccagggccggcaccgacttgtcgtcgtcgtcactagggcagtgccgatctgagggggtggcggcgccggctcgccgtctcgctgcaagtcgccgctgtcactgcaagtcgccgccatcgccgcaaggagagaaatgtggatagggttgggtggatggagagggttttctaagggtattctgggtattatgaatattagttgtatttctttttcattttaaatcaaaacttaacggactaatggaaatagggtcagacgggaaactcgtttttgaaaaggagggtcaaataagtgttgatgaaaaacaagaggcctaggagatc

SEQ ID NO: 15244 - DNA, 8765 bp, Oryza sativa
  unsure (1)..(8765): unsure at all n locations
cttagatcgaaatatatattaataatgggacaatatatgttcatagcatagccgatcagatagatctagcatgtatcggctagtactccgatacgactctatactaagatattaaagcaagtagaatataccaaacaaaagcctaatatacttaaatgcaacaagatctcaacataaagggcagatttaacatgtcaataaagcacataaaacaaatatagttaaatcaggtaagatcggctgaaactccgatactaccctaatcggcaaccaagaagcaggctagagattgagattctaatcacgactcaaaagatcaaacaactgatgcagctataagtatgaagggaagaacaatatctagacaatcaagctgctggaagtttcatagagtggtggatatcttatataatctgaatcaacatcgatatttaacctaatcggctgccctctatcgacagatgttagccgattgtaagttaaatagcaatattgctagagattatgtaagatatatgataactcgatgaattacataaacaagattagagtatcataaagatgaaagcactaattccgagaatgcaagccgtcataacaagttttacctcttgttgaagatcgaaaccgatgcagcttaacccgaaagcaagaactcgtctaaataagactaaagcaaaaagggtggcgatgcaccgagattgtattgaacgtgtatgttcaatgattacatggggttcggggtctatttatacccgaaaattacaaactatgtccataccggacacgactcttatatctaacaaaccctaagataccataagtctttgcggcagacttttgcccaaacatatctctaaggaaattacataaaatatcctaattaatagagacaattgccttcttaggactctattaatgtgtggcaatcatcttgaagcatatcaactgaacccgatgtcgcacaccaaatcgtattgtcggaatcagctgtatcggcttacccagtctgactcggactcagccgattctgatcgtagccgatttggactccaaccgattcttactctgtttccgcaacgatcttcaccttcgattccgcttcgattcagtcttcttctccgatactaatattaccaaacttggtcgttaacacatgccccccaagtccggaatattggataatgtttcggattttccatatgccgattccgaaagaaatccgctcttgtcattttccgaccgttactcccatgctttaaatactaaccgttacccccaagaaatctcacatcatcttcttccgttttcaccgctgaagcaaattttgccctctctctctctccggcgattcctccgacgcaaaaggcgatcccagggcgattccatctccggccagatctccgcctgcagtgatgtcgtcctccgacaacctgcctactgtgccgtcaaccgagtacgatgaggtgagttcccatcggttagatctccttttcccgtatcggattgatttcccttttcctcatcttgttttcttcttctcggttcttttggatttgcaacatctttctaatttgatcgcaattccaagcctatctcacgagaatcattattttcttggtccaatcggcaaccttgatcccaccgagttcattattggtgaaacaaataggattcctttcagattagccaacccagatctacatcactggaagaacacctttaaatcttggccatcacttgagaaaacccacccgagaagagctggattacatggtacaagcgcgtatggccaacaaaaaagttcattgggataagatcggaatcggccaagcgcttgcccttaccatagccaactcagctaaggacggacctctgatggctgccgctacctatttctggtccagcaccatcaatgcctttctgttcaaccatggaccgatgactccaactttgatcaacaccaccatgatcactggattagatgtaacttcatcggctaaccctatgagtatgaataccaagaaccaatttgacttcaagaccaaaagcataggaggttggtctggctatgtagcggcatatatgggcaaagggcctatcactcctcgggagcatgtagctttcttactaatgtggctagaaaagttcctcttctgtggatccagctatggtcctacaaccaattggcaatttgtagccgaagccctggaatcaaagaagcaatttcccttaggcaaaatcctcctcggcaatctataccaaatgctgaataatgcatcagccaagatagctgtcggctcagtagtgggagtaggtggaccatggtggctgctgcagacttggctaaatctgatggtcatgaaagttgtcaatcggccatctgtgacaaaagctgaatttccaaggttggagccgattgtggaagatgcccgggtttggtttccttatgaagactcagcagaccttgagcttccatcggactttatatttgaatacatcaatcatgaaagatatcaaaagtccagggatgtgttctcagctgcaatcagcccatgcattcttcctttcggcattcatcaaggaagaaacattcaagtctcttatgaattttatcacccgatgagctcagctagacaacttggagtgggtcaactcccaatcgggttattcttcgccgataagatccaatgccgaggagaaatttcatcaaccttaatgatggatcggctgctaaaaaactaaccatatccatggcgactctcttctctggcgacgtccatggcgactctctctagaagatggtcacgccggcgccgcctactggatgggatttctccacgggggattccatccgtgatgaagtttggagccgttttggttcaccggttcacttttcctctcattttagccgttctacgtttcgattagtggttgatgttcctcgttcttcgtttcgattgacctcgtcctcggtggcgcttgctcttagagcggcgattggtggttctccgtctgatcttcatgttgatcctttgattgatcgaagttttacttttctggtgtgttctaagaaagttggactctggatctactctctcagatccttttcttgtaaggatttctcggttcggtattttctctggaagaatggaggtcctgattggagacgggaatgggatctctggcaagctgagcaatataatgaatggaccattgtaaagcggcgatattcttcgggtaatcgttctcagcatttgataaaggcttcttctgtttttgatcgtcttaagtttgatattccatcatctccgaagaggattactcagaagtctgattctattgtctccaaggaaatttttcttgctaattctgatccgaaaggtacgcatcttaatcgtgataagcgcggaattcttccttttcaaattagaaccgatctgggctggtttgttttcggtgtttgggctctgatcacctcatccgggattgctgctcggaggttagatgtttgcattgtaaaagtctgggccatattaaaaagttttgcccttctgttgggcttgttaagtctccatggcccaataaagtggtgtctgctaggggcttgggaaaaaaactgtctgtcccaaaaaaggagcaacctttgcgcattaaaactccacctaatcaggtctgggttaaaaaaaataagaaacccccttcgtcttctccttaagttgctcgctctctagtagtggcgtcagaatcgcagcctcaacctaatcctttccctgctccaatggcaaatactaaccttaatccccatcgcttcctgcgtgcggggcaagtggtacatcaaggtggtgatcgtgtgccaagaatcaacctctctgctgctaccaagccgccaaggtctcatgaagagtatgccagctttggttgagcccatcttgccggaggaactttgggatgatcatcggattctaatttctgaatacattgagcaggtgcagcactttactgttcgccgtagttttcctcatgcttcagctgtgggtctattcaagtttggttctgccatggttagggacctgctagtttatgctcccccttttatgtatgatggtatacatcaggtcaactttgtcagacatgatcagagtcctaactggcgtggtgctccatttactagaactgtctggtttttattgctcgatttccccctagattacatcaacatgcagtacatttgtctggttgtctcttctttcgggcagttggaggaatggtatcaaaatgacccaatagagggcaaagttttggtcagagctatgttcaaggactttgattcagtcccaaggaaaattgttcttcaagatcccacaagtggtgctggtgaatcctggaccatctctgtttttaccttggagggtgattttgctgatatttttccccctgatgaagaccttccccctactggtccaaataatgatgaaaatcctgatggtaatgatgatgacgatggtaatcaagataatatttggcaatttggcccacatcctgtggttcttgcagaaagaagaccaggcttggaatcaggctgctgtgggccatcaggccatggaccttgaacaagctgctcctgagaacatgggccagattgataacaaccatggctggaatctggttgctaacagaggtttaattttcacccttgctgatgctttcaaagatgccttcaattcctggtatgccaactctctggcaaattcagcccttcatcctgcaaagcttaattttaatttgggaaatgaaattgtgccgtatgattctatttcttttgaatcttctgctataatcctgagccgagaacctctagctgtcatccctccgtagtctgtgatgcctattttgcctgaggatccttttggctcaatggaggaacattcttgtccttctactccaacaggcatggaaatagagattagtcttccaccttcccctaggaaaagagggaagaagagaacaccttttgttgactctcaagttagaaggagtggtagacttctggctcttaaggatggtttcaagaatattctgcaagaggatccaaacatgggtgttggaaagccaagagggaaggcagttaaaaagctgaaacagttggctgaggtaagtggaattattttcccatccgattcattatcttctattgatttaaatcctgatatatctcgtgaatctgaaagtgatcttacatctgctatacctgctaattgtgatatatcttttctccagaagattggatctgagatgtgtgggacttcccttgaggaggtttcaagcttggtggacttgggagaagctcaggtcatcaagctgaaaaccattggaccatccaatgatgaagcctagttctatcagacttttagggctgctagttgcactctttaggggcatgtgtttattcctttatcaacccttttattttgtgtttaagttatgtaaactctatgatggtactatgtgttggtgtgcttgggacctgcatggattattcctgcttgttatctttctctcttcaagactagttgtcaaatgaattcggctatgagaaattggaatgtcctctgctggaatttaggggtctgaattctgatgacaaatggttagccactagaaataaaattgaggaaagtggttgcgctgttttttgccttcaagaaacaaaaagatcttcttttgatcattcttacataaagaagtttgctcccaaacattttgacaagtttgctttctctccatctgttggagcttctggtggcattttagttggctagaacagttcagtttttcggggatcagatattgtaattgaaaggtttgctgttaagattactttcacctcaaatcattctggtttagtttggactttcgtttaagtttatggtccctgcactggtcctgaaagaaataacttcctgtcctggctccaccagttgaacattcctgatgatgacctctggctcattcttggagactttaacttctatagatcagttacaaatagaaataggccgggtgcagacatgaatgacattttcctgtttaatgcaatgatcagtgatctgggtctagttgagttgcccctcaagggaagggctttcacttggagtaacatgcagcatagtcctctactagagcaattggattggttttttacctctactgcttggaccttaaccttcccccataccttagtaaagccacttgctcggtctacttcagatcacacaccttgtgttgtgcaaattggaactaacatccccaaggctgacatcttcaaatttgaaaatttttgggtagagcatgatggtttctttgatttagttcaatccatttggcaaaatcatgggtatgaaggtaatgcagccaagaatatttctgttaaattgaaggctttgaggaaaggtttgaagaagtggagtaaatctctctctaaacttcaattgttgattaaaaattgtaatgctgtcatagcttttttggactccattgaaaacttgagagatctcactgttcttgaatggaactttagaattcttatcagaaacaagctactactatacctgaagtataaacaaatttattggcaaaagaggtgtactatcatatgggccaagtttgggggtgagaatacaaaatttttccatgctatggctactgagtcttttagaagaaatgcaataccctctttagtagattcttttggtttagtttgtacaagacatgaggaaaaggctcacatagcgtggagtgctttctcttcaacaatgggttgttctcagtttgagtttatgccttttcagctgcaagaacttttccatgcaaatcaatctcttgcttctttggatcaaccctttggtatttctgagttagacaaaattatacagaatctgcctatagacagagcccctgggcctgatgggtttaatgggatgtttgtttagaaatgttggccaatcatttgtcaggattattatagacttgcagctgagttctactatggtacactggacctggatcctttaaaccattcttttatcatcttggttccaaagaaatctgtgccaaaaggtataaatgactataggacaatatcactcatgggaatctctcttaagatttaaacaaaagtcctagctgatagactgcaaaaggtgatattggagataatcagtcaaaatcaatatggattcataaaagggagaactatacaagactgtctagcatggaactttgaattccttcatcagtgccatcactccagaagggaaatagtccttctaaaattggactttgagaaggcttttggcactattgaacatgaagctattttgcatgtaatggaagccatgggttttagtgctacatggtttggatggataaggaagatcttttcttctgcttcttcttcagttctggtcaatgggatacctagaaaaaatttccactgcaagagaggagtaaggcaaggtgatcctctgccacctttactctttgttttaggagctgaacttctccaggtcattgttaacagagcttatgcaatgggtcatctatcaaagccttttccatcagactttgacccaaattttcctattgtccaatatgctgatgacaccctgctttatttgaaagctagtggttaagagctctttactctaaaggctttattgcaaactttccagctgggaactggtttgaaggtaaattttaataaatcttgtctcatcccaataaatgttgatgaatggaaagctcagaacttagctgcagttttgggctgtcaattgggatctttgccttttacatatttgggtttaccatttggtaccactaagccaaaggtaatagattttgcacctttagttgacagaattgaaagaaggcttacatcaaatgcttcattcttgtcttacggagaaagacttacactggttaattcagttttctcttcactacctacttattacatgtgtactttaatgttgccaaagacagtgattgataacattgacagagcaagaagacattgtctttggagaggctctgaggtcaactccaataaaacatctttggcagcctaggataaagtgtgtaagcctaagagaaaaggtggtttaggagtgctaaactttactatccaaaatcatgctctgctcatcaaatttttggacaagttttacaataagaaggatttgccctgggtcaatctggtttggtttgcctattatggtaactctgtccttcatttgacaaacttgaagggctcattctggtggagagatatttgcaaactaatggatgtctttagaggtattgcaaagtgtaatatgaaaagtggaaatacctgctccatttggtatgatgtatggatgatcaaccccctctttttcacactatgccaaagctttgttcttttgctcaaaaaccaaaatgcatctgtctctgtgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcaacggactagcgggcctacggctccatcttcacaggcgctcaactggggtataagccaggnnnnnnnnnnnnnnnnnnnnnnnnnnnnnnnnnnnnnn

SEQ ID NO: 15245 - DNA, 4857 bp, Oryza sativa
  unsure (1)..(4857): unsure at all n locations
agggaagggggggggaaaagaaacctttttaggatttttctttttataaaaccattctaactttgtttatttcttaataattattatttgtgctctgaaaattccactaaaatttgagggctccttttagaccaaggagaatttaacaaaaattctccgggccacatttgaatttttcttatacgcattttagtgtttaccaatttcttttcgaattttaattaattctattattccttttagagaatgatttttatttcgggatgaatttatcaggacgtgacaaatccaccccccttacaagaatctcgtccctgagattcgaggaggctagcatgaagataggttgggcggtcttctcttcttgtctgacttcttccgctccgtcttctataacaaacttgcctaacaacacttctccactctggactgcttggctcgatctcctgttgcaggtggaatcttctcttcacccgacttgtccctagttgaacctttagctgacttcgactaggttgcggcacttgaagatggggcttcagttccagaacttcttataattcatatcttcggcgtcaacctcacacaagttatcaacttcatatcatgtgtcgtaacctgcttgtcattactaggataccatgcttggcgtttccttccagcttaccaccatatgctttagactatgatatcccacttaccaaggataccatgattgacaacttgccattaactgtctcattttagctttcctggtctccggtgctaggtacttctgctattcgatgcaagggtcaaccactctaactataagttatgcttcccaggagaaccaatttatcccacttgacatgctttgacgtcttcccgaatgactttgctgctggacttgttattgtctgatcgtgatcctgccagatctgaagcttcgttgttacaggtgattttaatctgacctctgtagactatcttcgatcatatcacttggttcataactgggaatagctcccacgaacaagcagctcggattcactttctttacattcagtttacttcccattgttatcttcaggttgtcctcagttagcattcaacgtattcctttacacctttaaccttgatgtgttctttcccattggatcatctcccaagacatggcattacctggtaaccggtgcttgcacttttcactccgtgtagcatctgataccgagttgaagatttcactccctgccttcatagaaacacttttacctaggtcatattgcttacttaatgacaaggtgactgttgcggggcaattactatcaggggtcttccttgagcgatgcagagcatgtttctgtttatcaatcacctttcggcctacttctttcatgctggagaacatctttgccaatctcttttatcaatcatctttcggcttatctctaacaggtggtattctttaatgtggattgcggacgcttctggggacgatgaggtcctttggcttgctgcctttcagtgaaaccttgatgtggttcgtcacaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaattattgatgtctcctggatcttcttaactgtttgcaggtatatccgaacttatcaatgtagaggcatggcgggtacccttatgggtttcatccaacaagccttatcttgatctgtaaaaggcgtatccaaactcctatccccaactactgtctcattggctttttaacccaacacagtttaattggttttcttttccatccacaggttggttattaactcgaggttagaatatagttcctctgacacgagaccctaggtctcctttgtcagtaaacaattatacacctgatcacatatccgcatcttccaaaagaatcctcttagaacttgtctgtattacacatttctcccttattacacgaatacaaggcactgccttaaacaaaaagggaaggtgcttatcatcgatacattgtatcctcaacatgaatcatccctaaacatagcaagctcactgtttacaggcatgaatatatttatttattacatgattgctgcaaactttcgattacacattgataagtagcgaactggaaaccacaaacatggatacatagctggcattgttctagtgactgcatccttgattggttctgtgatgatgtgataggactgcatattgctattattcaccggagaagtttccttctgattgctggttgaggcgaataacggtcttctgctcggtatcgccctccggaggttgattgccctttgcttggcctggagtaggtcggggagagacacaacttctttcatcgacgacaattctttgctgaggctgtcggtgcagagaatggttggtgttgaaggtattatcgctatgatttattgcaaagtcaggtgcagcaggaggagcattggtgctggggatgatatcgtcgatgttgctgttggagctgactagctgatgagacaatcgtagggttgttcgttggatttctacggtcttggtcaacaacacactgagttggcaatccttgggcacatggtttgcaccttcgcacagaaaacatgtgaccttgcgggtgagacactcccctggtggatggtcttcttcacaatgagtgcagagtgtgagacacatgctagcaacgtgtccaatttccccgcaacgggtgcatgcctttgattccatctcttcctcgccgagatgtcggggagactcatcttcataatccgaggagacttgatctgacccttcactatcagatactctgccatcatggcttaggaggtgctgggtcaactgttgtgcacctcggaaagtatttcctctttgacgtctaggaatagttatccctgctggaggccattcggtgctggtaatagtcatcttacgtacttctgcttcagttcgcatcggtgcttttctcttctgattcttactcttcttgcctttggcttgcttagtatgtgaccccacgtggtacgagaggctaggaggaaagcatttcccgggattcaatggattctctccgttgagctctctactttgcacactaggctgcaagcttgacttggtgtgaggaggctggtttagcgatgtctgccctgctaaaccaagggaaggggcttctttgacatatacccatggacaattcagggcatagtgtccttgctctctgcaatcatgacaaaaggggacatcctcttctggcattggaagctcattgacctgggtggcaaatgctcgatcaaacacatattgattttggtcttgacttccaaccaatggtagctgtgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagataggaccttaaaggaactaactcttcttgttgatgtgttgtttgtttcacttattctgcaagttgattaagcaaacaacctagcatggttacatcacaacccacagatgcaaaccacgcgctacacacacaagcaaggaaacacacgacaaacgaaacactagagggtggcttaggttctgcgacgggttcccaagatcttcactcctgcttcacagctggcttcactgcttcctccgcttcgctagcggatcctgcagtcttccggagcttcggcaaacgactgacgatgtcttcttcttcactgacctgaccatctagtactagttgaaaatccgaagaagggagaacggagtaaaccttttgcaaatagcattaggggaaggagaaaaaggaactttcacaaatatatttatttataaaatatgtccttaggttttatccacttggcttatcctacagtcgagatggctctgataccatcttgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcaacggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggcagatgcatgattaatgcaagggggtacaaggggtaataatataggggttaagttttgcagaaagcagcatttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccactccacattttagttgttgagcaaattttaagaattgaaacactgacttgggtacattgctcggcttgcccatannnnnnnnnnnnnnnnnnnnnnnnnnnnnnnnnnnnnnnnnnn

SEQ ID NO: 15246 - DNA, 8921 bp, Oryza sativa
  unsure (1)..(8921): unsure at all n locations
gtgatttccccctctttatggcgcgcggggacggcgggatgcggcggattcggcggcagcggcggcgctagggcacgggcgggcggcgggtgcggcgcgaggacagggatgacaggtgggccccacccgtcagcgagggtggcgggtgggcccgcccgtcagcggcgcgcgcgcggggagaggccgagtgggccgcggggaggaggagagggagggaaggagctgggccgagccggcccagtaagggaaggggggggaaagaagactttttaggatttttctttttataaaaccattctaactttgtttatttcttaataattattatttgtgctctgaaaattccactaaaatttgagggctccttttagaccaaggagaatttaagaaaaattctccgggccacatttgaatttttcttatacgcattttagtgtttaccaatttcttttcgaattttaattaattctattattccttttagagaatgatttttatttcgggatgaatttatcaggacgtgacactctgattatctgtccattgaggctgaagaaaattttacactacctttatctgctcaagcagctcacttcttcccttctagatatcgagctgattaatgaaaatgatgtttggtcttacatttggggaagtatgaaatattcttcacagaaattctatgcactgaatttcagagttattaagccaccagttcattttctatggttatggaagtgcaaagtagtttcaaaagtaaaaggtttttgggtggctactcatgatgaatagattaaacaccaagttcatgctagatcataaaaattgtgctcctccgaattgtgatctttcttgtgttctttgtcaatcggcagctgttgaagacctcatgcatctgttctttttatgcccgtttgcccaaaatcgttggagtcttctaggcattatatgggatactaatctatctttggaagcaatgtttataagggcttaaatggattatcaggggagcttgtttcatggagaaattccttttatgctacttggcatatatggaagcaaagaaatgggttcatttttgagcaaaagatcccttctttcatcacttggaggcaactcttaaagggtgacctcttccttctgttgtttagaatttctgcgagatatcacgatataatcataagttggattaatgggttgtaactttgttcttgttttcttaataaagtttttctaacagtgggggcctcccctgctatgttctttcaaaaaaaaatggatcggctgctcaatctccaaggacctcctctgggcagtattgaaaatatcgagctggcgggattcaagagcaaaaactttgacagatggtggggcgagtggaaactgcatttattccaccaatcagcttctatgtatatgatagatctttttcctgatgtcatacctctggtaaactttgatctcattagttctgtttgaacaattatcagccgattcataatttgactaaccctctcttgtattttgtagacaacataattttcccctccacatcaaagcaatagtagagatatcaaatatgccccaggtctaattcaaaatggaggtggaccatctcctctcgtcatcggctataatgcccccaagacctcaacccttcttcaaggcctcatcagagaaaaccagccgatgcaggcaagaagagaagaacaaggtcatcggctgcggacacattagctctagcctcaaagaagaaggctaaactcaagaagcctaaaccaactgatgatctgcctgtcctagatccatctattgaacaagctctggatgaagaagacatcgaagatgatgttgatcaagctacagccgaagtaagcaatacagaaaaaacaccatcggcttctcccaagcagactcctccaactccttctgccccaactcatttttcaagagtaagcagctctctttaatcctttttgaaatcacttcattttttcggccgattaatcacatatcgtatagctgcagaagaagaaaactgctataaagaagaaatcagcagcaacaactatcaaaccagctccaccagtaagacattcctaatttttactagttgattatagccgattttgtctaacacttgtatcttttacagcctcctcctcctccttctcctcctgtacagcaatcatcaagtgaccgaactccatcggctgtggggagtcaccacattgaggaagaaatacaaccagctgctcctgccatcccggtaagtcttgtcttataagaatcttgaatcggccatatgactcatgtcgagactcaatttaaaattctttcttgcaggcgttagctgatctgttttctttcgacattaaagactatcttgacgaagaaacagaagaagataccaccagcaaatctttacttcccttgtccgatgatatgaagaaaacccttgaagacatctctcatcggctggaagcatcatcactggaaaacttggtggtaaactgtggaccgattaggactcggctacatgagatccaagctctaatcccagatgagctagccgatatccttactccagctgtctatcttgagcaacatcaattcaagctggagaaagccaagctaagactagccgaacgtcgggagcgcaaggatatcgaagccacaatccaagccaatcggcagcttgtgcatgaagagaagtccaagcttgatcagctctgatggcccaatcaaatctaatattgatcggcttgaggctcgcaagattgagctcttggcacagcttgaagaacgcaatgccgagctggatatagaacataaaaagctggccgatctcccaaaatccgttgaagaacagaagtcacgattaaaatcggctatcaagaatgttgctgagctgaccaagtctttgaaaatcatccctggaaccgatgctcaagacgcccaagccattgaagaagtagaacagattaggcaaagggcaatatcggctatccagcactatttgtctcagtgactctttgtataataggtcttagaaatttttgtaattggctaagatactccagtactttactgtcttgacaatcatctgtgccaattaatataacttctaaatttgctcaaaaattttcatttgttttgtatatatgtgccccctgattttataatgtcaaaagcattgagaaaattacaaaaacaactaagggcgatgtaaacacatcggccattattcatcggcaaaccacaaccgattacaatatgaaaaacatctaagggcgatataaccatatcggccattgtacatcggcaaaccacagccgattacaatacgaaaaacagctaagggcaatataaccatatcagccatctcaaggcgatgtaaacacatcggctatcatatatcaacaacatcagccgatcatgcattaacccaaacacttgggtaatatttcttcaaatacttgccatttagcgctcgtccataaacctctccatcgagtccttgcaacatgtaagctcctttagacaccactttatgaatttggaatggtccttcccaattcggcgaccacatgccgaatttgctatcccgagtcccaatcggcaaaatcaacttccatacaagttcaccttcggaaaaatctttaggtactaccttcttgttgtaatgccgagcaacccgttctttatccttggtaacctttgcgagggctcttaatctagactaaaccaagtcctccctttcatcggccataaggttacaatactcatcagctgttaaattatcttgcagctcagttctgcttgagccgattctaacctcgcatggcaaaacagcttcatgtccataaacaagcttataaggagggacttggatcgatccatgacaagccatccgataagaccacaacgcttcagccaaccgagtatgccgttgccgaggataatcagaaatctttcttttaatcagtttgttcaaactcttgttagatgcctcagcttgcccattagcttgtgcataatatggcgaagaattcaacaatttgacacccatgctgtcggcaaactgaacaaactcatcggatacaaaaattgaaccctgatcggttgtaatggtttgagggataccaaatcgatagattatatgttcttgaataaaatgtatcgcatccccagaatcaaccttcttcaagggaatcgcctctacccatttggtgaaataatcggtcgccaccaatataaacttatctcctttactcgatggaggattaatcattccgatcatatcaataccccatggtttaatgataggattcatagccgacgccggtgcttgctgaattgctccaaatttctagcagtcttgacaccctttgtaatatctgaaataatcttccagcattgtcggccaaaaataccctgaacgccaaagtaaccacttcatcttatgaggcgattgatgagtaccataaatcccttcatgaacttcgccgattgcaaccttagcctgatcggcactcaaacacttaagcaacaccccatcaatcgtccgataatagagctcatcatccaataaagtatacttcaacgccttatatcttaatttccgagaagccgattgagatggattctgtaaatattgatgcacatcagacctccaattatnncgctgtattgctgcgacctcgaccttaacatctttgatcatcggcttataccccgatgccccctagcccaaatcaataagctccaatattttgttctcgagatacatgcttcaaagataccacccgaaaatccttcatcaattcttggcacttctcattataaaccattaatgtatcattcttgcactcatattctcctgccaattgacttattgctagcaaagaatcccccatgatttcaatagcatcggcttcaacctccttgagtaactgtaaccctttgagcactgcttcatactcagcttgattattggttgcatacggtttgatagtataagcaaactcaaaattcgcaggggaaataataaccaagccgatgccacaaccatgagtgcacacttacccatcaaagaataaagtccacggtacgatctcaaccgagccgattgaatcatcacgatgctctacaataaaatcggctatagcttgtcctttaatcgcccgactcataccgaagatcaaactcagttaaagaaaatatccactttccaacccttcttttcaaaatcggggccgatagcatgtatttgacaacatcggccttgcatatgacagtgcattcattagactatagataatgccttaaccttgtacatgaaaaatataagcacaagcataacttctccacaggggaatacctagtttctgcatccaagagccgacgacttagataaaacacaactctctctttcccttcaagctcctgaatcaaaaccgagccgattgacttctcaccggccgacagatataaccgaaaaggtacccccttctggggaggaatcaaaactggaggagagctaagatattccttaatatcgtccaacgctttttgttgctctaccccccaagtaaactgttgatcggcattcaatctcaacaatggtgtaaaaggctctaatcttccagacaaattagaaataaaccttctaacaaaatttatcttgccgatcatctcctgtagttctatcttgttcttcggaggctgaatcttcttgattgcattaacactcctttgagttacctcgattcccctatcgtgaacaagaaatcccaaaaactggccagccgatatgccgaaagcacactttgtcgggttcatctttaggccatatttcctggttctctcaaaaaccttccttaaatcggctatgtggtcttctacctctttagactttacaaccacatcatcaatgtagacctgaactaaccagccgatcagatcgtgatatatataattcatggctctttgatatgtagcccaagcactcttcaagccgaaagtcatcacaacccactcaaacgagccgattgcaccaggacgcctaaaagttgtcttatggatatcttcttcagccataaaggtctgattgtatcccgcattaccatccataaaactcaaaattttgtgtcccgaggcagcatcaactagctcataggctactggcattggatattcgtctgtcggggtagccttattcaggtttcggaaatcaatacataccctgatcttgccgtttttcttgataacatgaactatactagaaacccactcagcatatcggcaaggacgaataaaacaagcatcatataatcgttaaatttcagcctttacgggatcaagcatatcagctttgcatcttctcggaggttgttgatgtggtctaacccctggtttgataagtagccgatattcaacaatcaatcggctgagtccaggcatctcataatactcccaagtgaagcaatctctgaattctttgaatagctctatcaacatggttctaaactctggagataaattcttactaataaatgtcggccgtcgtcgatcacctggactgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagacacaccggagaatgcatgattaatgcaagggagtacaaggagataataatacaggggttcagttttgcagtaaacagcatttaaaagtcacttagttgctcaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagttgtttgagcaaattttaagaattagaacactgacttgggtacattgctcggcttgcccatatccgagggctcggctattcgaatagatttactctgatcagaggtgtacatctttacccacaagacacatcttcctcacgtgtaaccacgcgccacataccaccacggtatacggacggaagacgtgacatagtttccaacccatcctagccttagacaagagtaccaacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataaaccatcaattccatagtgtccaaatgatatgagaatccccaaagtctaaagttataaaaccacctaatgttgcctaattaatcagcgaagcatctacctaaatttaaactagggataccacgagtagagtgtccactagttgaggttttgtttaatctagggtgaacaaggtaataataataccaataacaataataatatggtcataacaaaggtaaataggcatggctaaataaaacagtgataacgcgggaatttaaataaagcgataatgcaataatttaaatcaacataattttacaaactgggattcaatatgttcaaggatgatgtgacttgccttgctcagagagaacggacttccgatccttcggcgacgaccgcgaaccacgcttcgggaacctccggaacgacagaagctacgcgaagcacacaagcaaagctacaagcctataaagaagcaataacaatacataaaaacaaagcacagggttctttaggttataacaaacattaagagacttgaacgggtcgattcggagctcgtatgaccaggatatgatcatccgaagtttaatgctgttatatggagatttgcgaattattataattaagctttgcaactataaaacaggtgtaagcgctagcctggaaaagacaggagggctgcgccgttgacatgcggaccccacatgtcaacctaaaggaccacggtagaccgagtacacagagacggtccacgggtcgacggaagcggaacccgtgtgtcaaccgaggcgagtggccgacaaacggactccactagacaccacacggcctgcacccgtggaaaccacgcggctaccgagcgggcacactaacacggacactacccggtcaccacccgcacacgtgaacgactaccgacaccggtacacgggtaccggggtcgacgaccgcacaacgggtacggggcgacaccggaaggacgagggcggggaagcgagaggacggatccttaccaccacgcgacgaggcgtgggaacgacaacgacgaacgggaccggcgaggacagctcggggacgacggaggcgaacggcgagggaacgacttcggcggcgatccttggacaaaggcgagacg

SEQ ID NO: 15247 - DNA, 797 bp, Oryza sativa
  unsure (1)..(797): unsure at all n locations
cagcgcctgagcggaggaggggacgcgtggaacacgccgctgcgatgttggtgaaggtggtggtgcagcggggcgacgagccgacgaggaggaagnanaggccggcgcgganacgacggcgttccggcgaaattcgggcgaggaggaggtgatgccgggaaagaaggcgatgccgcggtgtcgaagaagnagatggcggcgtcgatcggcgcaccggcgatgaacagcagccggctggagggagtacagtggcaccaatgtcactggttgccggcgggggcaccgttccggcgagtttccggcgaggagacggtgaggccggtgaaggggacggtgttgcagagccgagggaggcgacggcacggccggacgatgctccggtgaggagggagaggcggctggaggtggccggcaaggaggaatgagaagggcgacggcgggagtgcgcctccggcggtcaccgcgcgaaacggagggtaggccggcgaagaggaggcggctgcgatgctagaggaggcgacggcgcggccggccggcgcacgggcgaggcggcacaggcggctggaggtcgccggcggcgtgggagagggagggcgacggcggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccgggaatggcgcggccgttcccggcgattgggggcaccatc

SEQ ID NO: 15248 - DNA, 845 bp, Oryza sativa
  unsure (1)..(845): unsure at all n locations
nnnnnnnnnnnnnnnnnnnnnnnnnnnnnnnnnnnnnnnnnnnnnnnnnnnnnnnnnnnnnnnnnagagccccacgctggttgggaggtcactgcagtgatcctctctggctctcccgagcggacttcgctggcagtcaccgcgggtggagattccttccccgccgcttgccagaacgtcgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgcatcgacttccaccagatggtacgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttcttcctcgtttgtcttcttgttgggtcgtgtggggcatggtcatgccggtgtgtggcataactgtgtcggagcctgtctt

SEQ ID NO: 15249 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnnnnnnnnttcgatctcaccaccgatgttcaactgttgcgactgtccttgaccagcggaaaaagattcaccaatttggagtggctcgatacgctgtctctggcgactaccttgtgcctcctggaaaacagtcattttccttttacggttatccatcctgttcttcttgtcttccagtcgaattgctttgtcaaccaactcctgaaaatcctcatagtcatgagagatcaacataactgacagctcatcctttaagccttccaagaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatatgtgtcttcttgaatgcttcagtgaactccgcccaagtgattggttgtccttctgctctgttcatccggaaatgatcccaccattccgaagcagatccttgcaactgatgtgaagcgaaaacaactttctcctgatccgtgcactggagcaattccaacttcttctcaacagcgtgcaaccaatcacctgcttccacttgggttgtagtgctagagaaaggtangtggcttcacacgaagaaaataacttacttgttc

SEQ ID NO: 15250 - DNA, 7198 bp, Oryza sativa
  unsure (1)..(7198): unsure at all n locations
nnnnnnnnnnnnnnnnnnnnnnnnnnnnnnnnnnnnnntttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttattattattgttattgttattattaccttgttcaccctagaacaaacaaaaccccaactagtggacactctactcatggcaccactagtttagttttaggtagatgcttcgcaatttaattaggtaacattaggtggtttttcaactatagactttgggaaatattcatatcatctggatactatggaatggtttggttactgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtaccgtggtggtacgtggcacgtggttgcacgtgaggaagatgtgtcttgtgggtaaagatgtacacctctgatcagagtataatctattcgaatagccgcgccctcggttatgggcaagccgagcaatgtacccaagttactgttttaattcttaaaacctgcttatcaactaaaatgtggaatggttggcctgggttggcttgggacgagctgggacccagggtcgggttgccagttcggtctgaatcatcataggccttgggttaaggcaggttcgtgtgggtccacggccttgattaataacattgtatagttctaggatcgcgtttacaaaatagctttgagcaactaaacgtctttaaatgctgtttactgcaaccctaacccctttatggtaattcccttgtactcccttgcatttattctgcatttgtgggtgtgtcttgttgagtacggtggttgtactcagtcttgctcaatttttcccaagcccagaagaggagctccttgaagatgaaggctttagtgtctagctcgtgcctgccatcaagcgcctgtggtcgtcgccctactcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaaagatgctaccgacatgtgggccccacatgtcggtgacacgagagagaggagggcggccggctcggctgggccaaatgggccggttcggccgcgcggagagagaaagagagttgggccgaattcggcccaacaactaaggaagggctttttgaactttttcaataaaaataaattgtgaaatgatgtttcatttattaaaaatacttccattgctcaaataattcccagaaaaatctagaaaatagaggagcaagcatagtatttaataaaattttatctaacccaattttatattgagatttagcaaattaaaattagatcttctcttttaagcttttaaaatcatttctaataattccttttaaacaacaatttataatttaaggatttttaaacaagaaaatcacttaacaattataattagatcatttgatgattaatttaatatttaaataattgctgaacttctctttgtatgattaaaattaataattgagctccgaaaaatccgagaaaattccagagagtataattaaccatggagaatttaataaaaattaaatccatccatgctttatatttagaaaattttatttcccacatttaaatttacttgtaaattaaagaacatttaatataaattctattaataatttattaaataatttataaatcctaagaggaaaatcagggtgtgacaaatctaccccccttacaaagaatctcgtcccgagattcggaacggctagaaagaaaaaggcataggtaaactgcagtctatcttattattccataactccgataattattctaaggctttaaagaaaactactgctgctttgaaactggtggctgagctgtatcccttgagaacgcaactcttgaagacgcaactggcactgcattggctcctgtgacgacaatgttgttgacctgaccttgcggctgctgatgctttgacttcggacactctcttgcaaagtgacctggcttgtaacagttgaaacatacctgctgctcccttccactactgttattctcttgagactgatcctgctgaactggcaccggttgattagcttgctcgatgtttacttcattgctttcattagtctctgattcgatctcaccaccgatgttcaactgttgcgactgtccttgaccagcggaaaaagattcaccaatttggagtggctcgatacgctgtctctggcgactaccttgtgcctcctggaaaacagtcattttccttttacggttatccatcctgttcttcttgtcttccagtcgaattgctttgtcaaccaactcctgaaaatcctcatagtcatgagagatcaacataactgacagctcatcctttaagccttccaagaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatatgtgtcttcttgaatgcttcagtgaactccgcccaagtgattggttgtccttctgctctgttcatccggaaatgatcccaccattccgaagcagatccttgcaactgatgtgaagcgaaaacaactttctcctgatccgtgcactggagcaattccaacttcttctcaacagcgtgcaaccaatcacctgcttccactgggttggtagtgctagagaaggtaggtggcttcacacgaagaaaatcaactaacttgttctggggcggcggaggattgacattgttgttcccttgctggttctgcatttgttgcactaacaggttgatcaattgggtctgttgagccagcacttgagcaaaggttgggttctcttcattgttattgtttccacttccactggcgcgagtgttcaccatctgttgcagattagagaagataggaggagagaggttacactaaagacaagaccttaaccaggttaccactgatctggtgtgtgtagttcattatattgttcaagttgattaagcaagcaacctagtatagtcacacactcatcaatgaactactccaatgcaactatacctacacacaaaacaaacaacaaacgttctaccctactaactattcttcaaagacactttggcggcataggttctaaggtaggatgccaacttcattctatcttgacatctgggcacttcggtccttcctcgatccactttactgacctctacaagtagacctcattggcgtcttcaggtttcaaccactagtttcagaactactcaagttgaacgagagaggagagtagacaatgaaacaatttgcaaagaattctagataaggaagaaaggaaaatttttcacaaattatgttttcggaaaattagtccttaaggtttgaccacttggcttatcctacagtcgagatggctctgataccaacttgtcacgcccggaaattcactagtaatttccgaactaatttgtgcataaaatcctcgtccaggaatcaaccgaggtacacaaactgacaatttaatatacagattcatcaaattaactaaaacgataaatacttacttatgaggcacttagtcctcatcaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaagatttaagagaagtaaaacagtggagtaattaatcagaaattttaatcaacactgaacagcacacccatgctgcacaggcccaaccatcctgaacaaccgtacccggctgtacagatctaactccaaaccaggagctaagcaaattattaccagttataacatccataattattgtgagaggtgtgagactaatcacgaaaaacattgctcaactcgcccataaccgcgggcacggctattcgaatagttttactctggccagaggtgtaccactgtacccacaagacacagcctcagcatcatgtctaccatgcgtcgcgatactggaaagtacccgaatagaggctgtgacaataccctctgcataacacaactcaccacagtgcaccattcctggatcataatcaccccctctacaaccagaggcatggactccccagcgacccccacggacttctcgccgcttctcagtctggcaccccgcaatgaatcatgctatacaaaaggtaaagccgttgcccatgctggcttgtggttggtacggttaatgtttcacaacagtagctcgcgaaccggtccttaattgtcatgagcacaaccgtcaaaaccacatgctcacaacccaccttaaccaggttttaattatcaattaattatcatcacacgattaaccatcgtgagctaccatttaatgtaaccataaataataatgtagtatatatgactcatcccattagtgagctaatgtttctaagcattgctaagcaattatatatataacatttagctgaaccaaaccaatacataaggttcaagctactcaatttattacccaaggtatcaaggaatagggcattcaatgcaaattggccataacaaaggaataggttcacaccacccggtgacattcaaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacaatacatataaagtaaacaaacatgtagatcataattttagatgaattatgagacttgaacggcctcattctgacttcaaaagaatttattatgaattttacaagattaaatctaattaaagcccatttaaaaagaattaaataaatttaattcaatttatggacaattttaatatgtagatctttattttagaaaaatttagcaacttgaaccacctgaaacggatctacggttatttagatatgattttccgaagatttaatctattaaaaaaaaaggaaaaagaggagatcgatgatgtcagcatgacgtcatccatggccggccgactcgggcggcaacctcgccggagctagggaccttggccgggcgattggagagcacctacgcgaagaggacgacgagacgaacccgacagtactcaccacgacgacaaacgacgaacgacgacggccggcgacgagaagggcgacggcggcggctcggttgaacggcgacggcgagctgtggcggccggcggcgaagaaaaggtggcggccggggttctcctcaccacggcgcacctaacggggcaagcggcggcgacggcggaggcgacgacgcgacgcgactgaagaccggccggcgacggcggcggctaagtgcacgcggcggcggcgctacggtgcacgggagaggacgagagagggggcaaacgaaagagggcgacgaggggatgctttatatagccttggattgaagagatcgggctccaaacaagaggaatcgatccgagaaaatcaaaactcggttttggagataaactcgaaaacgagtttgattcgaacaagatacacaacgatttgctccaaaacttgggggaagagatagaggagaacgagggatcaaaacccctcaaaaatccggaagaaaagaggccggattggagcggatttgagaggagaagaaagcggctcgggcgacggcttgggctcggcctgtgccggcggctggaggtagaagatgctaccgacatgtgggccccacatgtcggtgacacgagagagaggagggcggccggctcggctgggccaaatgggcctgttcggccgcgcggagagagaaagagagttgggccgaattcggcccaacaactaaggaagggctttttgaactttttcaataaaaataaattgtgaaatgatgtttcatttattaaaaatacttccattgctcaaataattcccagaaaaatctagaaaatagaggagcaagcatagtatttaataaaattttatctaacccaattttatattgagatttagcaaattaaaattagatcttctcttttaa

SEQ ID NO: 15251 - DNA, 1938 bp, Oryza sativa
  unsure (1)..(1938): unsure at all n locations
cctgtctttatttatttgcctaagcaacttgaactttaatgaacccatttaatagcagtaataaattcaagaattatggtagttgtgggtggttagttttaattgatagctctttctctgtttgctggttctgtgtggggttttcagatggtgacgaccaggagaaatgctgccaccggtgatggcaaccaacctgaaggcagcaaccacaaccaccagggcaacccacctccacctcctcctccgcctcctccaccaccaccagataccaatgccattctcacccaaatcctcgcccagcaggccaacatgatgactgttttcctccaccacctccaaaatccaccacaacagaatgctccaccaccacccccacaacactctaaactcgccgagttcctccgcatccgtccacccaccttctctagctccaacaaccccgtggatgcgttggattggttgcatgccgtggggaaaaagctagacacggcgcagtgcagcgatgaggagaaagtcatcttcgccgcccaccagctgcaggggcccgcatctctatggtgggaccatttccaagctacgcagccagaggggcaacctattacttgggcccgcttcaccgccgctttccggagaacccatgtgccagctggagtcgtggctcttaagaaaagggaattccgagagttgaagcaaggcaaccgctccgtgatggagtatttgcatgagttcaacaatctggcccgttacgccccggaggatgtgcgggaagatgaggagaagcaagagaagttcttggcaggaatggacctcgagctgtccgtccgtctagtctctggggactatccggatttccaacgtctggtggacaagagcatccgcttggaggccaagcacaaggaactggagtcgcacaagcgccgcttggcgaatttccgcaatcaacagtgtgctaaccaaagggtccgctacaccaatccctatccagggggatcctcttcgcagcagcaacaacagcagcagcaacctcgctccgcgcctcgacctcaattcgtggtgcgcgtcccacagccgcagcagcagcagaatcagcaagggactcgtgcgccccgtcctcctacgccaactgtgcagcccggtcaaggccgcagggacgctcaaggtcagcagcgtctgtgcttcaactgcttcgagcccgggcactttgcggataaatgcccgaagccaaggcgtcagcaaggtcaagcgcctccccgctccaacaacggtgggaaggatgtcattcggggtcgtgtgaatcacgtgacggccgaggacgtgctgacaactccagacgtcatcgttggtacgttcctcgttcatcccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgaggcgcactgtcactctgtaccgagggccggaacaaccggttgttttctttgcacccccaacctctgtcagtagttcagaactgcatcagataggactgtcagaaatccccatcgtcagggagttcggagatgtgtttccggaagaactacccggtatgccgcccaagcgagagattgagtttcggatagatcatgctccaggaaccactcctctgcacaagcgaccctaccgtaatggnnnnnnnnnnnnnnnnnnnnnnnnnnnnnnnnnnnnnnnnnnnnnnnnnnnnnnnnnn

SEQ ID NO: 15252 - DNA, 1706 bp, Oryza sativa
gttcatcccatccctgcaaccatttttgttggactctggagcttcccactcgttttatatttgtgccattcgtgggaaaaaatcagttggggtagaaaggcttaggaaccctctgctcatcaccacccctggaggggtttatgacagcaaagtattatagccctgccgtccctatagaaattcaggggattccttttccctcggatctgattctgctagacaccaagaatttgaatgtgattcttgggatgaattggttggctcaattccaaggagtagtggattgcgcgaggcgcactgtcactctgtaccgagggccggaacaaccggttgttttctttgcacccccaacctctgtcagtagttcagaactgcatcagataggactgtcagaaatccccatcgtcagggagttcggagatgtgtttccggaagaactacccggtatgccgcccaagcgagagattgagtttcggatagatcatgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagacaagactaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcaccacgcgatacgggctgtatgaattcacggtgatgtcgttcggtctaaccaatgcacctgccttcttcatgaacttaatgaacaaagtgttcatggaatacttggacaagtttgttgtggttttcatcgatgacattctgatatactcacaatcagagggagaccatcagcaccatctccgtctggtgttgggaaagctgcgggaacatcaattgtataccttcgggtcacgccattgcgaggtgtacacaggtttcagacaaaagggaagctcgcacctcggtatgtgggtcctttccgtatcattgctcgacacggagaagtcgcttaccagctggagctgcccgcctccttgggcaacgtgcatgatgtgttccatgtgtcgcaactcaagaaatgccttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggtccagtggagcaaccatgccgaagaagaagctacttgggagcgtgaagacgagctgaaggcagcccatcccgatctcttcgtcagttcttccgaatctcggggtcgagattccgtttaaggggggtaggtttgtcgcgtcccaaaacgactctaaaatacatcctcgaaattgtgccgagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaa

SEQ ID NO: 15253 - DNA, 532 bp, Oryza sativa
  unsure (1)..(532): unsure at all n locations
aatcctgagccgagaacctctagctgtcatccctccgtagtctgtgatgcctattttgcctgaggatccttttggctcaatggaggaacattcttgtccttctactccaacaggcatggaaatagagattagtcttccaccttcccctaggaaaagagggaagaagagaacaccttttgttgactctcaagttagaaggagtggtagacttctggctcttagggatggtttcaagaatattctgcaagaggatccaaacatgggtgttggaaagccaagagggaaggcagttaaaaagctgaaacagttggctgaggtaagtggaattattttcccatccgattcattatcttctattgatttaaatcctgatatatcttgtgaatctgaaagtgatcttacatctgttatacctgctaattgtgatatatcttttctccagaagattggatctgagatgtgtgggacttcccttnnnnnnnnnnnnnnnnnnnnnnnnnnnnnnnnnnnnnnnnnnnnnnnnnnnnnnnnn

SEQ ID NO: 15254 - DNA, 671 bp, Oryza sativa
  unsure (1)..(671): unsure at all n locations
tttcacaaattatgtttcggaaaattagtcttaaggtttgaccacttggcttatcctacagtcgagatggctctgataccaacttgtcacgcccggaaattcactagtatttccgaactaatttgtgcataaatcctcgtccaggaatcaaccgaggtacacaaactgacaatttaatatacagattcatcaaattaactaaaccgataaatacttacttatgaggcacttagtcctcatcaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaagatttaagagaagtaaaacagtggagtaattaatcagaaattttaatcaacactgaacagcacacccatgctgcacaggcccaaccatcctgaacaaccgtacccggctgtacagatctaactccaaaccaggagctaagcaaattnnnnnnnnnnnnnnnnnnnnnnnnnnnnnnnnnnnnnn

SEQ ID NO: 15255 - DNA, 446 bp, Oryza sativa
tttttggtttacggcgtagaagcaatgttgccgagtgaagtggaatttgaatcactacgatttcggaacttcaatgaggagggctatgaagagggccgagtagacggcatcaatcgattagaagaagcccgagaagcagctttcattcagtcgactcgatatttgcaagggttgcgtcgttatcataatcggaatgttcgatcgcgagcctttttagtcggtgacctggttctgatgaaaattcaaacaacacaggatcggcataaattatctcccttatgggaaggaccattcataattgctgaagtcactcggccgggttcttatcgactcaagcgcgaagacggtactctcatcaacaattcttagaatattgaacaccttcgtcgattttacgcttaggcatttcgtttgtatctttcctctttgactgataacttcaagtt

SEQ ID NO: 15256 - DNA, 701 bp, Oryza sativa
  unsure (1)..(701): unsure at all n locations
catgttgctgtacaaactggtgacccaaagtgttgagaataatttgattggagatagcagaaagtttcgtctcctgtaaacagacaatcgtcggtttatattgctagatgcaaactctaacagagtcttgctttactttggcattcaaacctctcacattccagttaaacaggtaaacattgtcttgtgacataggaccaaaagggcacagcaactctactctcgcagaaacactcccaacgacgatgagagaaacacagcaagagaggtacaaaatagggacagcccaatacaacacaggaaactagacagtaggaagcagcttgacatagtggcaactgagacttgaacatcagggttggagacgtcatggatgttatgctcgatgacatctcagtagtaggggcgcttacaggggtgccacgaccgccttcttctttgcagccttcaagcggatggctttgcatccacccttctccactagctcggagattgtcttcaaagaggctggggataaaggcttgttgaagtgctgcaagtaaagctttttgacattatcatcaaaagaagcgtgatcatccatgaaaccaaattttttagaaataatttcttgagcaaaattctctaacttcgcgtctgnnnnnnnnnnnnnnnnnnnnnnnnnnnnnnnnnnnnnnnnnnnnnnnnnnnnnnnnnnnnnn

SEQ ID NO: 15257 - DNA, 625 bp, Oryza sativa
  unsure (1)..(625): unsure at all n locations
nnnnnnnnnnnnnnnnnnnnnnnnnnnnnnnnnnnnnnnnnnnnnnnnnnnnnnnnntaattggaaaattttaaaagtctctatcgaccatgaagaaaaataattggaagacaaaatgttgatatgctaaatgtgtggaataattagcagtacatcagacgagatgcatatgttgtactacgcttagaaaaaacagagtgggtagtaaatttgatttcaaatgattagttaacctcatcaatttctagttgtatctatttttttcttgtgttcacatatcattattttctttccatagcatcattcatcaacaagctgaacgaatagcgcacatatattgttagcctaggaagcacaaaaaatgaatgaacaaagtactagctccctaaaaggattgaagaataagaactaagaaatatagttacctgggagggagaagccaacaataaagctctaatcttcagaagaacaatatttgcatcctgaacaagctcttcaactttggaaatagcattttgaacagctaagagctgctccatcgtgttcattggaggtggagatgtcactttgacctccatcattggattnnnnnnnnnnnnnnnnnnnnnnnnnnnnnnnnnnnnnn

SEQ ID NO: 15258 - DNA, 1260 bp, Oryza sativa
cgtgcgcccggtccaccgtggaccgagcggctgacgcgtgggccccacttcccgtggacccggtccgcgcgcccgcccctcggctgacgcaataatccgtttttaattaaaatttaaatgaagaaattcgtaaatatccatttaaagagcatataaacttcaaatggccatatcttggccatttgaactcggaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattactaccttgttcaccctaggcaaacaaaacctcaactagtggacactctactcatagtaccactagtataattttaggtagatgcttcgcaagttaattaggcaacattaggtggttttataactctagacttgggaaattctcatatcacctggatactttggaattgttggtttattgtggaattggcctcacaccgccccctctattcaaaatccccctaaaatggttttaggctgggctcggggtgcatggttttgatggtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaagactacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtctttcgcccgtataccgtggtggtatgtggcacgtggtaacacgtgaggaagatgtgtcttgtgggtaaagatgtacacctttgatcagagtaaattatttgaatagc

SEQ ID NO: 15259 - DNA, 442 bp, Oryza sativa
atcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccagttaattattggccgaagatggctttattttcctaggggttataatttgactagcatgaaccctatatattggtttggttcagctaaatgctatatataggtttgcttagccatgcttagaaacattagctaactaaagggattaattataaactatgttatattattattaata

SEQ ID NO: 15260 - DNA, 715 bp, Oryza sativa
  unsure (1)..(715): unsure at all n locations
aataagccttgcttttttattctatgaagcagctggatcatgttttgaacataaaaaaaatttgtcatgaacgctctcttccgaacaatgcactttgggttctgggaaaccaactcattaagtcttggagctagtctattcgcaaaagttttagtgattttcccttgcaaaactatggcccagactaataggtcggtaatggtcagcgccagaagcgtcatctttctttggaatgaaacatataaaggccgaattcagtttttccagttgagatgtgttaaggttcatgaacgaattgattgccgccatgatatcatccttgataatctcccaggagactttgaaaaaggatccaataaaaccatccggacccggagccttttcgggaggtaatgagaagatcgtcgcttttatttcctcctccgagaaatcctcctctagttccgaaagatccaaggactggagccctaaagcagcccagtttagacccaatgatctttggttatttgtcccaggtctggatttgaaaaaacggaacagctcgtcttccttgtcttgtgccgatattgccactcctgagggagtttgaagtgattggatgtaattttttcttctcctagagtttgctttgatatggaaaagttttgaatcaacatnnnnnnnnnnnnnnnnnnnnnnnnnnnnnnnnnnnnnnnnnnnnnnnnnnnnnnnngcg

SEQ ID NO: 15261 - DNA, 123 bp, Oryza sativa
aaaaaaaaaagaaaagaaaaaaaaaaaaaaaaaggcgaaaaaaaaaaaaaaaaaaaaaaaaaaaaaaaaaaaaaaaaaaaaaaaaaaaaaaaaaaaaaaaaaaaaaaaggaaaaaaaaaaaaa

SEQ ID NO: 15262 - DNA, 427 bp, Oryza sativa
tacccaccccaatcacaacgcgccccccactccaacaccgccactaccgcgcgcgtcaaaaccaccatccaccgaagcacgcacatacagagagggagagagagagagagcaggcagtacctcgaggttgaagagggtggagtaggagagcccgccgccgttggcggcggcgcccccgcgcgacggagggcgccgcgggtccatcccgaaaccctaccgtgcccccgcccccacgcgcgcagagacgcaagcaggaagagggagaaccaggaggagccggcggtcgcgggcgcacgcgaggtcccccgggagggaccgcggcggagggtggagtcgagcccccgcagcggcgggcggcggcggggagggaggcgtggagattagggttaggttttggggagcggagggggggagagaagggggggac

SEQ ID NO: 15263 - DNA, 5231 bp, Oryza sativa
  unsure (1)..(5231): unsure at all n locations
caaaagaagttgtcgaagcagcaaaggcttcaatgggtaatgagatatgattacatttaacttccgttgtaatataaatctagtagtttctttgtagtagtttttgtggtttattgatccttttgcttttcaggtcaggatctgtcagaagttgatttgatgaatgtgaagcagtttgctcaaagagtcatgaatctgtctgaatatcgtaaaaacctttatgagtatcttgttaccaagatgaatgatattgcaccgaatctaacatcattaattggtgaagttgttggagcacgccttatctctcatgctggcagtctttcaaaccttgctaagtgtcctgcctccactctccagatacttggtgctgaaaaggcacttttcaggttgttaaaactgactgatttcttggtagctctcaaattccaagtaactgtatggaaagttgtttcaaagtactgatcatagagtatacgtcaacttcttatgcttctttactttctcccagggcattgaaaactagggggaatacgccaaagtatggccttatattccactcatccttcattggccgtgcttcaaccaagaacaaaggcagaatggctagatatctggcgaacaagtgctccattgcatcacgcattgattgttattcaggttagttgcatagttctgtttccaatttgtatgtccactagttactgcttttgctgaaagaacttgctgccatattttggaattcagagtcagctaccgcagtctttgggcaaaagcttcgtgagcaagttgaggagcggttagacttctatgacaagggtgttgcacctcgtaaaaaccttgatgtgatgaaagctgcgatagacagcatggttaatgatgccacaaatgatgttgatggtaagttggctaacttcggttgccagaaatgctaacattgagctacatgttactatcatttataaactgtgcattgtgcagatggcgagaaggtcgatgcatctgccaagaaaagtaagaaaaagaagtctaaagctgaagctgacggcgaagcaatggacctggacaagccttccaatgtggctgatgaagctgagcctggaactgagaagaagaaaaagaagaagaagcacaagctggaggaggagccacaggagcaggagaagagcgtggcgcatgccaatggcgacgccgaggagaacggtactcccaagaagaagaagaagaagaaccgtgaagtctcggaggacgctgagcctaagacggccactgaagggaagaagaaaaagaagaagtccaagacggaggacagcgactgagtgatcggtttgcctacttgcatggctgatctttctgattagtgttgttggaagcagagttaaaaaaaacacctagattcctagttcctgaagacaagagcagtcctgaactatgaaattgccctcccatcctctttccctcattcgatgttatcaattttgtgtgtgatagatgctccggaattattgggagcgaagtatcgctgccgttataacaaaacttcacttgatatcttatcgctcttgaacttccccggcgccgtgagcttgtccgagctccaggccgccggcgtccaggtcctctatctccctcgactcgccgccggcaagtgctagcagaatcgtatctccctcgccggcggcaagggctatcagaatcgcacgaactttgtcaggttaaagtgacagggtatctctggtttctcttgattcaaacattagttcggggtgttagaatcgattggaaatttggaatcgacaaatccactgttacttttgcatagcagaaagcaaaattctggtaatggcattagatgcgatcgaattgcaaaatagacgagaatcaaatcaccaacaataccagcaaccattagcatattgtgagaacatcagaagagaatactgaactactcatcgaagctcacaaaatacactttgttggagagaatacaagaaaatgtactgttatcattcgtaattttcttttactgggatcaattgctttccgtattggatacttggaagtataggtgctttagcacacaactgaacaagtgaagaatggagtacattttacattcgctacaatatttttttcacctttgattctcccttgatatgtaaatgccattaatttgaggaattgatgctggtacgcagaaactcgcctgtttaggagcaaaagctttcgtatcttcgttgttgctaatttcaagtccacataatctacaaagagtttccaggtccagctcctaaagaagttccaaaacaagaatcaacatccagctgatgattttagaactgttcactaaagctgcaactaaaatgcacaactgcagtaaaaatatatgtcgaagggtggtgtccgcgtacctcgatcattaggatttctgataaatgtgtcaaagggtggtgttgaagtttgtagccactatgattgaagtacattaatgctctaacacgagcctttggcagcaaagcaggcaaaaaaaattgatatgtcagaacgaaatatatccagcaatattaaagcttgtgaataaagaaatgtgctggtaacaaccactagcataacacaaacttgagataattctcattcatactgaaaggatcagaacacaattttaaaacgggtgaggaaaatttaactaacaattgcagcaattcgtttttttgcacaaacaattaaacacttcagcagtatgtgggcaactgggcacctactttacacttaacaactatgtttgtaaaagctagataacagataccatatggatataacaggctcaaatgtacatacagaaggcaaggatatcaccttatcattaaaagggtcaaaattgctgttcggcttacctcattgagaaaaggttctaacagacgcagctgaagatcggttccttcagctgctatggcgcagaagaaacgcttgaagtttcctaggtggtagaatctgcagaaagaagatcagaacatatatatatcaattaagtttaaaatgatgtgtctcaatagttagcacttctgagttgtcccaaatcatactgctgtgcacaaagaagactcaagaagcatgatggctcttagagcatgacaaaaatgaaggctctatgtatgttgatacaaataatatgcataaagttaccttaatatagatctagcaaataccatttcctttgattgtataattgaagcagatagatggccataccacaaagagagtgaatctacctggagataaacaggaaattaggctactattcactagctggagtaagaagaaagtattgggaacaagagaataacataaattagattatttagaaggcaataaaaattgggggcaaaccattttgggtatcttgcagcccaaatgtagaagcacgtagaaggaataatattcagtctctttactactctgtgaattgttcttgtgaattacatcatacatatcaaacagagaaagaaggcacttcattagctgctccatgtttaggtaacacagggaagaagcatcagaatcctgggaagacctagaaagcttctgatgggatagaatatgaaactttatctgcagaaggcaggggcatgcatcagataaagctgtgaaagaggaataatctaccctatatgcttgcacttgaagcaaatatgttcctccaccttaacaaaatgacatccggcagcataacatcaaaagataacagcatctaacgaacaaaaaggaccacttagtggctaacacagatgccaagtagaaaatgcctgaaagaactaattcatgcataatcggaaaagaaacatactttctcccaaaccaattagagagaaaaggcgagaacctcaacaacattttatgcatatcgagtattactctatctaacaagagtttggatgagtgaattttctggcctcaactacttaaaaaggatggaacataaccttacaaggaaaacaaagagaaagttgttgagtagtagttctgtgatagagtataaggatgctcaattctataatgttaaaagttagattccagacacaacaatctaaaccagacaaataagtaccctaaaattcagaggtctatacaataagataaaaacatggatgatatgagtgtaccacatcctcgtatatttgaattgcttgggcattcactatgttctgaatactgaggtcttgcctcacagaccttgtcctatcaaatataaaatcatgaactatctcaaactgatgctctgaggaatccaataaatgcaaaagataatccattgtttctcgcaggactgggagagggcgtatatctgatgcctgtacactcgtggaagagatagttctgcaaaactagcaggaaaccaagtgttagaaaaggaacggagatacacagaattctcaaatagctacctgattctcttaaaacacacgcggttcatgaaatctttcagaccacatgaaactgtagtgcaaatttgtaattataacagtgttttcaggtggcaaattggctattctatgtggttggtaaagattcattatcttacacaccttttatgatttttcagtggcatttttactcaagtttgcagtggcaagtaaatgaattccgacagtttcacctcaagtgtgcagaacatgatatctcattgtataactattattttcgttgatacaagctctttttacctaataacaatggcatgctaaataaataatgtaaaaaaaatcataatctgcttttgcacattgctttcttttatctgcaaacatgaccacatattcaagataaaaataagtattaaatgaattgataatcctgtcctttcatcatatcttcacccctgcaaaaatactagtacaaggtaagtactaagtagggttatatttcatccaataaactataaaaagaaatcaaacaaaataaatataaatctgacactatcgtacattcaatctcttgaaggctaggctacccgaatagcttccttacactctggcagtgattggacaagacaagcgtagatcagatttagtgctgcattgctgttattgcattattggtggcatatgtaactatatagctacatctaacataaagtgttgattgttccaacacatgcttaacggggggatnnnnnnnnnnnnnnnnnnnnnnnnnnnnnnnnnnnnnnnnnnnnnnnnnnnnnnnnnnnnnnnnnn

SEQ ID NO: 15264 - DNA, 14002 bp, Oryza sativa
  unsure (1)..(14002): unsure at all n locations
tatgtggttggtaaagattcattatcttacacaccttttatgatttttcagtggcatttttactcaagtttgcagtggcaagtaaatgaattccgacagtttcacctcaagtgtgcagaacatgatatctcattgtataactattattttcgttgatacaagctctttttacctaataacaatggcatgctaaataaataatgtaaaaaaaatcataatctgcttttgcacattgctttcttttatctgcaaacatgaccacatattcaagataaaaataagtattaaatgaattgataatcctgtcctttcatcatatcttcacccctgcaaaaatactagtacaaggtaagtactaagtagggttatatttcatccaataaactataaaaagaaatcaaacaaaataaatataaatctgacactatcgtacattcaatctcttgaaggctaggctacccgaatagcttccttacactctggcagtgattggacaagacaagcgtagatcagatttagtgctgcattgctgttattgcattattggtggcatatgtaactatatagctacatctaacataaagtgttgattgttccaacacatgcttaacggcaactgatcacccttttaagcaaaaatacatgcacagttgcatgcacaaaaaaaagcttccagctccatatcaaatccaatcaaaacagactaaaccaccacatggaatggaaccaagctatagcctgtccatttgcatggagagaacaatccaagcagatacgcaccaaaaatgaccagcagtgaagcatcaccacgacccaaccgcaagttcaaaaagaaaaaaaaaatcaggaatggcctccacatgagtacggagaaaaatggatggctcaccttcttcacggcgagggaaggggacgtgcgcgcggggtcgccgcccacccgctcgaacaccgccaggtccctcagccgctccctctgcgccctctccctcgctgcagcaggaaaaaaaacagtagcatccatgagctaaaacgcgccaaccaaatccatccaattaggggccaactgatcgcgcaatttcgtcgaacaggtggggggcaattcgccccgccaaacgggggtcaggtcaggtcagccagcgtcggcgtgagcgcacgggaggcttggacgaagcgcgttacctgggcacatgtcggggcagctgcccacgatcggcggggcgtcgccgccggtaccagccgcggtggcgctggccgccgccgggaaggaagaggtggaggaggaaggaggaggtggcggtgaggggccggcnctacggctgagaccaaggccgcggcattctcccagacttcgccagcctcggccccatccgtggccacgagtggaactccggacgcggtggctcgccatgtcccggcgatccatggcggcctttggcatcgagctccgaggggtagtctggtaatttggtggtaagttgaaccgtggagtggaacaatggagcttcaaacgaacatgcttttttagtggagagagagagggggggaggccaagatttttttttaaccttttaaaattttaattttaaagtaatgtcctgttttccaatttttttttcaaatttctaacttttccgtcacatcgaactttcctacacccacaaacttccaaattattccgtcaaaacggttctaatttttttaacttccaattttagagtgaaactaaacacagcttaaatcataacaaaacttatttttaaactgatctttcgnaccacgtcagcaagagtggtgtcatgaaataccgttgccatgtcatctagacaatactactccctccgtcctctaatataagggattttgactttttgcttatactgtttgaccactcgtcgtattaaaaattttttggaattattatttattttttacttactttttgcttgcaccgtttgaacattcgtcgtattaaattttttttggaattattaattatttttttgacttactttattatctgaagtactttacgcacaacttttcgcttttttatattttcacaaaatttttgaataagacgagtgatcaaacagtgcaagcaaaatatcaaaatcccttatattatgggacggagagagtatcacactaccctggctagtgtgacggtgttattttgccacacgcactctggctgacgtgggcacgtggcaacgttctcttgccaagccattcatattgacatgacaaagcaaaattttcacatcaataaatcgattattgatggtgtgacaatattatttcgtcacgcacagacgaagtggcgtggcaacaaatattcaggtttagaaataagtaaagagatgatttatgtttagaattaaaagattaagaatcataaaaattcaaaaacctaaaggcaagacggtgtaccggtgtttgaggttcaaactgagatgtgggaactttttttttcaattacacaaaaaaatgtatattcacgttatatagtctacgcacttgtgaatgcatcatctataaaacacttgccgagacgggggcataaataaatacaagaaatataattggaagaatgagcagttctttttgaaagctctgcatttctgtcagggttacgggtaaagtataccctctactttttgatatacgtcacatatcgatatggtatacttgcgcgtatacggatgtttttggcatacgttaaggaaattcattatggagttcacagatggaaggaatcctactcggattgaactgggtcgtcattatatcgtatcgggtccgatgtctccgagtcctacttggagaccagttgacctgcggtataaaagggaccccccggagaggacctagggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactagattagggctattacctatcaaggggcctgaaccagtataatctttgttttctgcctactcgatgtcgtattacgtagatcctcgtaccagtgtaccctaataccctctatatccggtctacgggtatcccccgtcgacagtggcgcgccaggtaggggcacttggtgctcaaggttctactactatgacatccagcttcgtcgacaacggcgtcaacaccaacctcaaccaaggagttcctacttcaacaacactggtgtggactcaagtcggcgaaatcgtcttcccggtttacaccacagtgccgatctcagctggtccgtcaatggccggaaacgagaacgcagtggctataacccaggacgactacatgttgaaggatcctcccgccgaagcggagatcggaacgtcgacgacatccgagcctgagaaggatcctagtgcggccaaaccttgtctttccgacaagaatcacgagccgacgaggatgacttccgaggtgacaaggtcctggtgtcctatccacaaaaccagaaaacacacctcgcaagcctgctgggtttttctcaacgtccacgctgaaattcatgcctgcaaagagcgtggaattcagcgtactttaccaactcgtgatgtctattgtcctattcacaaaacaaagaatcacgacctctcaagctgcaaggtctttctcagcgccatgaaaacgtcaccttctaaggtccagcagtcacacatccccctcagggatgaggacaaggaaaaaggagcgacgctaattttagatcgatttgttggagtaatcgacatcgatccccacgaaccatcagtcttgcacctgctcgaagactatggctcatcgtcaacgaatacgccgcgcgaggtattggttatcgacgagaccagcacgtcagcgcgcgccaatgcggaagcagggaatcaagtgaccaccggcccagcacatcagggttgtcaatgcaatactgggagaaaccacctacgatcccgttctgaacgacgatctcgcacgatggacagaacggttacgggaatcagtgaccaacctcagcaacgcgttcgaagaggccgctgctgcagcacacccggaacagccaccaactggcgatgctaatggtgaaaaccctgaacagcgggaatcgcctcatcgagccacccctccacctcgcagcaccggtgatctccgcgatcacctgaatggctgccgagaggcgctacgcacacgagacaatgagaaccattcctgacatcgcgtctcttcacggcgtcacgataacgaagaacgaggaggccattcgagcgaagaccgagaccgtgataaccgccacaaccgccacgattacgacgatcgcgaacggcgggtgctgggtgatactggtcgaggacgtcgccataatgacgacgatgatggagatcggcgccgaaacaacaacgggagacgacgacaggattctcgagaacccagccgatgtcctcgtaatcgtacgccggaaccaagcgacccatcgtcatcgttgtcatcttcctcatcctcaacatcagatagacatccacgaaggatgtacgatcgccgacaacccaccgcccccagcgatgggtgtagagctttcggtcgttcacttcgagatgtccgatggcctgaaagattctgaccaggagcaatagtgaaatatgatgggagcaattgtcgatcgannnnnnnnnnnnnnnnnnnnnnnnagacgcaagaacgacaaaccgaagaccggaggagagaagaaaccagtcaaagacgcacctgagtcgagcaagaagtaaaattgcaagagtaggaaaagttaagctcaagcggatgttctcacaacagaatacgcggactctcccaagcgcgtagacccacaagacagcgacacgaagaaaacatggtgccctatacacaagtcagatagacactctctataagattgcctcgtcttcaaaaaagtcgctcgcaatacacatggcattggaaaaaggcaagcgagtgcatgtggtcgagaaggacgctgaagcggctactctagaatcggactcagcatacccagactctgatctccatgtctcgcacatctttggaggttccacgacatactcctcaaagcgagaatataagaaggtggaacgtgaagtctgttcgacgtggcagggagctgcgcccaagatgaagtagtctgagcagaagatagaattctctgaagaggaccacctcaagactgctgtcatcccagggcgatatccgatcgtggtcgaacccactattcggaatatcaaggtcgcacgagttctgattgacggcagcaactcaatcaaccttctcttcgccagcaccttggatacaatggggatcccacgaagcgagttgacacccaccgatcaacccttccatggaatcacaccccagtcatcgtccaaaccattgggtaaaattacattgcctgtgactttcggccaagcaaataagttccgaacggaacagatcaactttgatgtcgctgaattcgatgcagcatacaatgccatcattaggagaactgcactcgcgaagttcatggtcgcatctcactagcgtatcaagtgctcaagatgccgggaccgaagggaacaatcactattcaagggaatgctaagttggtagtgcaatgcgacaagcggagcctcaacatggtcaagcacacacccagcccacccgccacagctgagccacccaagaaagtgagcaaaacaaacaagacactgaaaccggatggcgcaatcaaaatctttccactctccagtgccaaccccgacaagaccgtcaagatcggggcattactaggccaaaaataggaactcgcgctcatcaccttcctccacgacaatgctgacgtgttcgtttggcagccgtccgacatgccgggggtacccagggaggtgattgagcacaaactcatggtgcgacccgacgccaagccagtaaagcaaaaactgcggagatttgcactagatcgaaaacaagccatacgagaagagctcgacaagcttctcaaagttggcttcatcagagaggtactccatccagagtggctagccaaccctgtcatggtgcggaacgccaacgagaaatggagaatgtgtgtcgatttcaccgacctcaacaaggcgtgtcccaaggatcacttccctcttcctcgaatagaccaactggtggactcaacagccggttgtgagttgttgagcttcctcgacgcttactccggctaccaccaaatcagtatggcgaaagaggacgaggagaagacagcattcatcacgccgttcggagtattctgctacgttaagatgccgttcggactaataaccgcaggaaacactttccagcgcacggtccagggctcacttagcgaccaactcggaaacaatgtcgaggcctacgtcgacgacattgttgtcaagaccaagtcaagcgactcattgattgatgatttgcgggaaacgtttgacagcctccgacgatatcgcctcatgctcaatccagagaagtgcacgttcagagtaccatcaggcaagctgctcggcttcctcggctctggcagaggaatagaagcaaatcccgagaagatcaaggcaatcgagaacatgaagtcgcctacaagactcaaggaagtacagaagctaaccggatgcatggcggcactaagcaggttcgtcgctaggatgggagagcgaggacaacctttcttcgctctgctgaaaaagcaagacaaatttgtatggacacagaaagccgaagaggcattcattgcactcaagcgctacctatcaaatccacctgtacttgttgccccctaacctattgaagaattatttctctatattgccgccacgccatatttcattagcactgtcattgttgtcgagagagagaaggtgcaacgaccagtctactatgtcagcgaagctctccacgacgcaaagacaagatatcaacagatccaaaaactgctctacgcggtaatcatgacattaagaaagctacgccactactttcaagcccacagggtcacagttgtatcctccttccctctcggtgaagtagtgagaaacaaagacgttgtcggccgcattacgaaatgggtagtcgagctaagccagtttgatgtccactttgtgccacgaacagtcatcaagtcccaggtacttgccgactttgtagccgattggactatgcctgataacaggtcagacaaccaaatagacaacgaaacgtggacaatggcgttcgacggcgcactcaatagccaaggagcagggggcaagattcatcttgacatcacctttaggagatcaattcaagcatgcaattcacctcaacttcagggcgactaataacacagccgagtacgaaggactactcgccgggataagagctgcagctgcactcggagtcaggcgactaatcatgaaaggagattccgaactagtcacgaaccaggtgcataaagattacaagtgctctaaccccgagttatctgtcacaccccgaagttttcctcccaagccaaaaattgaatttacaaatgaccccaagaaaatgcaggtgaaatcaggagaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttcttttttcctctctttttcctccttcttgtcaaatgggccgtcggcccatttcccttttccttcccccccctctctgttgggccggccgcaggccgaggcccagcccggtagccggctgcccgcctccctcctctcggggtcgccgacaggtggggcccacctgtcgggcccgtattccttctgccgccgatcccggcgcgccgccgcgcccgaaaccgacgccgcgcccacgtttccgccttccccgggccacgtcgaccacgcccgcgcgtgcgccgcgtttcccgcgcccgttcccctctctctcccgctcgcgcccgcgcccgagatggccgggattcgaaaaccgaatcccgcctctctctcctccccactcccccacgtcggccggcgaatcccgcctcttccggccacgtccggccctctcttcccctatttaagcatcgccggcaccccctctcgctttttccccatttcgccgacccctcccgagctcccaatcgtccccgcgccttgcaaccacccgccgccgccgtttttgctacttcggccgccgctagccgccgctaggctcgccgccgtcttgcgccgtcgccgccgttagattcgcggggtcgagatctacctcggccgcctcttccccgttgaggttcgccgccggagacccgtccccgtcgtgcgccggtgagtgacgccatggccgcggccttcggccggcgctctcgctctctcgcgctctttcctctccctctaatccctctccttttgttcgttaggaggtaccgagctcgtcccgccgtcgccatcgtcctccgtcgcccgccgtcgtcgaccgttgtcggtgaggccctcctcctcgttttctctctctcccgcaccgtttagccgccgcgtcgccgcctagctgcgtagccgccgctccttctttagccgccgctctccgccgccggtcggtcgccgtcggccgtcgccttgcgccgctgccgcatgcgcaccgccgtcgcgtgagcgctgcgccgccggcgccatggtcgccggttcggcttgcgccgtgcccgcgcgcccggtcgcgagctcccaccgccgtccgatctacccttgggtagatcggggccgtcggttcggccgccacgtggagcctccgccccttccatctcccgtgccgctgacagtgggcccgcgagccaccgcccctttctctctctcccgggtcgctgaccggtgggtcccgcatgtcggcgccgcacccctccgtgctgacgtcagccctggttaatattgcgcaataaatgatttaaggtttttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgagatagtcgccgaggttcctccagcagcagagcaaggcaagtcatgcttgtcacttgatcatattgatcctatattgcaaatgtcctaatgttttctttcaaatatcgcatttgttttgcaattatactatgggatggttaccttttgttacagccatgttattttgataccatgctcctttgttagcttgggttataacatgattagagttaggactagggtttgcttagccatgcttagttcaactagcacacaatggggagatctcatttaaaacctagactataggtttttatgataatgttggattagcggcaccgctttggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgagcagtgggggtgaaacctgaggtgtggtgtgcttggttagagggggttatgtgaagggtcctgtcacggcctctttccggtatgtcgtggtggcatgtcggcgcacggaaacgtgtcgtggggctgtgtcctgtgggtacagttgtacacctctgatcagagtaaaactattcgaatagccgtgcccgcggttatgggcggtcaaccagattcaccgtgattagtctcaccctagtgtaatttgttgaacttggatagtttaggtggaaggttgggcctgtcgcaacgtgggttagcgttggacagcggatgtttaatactgcttaattattacaactgttttcgcattaaattcctgtttataaatgccagtatttatgcaaatgaaccactttagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagtttcttttgttttccgctgcatttctgtaagacttttatgatgtttgtaagacgtggatctgaatgtcaacattgtcgtttgtgtaccccggctggtcctggacggggagtttaatgcacattctgcttggaattctattccggaatttctgggcgtgacattatccaagtatctcgcagaagtcagaaagctagaaaaaaggttcgatgggatcgaggtccgacatgtataccgcaaggacaacattgaaccagatgatatagcacggcgtgcgtccagacgagagccactcgaacctggcacctttctagacgtcctgacaaggccatcagtgaaagacgcaagcggtgaagatagcccggtctccctcaacaacagctcgggggctacagaggtagagcgcgtcgttgccgatatcgagaccacagacgactggcgcaccccactcatcaaattcataggcagcaaagagttgcccgaggacgacgcagaagctgagaaaatatcctgtaaagcaaaggtctactatatgatcggcaatgatctatacaagaaggcatcaaatggggtactcctaaaatgcgtctcgtccgacgacggcagacatctcctcctcgacatacatgaagggatctgtgggtcacatgccgcccggtcggacattagtcggaaaagcttttcgacaagggttcttctggccaaccgccctcaaagactcctgcgacatggttcagcggtgtgaagcctgtcaatttcacagtaaacacacaaggctaccagcgcaagcactcaagactatccctctcacttggccgttctcgtgctgggggctagatatactcgggccattcccacgaggacaggacggctacaggttcctattcgtggcgatcgacaaattcactaagtggattgaagcgacacccacgggggaaatcaaggccgacaacgccatcaaattcatcaaagggatattctgcagattcggattgccccaccgtatcataacggacaacggctcccagttcatcagtgccgttttctaggattactgcatcaggctgggagtcaagatctgcttcgcctcggtttctcaccctcagagcaatggacaagtcgagagggcaaacggcatagtactacaaggaatcaagacccgcgtctatgacaagctcatgtcacatgacaagaagtaggacgaagaacttccatcagtactatgggccgtgcgtaccacaccgacaacatccaacaaggagacacccttcttccttgtgtacggctcagaggccatgctccccaccgagctacgacatcaaagtacacgagtacagaaatattccgatgaggatcaggaggagcagcgaaatgacgatgtgaatctgtttgaggaacatcgcgaacgagttaccgttcgagcagccagctaccaacaggcccttcaccgttaccacgagaagcgcatccgagcacgcacgctttcgatcggcgactacgtcctccgacgtgttcaaagccaagcagggcgaaacaagctctcacccaaatgggaaggaccgtacacgatcacacaagttctgcggccaggcgcattcaaaattgcagatggcgattgtcgcgagttggcaaattcctggaacattcatcaattacgtaaattctatgtataagtcaatagtatccatacttgtaagacatcttacagcttcaataaagcctatttttcaggtccagaccaaaatcaaagtgttccttcccgatgatcccttacctagatgacacctagcgttgaaacctaccctcatgtccctttacgctgtcttaacaaggcctccgaggaacctaagggaacttcagctggggccgcccagagccgataagaccttgtcggatcctgtagagacaaaagaccatgtaagatctggtcgtgtaagagttctcgccatgcgtattaaccaagccgtgtaatcggaaataaactttccaacttcacggctgggggctaggatcagtgcttgttcaaccgaggcaggtcaaaggtccaagagccttatcttccgagaagaattctccgatgacaatgctgggggctagggagagtgtataactcaaacgactaatcgaagtcgcgaagtgagaagacactcatacacaatacatccagagtaagaaagcttagttggatagatttcttttctatttcacaagtacttcttacaattctataaaaatccaaaattatattacactcttcccctaggacatttgtcataggacacggagactaccaggaaggccaatgctagtccatagactggaagaccttttccgccagcggcgccatcgacttcgccaggccatctatctccgtaggagttctccgagaacgagaaaacccttcatggaggaactcgaggtgcagctgcggacgatgatctcatatacaggccaatacatgcccccggcatattggctcgatcgacgacactcctgcttcagggcctcgtcgatacgctggctgatgccctcaagctgggcgcaggccccattcagccacgggatgtatccagtcgccgatttctcgggatccccacggggtacccggagctctctacagacccttgacatggaggtgcagaaactcttcagatacgagttgaaccacacctcgcggccccggagtgtctccacggcctggtccttcttcacttccagcatagtcctctcgagttccgcgacctcaaacttcgtcctccaatactggatgcgacgatcctggtcagcaagcgcactctcgaggtctgctcagcatggaaacgactaagtcaaactgctcttctctcacgagaatacaacaaatcaagtcgatccagacggaagagtaaaggagatgaaaacaaagataaccaacctaagggagtcgtcgccatgctcgtttccacaggcgaattttgagctacatcgccctccggcacatgtggctcgaacgcaagtgccggaacgatcactggcaactcaggctgcccgcgctgctggacatcctcgacatcaacatctctacagacgacaacaaagtactcaagatcaaaatgctaaagaaagctaaggcgatgactgcatacacaaaggcggttggaaccaatgaaagttttacaaagcatgactaaggagtacaagagagtcaaaatcctactcttcaaaaagtgggagaacagactcccccagatcgccgacttcttccatcacatccatgcgcgcgtcgctagccgccccctgatccaagattttccgcagatcgagtttagggtgcgccagtctcacacacgcaagtacatggcacggcccggtataggtcccggtggacgtctcctctcccatcctagccgggtgcttggaggggatc

SEQ ID NO: 15265 - DNA, 1537 bp, Oryza sativa
atcctagccgcgtgcttggaggggatctcctccatcgccgtcgccagctccgcaagagaagtcgtcggcgagaactcatcgggattcgccgggatggtagacttgataccgcactccccggcgagctggtgcagaccagtataggtgactcgcaacgagccacggatttccgacaagttgttctcgcgctccgacatgcggtgctcgagtccctgccgttgtcgcttattgccggccaccagctcccgcatcttctggaggtcctcgcgaacctccgccaaatcatgcgccagccggtcggcgcgctcattcgccgacgccgccgccgccgccctcgcctccgcgatctcgcggctaatgccgcgagcaccagcctcaaggaggcaccccatctcaacctggagctcctcccaggtgaggatggcagccggcagacctcgaccagtggcgagattgctagctgggccgctaggtgttgcctcgcggctcctgggcacgaccacgacatccgtcgaggccacgataggagacgcgctggaggtccctccagacccgtcttgcgccgccttcgcccacgccgccctgcgaaaagctgcaactgagacaggctgcaacagtttgacgaagtgacaaaacctcaaagtcatccacttgcttctcgccaagcgtcactagccgttgccgacgtggaggcgggggagacgcgtccgaggcctggagtataacggatatgatgtgaggtggaagttttctgactacgtgatgaaagaacaggagaacttaccgagggggtgggtgtcttccgacgatgtccgaccacagaagagaatttcctcccctttttcagaacgttgccgccactcgttgtggcagcagcagcaacagcgtcagacacctccttggcgactttcttcttcagcgacgccgccacctgatggtccacgagcggcccgatgatatcagtcagagggagagcctacgcttcatgaagtcataatgcgatcccggaagaaaaatgcaaaaggaccgctgagtacacttacattgatggcaacgtcgcgctcggctgcccctttctcgcaaagggggacttggacgttgctcgccgttgtcgggccagtgatcatcagttggccgacacggcgctccacggttgcgctgtccaagcctgtagatcgagaccagaatccgataagtcgggaagaacacgcacataagggagccaatttaactaaaaagaaaaataccccgaggagaaacccgggtcgcgtcctccggcccagaataatcaaaggctggatgggctcgagcctggagcggctagatccgcctaccaatgaagtcggcagcgacttcataccccgacaatccccgtactcggaggtcatcaatgatatcgatgaaagattggagggatggggtcaaggcgagtttggcggtccaagatgaaatcttgtctagttgctcctcaggaacaataaaaaccggatccgaatcttctatctgaagatagaaccacctcccccgccatttgctg

SEQ ID NO: 15266 - DNA, 1542 bp, Oryza sativa
aagaagaaagaggtgaacacaagggaatatatgtgtagtgcgacattaggagtcatcccactacttgttcttgtgcaaatatggcaaggagctcaacattgcttgccctattgcctagcccaaggttcatcactagcacctctggtatgccaacactcgagctaaaacccctccaatgttgctaatcccatacgttgatgctcctatctccaaatagggcgcccgatataatgaaccactatctctactccgtcctccaaatcaggacacaaaccatcgcccattgggactggggacgctcgctgctgccctactcctgctcccttgtagatcaggttgccaccatcaccactctcctctctcggttagatccaagttacacattgattgggctgcacaacaccgatagtcatgcttggtgatggcaatgtgtgcacgcgagagagagcacacacgcaatggtgtaggtgcatgggtgatgccatgatgtgttaccagatttggaaaatatgaggatgtggtcttgagtgaaacacatagtaaatagtaaagttacacggtccaaagtataaaatatgggtaagctatcagaaacaagggtcaaaatatacgagccaaactacaatttacttattttttttctttataaaacagctttacaaacacatattttgatgatctaattatgtgaaaaacgatcactttttttttgactgctttgatgccaaagttgcattatacatcgtggctttgtgtttctaatgatgcattttctattagaatttaaataatcgatatgctaataaataattagtcccttttactttattttttattttttatggcatttgtaaacttaaataattttttatttgttaactaactcgaaaaaagaatgtcgcccacaaatggcagacgtcgccgcgggtgatgggacgacggcccattacacagcccgtgccggctggcacggcccacacggccactcctcaatcctcaataggcgcacgtgcgacgcacgcatttctctgtaaaaaaccctagccttccccatcctcgcctcctcctctctcccaccgctccaccgcctcccctcctctcctctcctctctcccgccgaccaggagaaagaaggaaaaagaagaagaaaaatcctctgcgatggcgaagaagaaggagagggcggtgaacgtgtcggggaagccgcgccactcgctcgacgtcaaccgcgccaatgacaagaagggcgcgggcggcggcgccgggggcggcggcggcggccgctcggccgccacggtgcggcggctcaagatgtacaagatgaggcccctcagggaccgaggcgggaagatcctgaagcacgacctccagtccaaggagctccccaacacccgcatcgagcccgatcgccgctggttcggtgaggatcccagcgcccccctcttcgccttccccttttcttctctagttgggagtgaaatgatactagctgaggagaaaagtgaagtgaattcgattcggctagtaactcggcacctagca

SEQ ID NO: 15267 - DNA, 22119 bp, Oryza sativa
gttgtcgtgcaggtaagtgttgtgacattttgtccttgcaaaaaatactctcactctgtcaaaccatccagacatctttggtgctttttttttttaaaaaaaaagaagtgggcattgatttatttgttgatcctattgttttgcacaggtgttggatgccagggatccaatgggtactagatgctaccatctggagaaacatctgaaggagaatgccaagcacaaacacttggtattcttactaaataaggtattgataagttccacaacaatacacagtgcaaaagacggactattttcatccttgtatggtggcacattgatgaatgatggtatacattttttagtgtgatctagtacctgcttgggccacaaaaggatggttgcgcactttatcaaaggactaccccaccctagcattccatgcaagcatcaacagttcatttggcaaagtaagctagcagaatcctgaagaagttcattgtttcaccataaatgaccccttacgcatttgaatcttttccagggatcacttctttcagtgttacggcagtttgcacgcctgaagagtgacaaacaagctatatctgttggttttgttggataccccaatgttgggaagtcatcagttatcaacacgttacgctccaagagtgtaattctcttttctttaaccggcttcacagatgacatctttttggtgaactttctgagtattttgtttgtatactatatccataggtttgcaaagtggctccaattcctggagagacgaaggtgtggcagtacattactctgactaaaagaatatttctgattgactgccctggggttgtgtaccaaaacaatgattcagaaactgatattgttcttaagggcgtggtatgtatctgcacttgttcgtttttgtcttcactttttagttagattgcacaaaacaaagcatctagtaaaacacctcactatattttttttcaccttgccggtacttttatgtacgacagatatatataatgcattttcgcaaacattatttcaacataagagttagagatgggcttgctgctgctatcttggtctgaggtggtatagaagtcccatgggtagcttttaccctggacaatctacaagactataactattgcctatctgtccggttgtccattaatgcttaaaaaaaattccagtaacacccaaggcaatccaaggatagtgtggattatattttatagttgtttattgcccttcagatatttttctgtggtcacacgctggagcactgccacttttgaagcatatatttatatttatatggatgtctatcctagttgattaccaggcattttaaagatgctacgtttgtgtacttatctagatgggtaatttcattcatcatgtatttgcatttgttgtcaggtgcgtgtgacaaatttggcggatgcttctgagcacattggtgaagttctgagacgtgtaaaaaaggagcatcttaaaagagcttacaaaattgaagactggtatgcttcttttaacatttagtttatggtttcattttaacaattgttctatatagatatgaacataacgcttattatttccacacaatgcgttccctattggataagtatgttagtatttgggttacttttcttttctcataaatctgaacattaagacttggcattttttatgacactattctgttagtttactcatagcatatttgctctcttttgataaagtatatccatgaagaggatgcgcttgcttgtagttagccttgtgatgctgttgtgcatggaaacaattaaaccattggagacagcacatatcttatgttggatatgttatctttctgcagggttgatgataatgattttcttgtccaactgagcaagaccactggaaagctactcagggtatggctttagcatatatgttgacatgttgtcagtcatgtttctatcaaatatattattcttgtggtgaggctttatgagattggggaattggagaattgtaattgtatactgatttacagtgttttacaaattttaacaatataatgtgtcaataagatgggttaattggatccatgccattctaaatatatgaacagcttaaattaaccatctatagaagattctgagcaaaaaaaaactatctttagaagattaaccaacaatttctgatggtgcttacacttgtggttcacagggtggggagcctgatcttacaacaacggccaagatggtgcttcatgactggcagaggggcaagattcccttttttgtgcctccaccacagcaaggtgaagatagtccatctgaaacagctgaacctgtggagaaatccgatgaggaaggggtgagcagtgacagaactgctgccgccatgaaagcgatagcgggaataatctcatcacagcagcagatgaatgttccttgccaaaaggaatttggtgtaactaatgaagatagtgaagtcgcggagcaatcagagtgatctacaaaaggctaggaaccctgcatgataaagaacagggcacaattttgccaaatacctagagattttatgaagatttggtgtctaacaggaatgttacgatgaatgttacgatcgttcagttcaccggtgcgttctactgcaacgaaagagcgttcactgcaacgaaagactggaatcaagggtgtgggactgggaaacttctgtaacttcatatattgtgtgggcctttgttgtagaccagatagagtgttttggtagcttaatataaccattttgttccaactgtacttgaaacaaatttattccgatacattaattccgcaaagtcgttcgtatttgtatggggtcaaaagtgaaatactcttttgttgacggtttaccttttcgtttcacctgcttggctgctgcctgaactgccccttgcttatgtatgcatccatatgggccacaaaatattggtttgttatcgttgggcggacctaaccattgaaaaagggaggaataagtctattatccatccctcaactttacgtcgagtttaatttccaatcctaaatcataacacaaaaaatcttcacccctatcttgataaaaccgtctgaatcaggtcccataacagtatggatggttgcttacgtcatcctagtcacggaaaataaaatgttacatgtaagtgattgagaggatgagggagaaagggtagttgttcgggctcccacgtaacagtgctgaggctgccaccagagccaccgccacccgaatcaatcctaacgagcgcccttcgaggactgcctcgccaccgttggctgcctgactacagtgaagctcacaactagccggaggagcttatcagtatgaagatgaggtgaagagaagaaaggatgtggaaagtagagggccactttgcaagtgagcccacatgtcttaaatttttttttactgattatgatgacacgtcagtaaaaccaaccatccatactattatgggatgggacctgacttgaatgattttattaagatggggtgaagatttttagtattgcggtttagggataacaattcaacttgaagtaaagatgagaaacaacaagtggacttattcaaaaaaaggatgaagtgttatgaaaatttccaactgacggagtataatttctgtaaatgtagcactattttttttatctattctaattttggtcattgctatgggtttagggttcatagggggtataaaatttggatttctaatttcttttagcatggtgtcgtagtcaacactaaatagttgaattaataaatatgaaaatttctaattaaactggcaatacgactaagaattgtttatgaaaaaataatatcatttatgtaggtttcagacggttttcatccaaagaaaaatgttttgatgctctgaaaggggaaaaaaggaatgtgtttctttaagacacagtacaagcatagacaattataaaacacgcaccctcactcttataaacatacacacaaacaccctacctgtatgagtgcctccagaagactagaccgctatcaacgggtgtgtcgcttaccgctgaaagaaaaattagccgtaaatgcgagcacccgtgtcagtcgtaagtctaagacttgaattcggatgagatggttccaccacaaggaacctaaccagctaaactatgtccacttcatggaaatgtgtttttttaagaattaaaaggaacttttaatagttcaaagcgcttggcatgtacaagttcacgatttggaagatcataagtgccacatttcaaattgtgaagtttaatttgcaaatttcagaaccatcctcgttaccttgtcttggtgggttaatcatgacatacatggcgcaaggaaatcttttacaagaactatttgaaacttcatagttatatactgtcggataaatacacacaatgtttaatattgtcgtgacatttcaatccttttgaagtggccaatgaaatggatgcgggaacacacactaaatctttagaagtatctaagttcttgaagtttttctcattctggtttcgttcgtaactttcttaaagttaaaatagtttaggctagggctgaaaggctcgatcatcgttcaaaaattgcaatttttgctaggcaacctctattgtagttgcatggtacttattctatgcttcattttctcacacatttccaaagctgtgtatacggggcttggatctcctggagttggcctcaactgcactaggtggatttcagtcaatcttagccattgtttctaatctatggtaagcatcatgtttgctacaaccgtttcatccacttagctcttcgtaaaaatcatcttctttagcggggtcaataataacccaatcatcaagccgggcggtgccaactcaacatagaacattaattgggtgacaccatgccaaagagaaaccatggtggtcaggcctaggcctagagcatgaaggagattagtagtgcaggaccgcatacagaagtctccatggacatctcgattgatcacgattaggtaggctagctgctagtcatcactgaaaactattggaagtcccattctttttagcaacaaaatatatatatcatctcaacttgtctcttgcatcaaatccattggctcgcacagtactatggcgctatggcaattggcaacactagatccatggggttgccttttggtttggcaaccaatgcttgggcctcagagtgtcttgcttggacggtttggagacttttgaggcgctctagggcaggacgattcaaggtgcagagattggtgatataaggacggagatgaatgatacgagaaaggagatgaatgatgtgaaattgtggaacaatcaagtttgtgtgaaaagaagtgacaattaagatccgctgaaatccatctcgtggagttaaggccaactctagatgatccggacctatgtatactactaaaaaatcgaacacgaataagtagggtctcaacatgagcccttaccttttgtgctagcatagttgccaaaattaagaatccagacgatgcatatcattcagtcaatgtttaatgcatatcccatattaaacaagtttcatggttctcaatgtgtgcgttattcataggaattaaaagaggaacttcaaaattggaacatagcatggcacaatcaatttaaaaaatgaggtcgttggacaaagtcatgcaccgatagaggctgtggctcatgcaatcttactagcaaaggtgagacgaataacatgaacacggtagcgtcgataaagagaatgctagagtgttagcaagcccaatcctgtcaatttagtggcctggagcgaagctagaaaaatgggccctctaatacaactatagtaatgtgcattttgggcaacatgatttcactctaaatttagaaataagcaagtgatttatgaaaattatgtcatactagattcaattcaacgttataataaaaatgagtgctggtaaattaccaagatgagaactagagaaaatgactattcactgtcctagttgcacagctgcaccgcaaggatccctaaatcctaaatcaaaatttcagaaattagaagaggagcaattgggagtaacattttgcatcccaaaatttaaacacataaacttagcatacatcaaaggggagagcaattgggtacctcctagtctcctagaattgaacagagagatcggatttttgcatccggctgccagttgcagttttgccgccgagcacgacgccgtagacatgtagccgcgcgcagtcgtcgacgtagcattgcgtagctgagacgcggctggaagggcggcgaatagccgaacaggcgactgcgagcgaaggcgaagcaatcggacggaatcacggaaggaagccaaatcgacacaattttttttcctgtacgtgtgcctcttcatctactgagctagtgggcttcctaattcctataggctattatgttagcatatatggggttgggcccccatcacttcgcgggccctgtgtggaggcccagctcgaccccctagggctgggcctgagtgttagctcagaagtcccacgaaatagaatgtgacatgagcgaatggtggtggcttggtggaagtcgacgaggagataataatgatgggaggttttggcgaatggcaggcgggtaattttctcttaatttaatgggcacttccatatttcattcgcttaattcttttggggaaggcaaataccacaccacatgccttgtgtaaaaggatggacagactcttgttgatattactggggaaaccgtgtaacaaatactcatttggtagaattcatcttgaaatttgttaaaatcacccaattgaagagacaaaatagtgggccgttcattagtttagatgaaaaatctggactcttgagtaaaattcgcatagttgcatgaccggatttaatgtgagaacgaaaaatcccgcgtccccccaacgaacccaagcgctagagagagggaaaaaaaacctctcgccgtcgcatgcactcccggttcgctttccctgctcccctctcttctcctctcgcgtcgtgctcgtgcctgcccccttcccagttccctccctttggcttggtttctctcaccaaatgccaaagccaccatgccttctctactactactactactactacccctccccaccacaacatcccgcagccccccctccccaccgcctccttctccctcctctccgtcctccccttttctacgacccttcgttccccaaaacctaaccttaatatccacgcctccctccccgccgacgccggccgctgcggggtctcgactacaccctcctgcgcggtccctcccgggggacctcgcgtgcgcccgcaaccgccggatcctcctggatctccctcttcctgcttgcgtctctgcgcgcgtgggggcgggggcgcggtagggtttctggatggacccgcggcgccctccgtcgcgcgggggcgccgccgtcaacggcggcgggctctcctactccaccctcttcaacctcgaggtactgcctgctctctctctctctccctctctgtatgtgcgtgcttcggtggatggtggttttgacgcgcgcggtagtggcggtgttggagtggggggcgcgttgtgattggggtgggtattggtagtgctcattgtcgctgggttttggagaattctctccgggcgctgtatcatcacttggttgtttttttaagcctcagttcgatcgaggttttagttgtgtctcgcgggattgggagctcgttagttgtgggctaatgcaggttactttgcatcggtgttgcgatcgtctgtagaagccgatgccccgtgctactgttctgttggttaggactcaaataagtgtgtgccacataagtgttatgctgtttagcagtatctagttgtttcctgagactggttcagtagtttgctagatcttcatgtagacttgggctactttagtggcttccaccgatcaaagtttcgtgtgtttcagatagtgacagagtgatacgagtatcgtgatcatctgttgtgccattcatgtcgctaatcaaatgttgatgccggtaacttggtcgttatattcatgcaacatttccaatatcgcatgcgcgacgatgatgaccttgttttgttgcgattgcatgccatttcttttttctgaatttagttaatgctatgtttcgttcatagatgagtattgtcagttgctggcatcatctgtgtatgttcctgtgttgtctgttgtgattgtggtctgcatggcgtgcaacatgctgctgcactgttatcattgttctggcagttttgttgttttttttatcgctgttcttttattatttttcttgataagtatggtcatgcataataaagttttttttcttgacatgtgtgatccttgcttcgggtttaaatttattttatttgataaggttatgaattgggggcctgcaagggtacattggtttactacgtaatcgcatcttttatcttgtcatcctttgtttttgatactactatagtgttattgttgcttgtctatccgtttggtctatatggatgcaggtctctttatttgtctttggtagggttgaaaattatatatagattttgtcattgtgaagcatatgtcttcccactcatgttaataatatggtttactttagttgaatttacctccattctgatgtcaagtttttacatgaactgctgatgcagcctttgctgaactttaaggtccccttgccggaagatcttgatcgctataggcgtagtagcccaaatgggagtatgagtagccaaggtaaaggctatttaaaaaaatccacctcctagcattgacactccatcaaattgtggtcttgccatttctttacatatatctacttctgtgtttgttctgcttaccctacttttccttttaggtcaagggtccttgtcagaccagtataatggaattaatgatgcttcccatgggctacatcggaagcgcaaaaggaatctggatggtgctagcgatgatgatgaggtagatgcctacagtaaccaaataactgaggagcactaccgtacaatgctgagtgaacacgttcagaagtacagaaggtcaaagtttaaggaggatgtttttagttctgatcctcctcaggtgatagttcctcagaaacacaaaaatggtagtgcaagagttacaaagtacagaagtgatacaaggaatgttgcaatgttgggtggggtagaagccacagctgagtataatgggacaaaatctactaatgcatatggtggtttcaataaggttgtagcttcactggattcttcctatttagatatgggagataatgtaagctacaaaatcccagaagggtatgataagttggcactatcccttaatctacctgttttttctgacatacgtgtcgaggaaactttcttgaatggcacactagatttacgcactctagcggcaatgctcagtacggaccaaaaatttgagacaaccaatcgtggtggattagctgaacctcagccacaatatgaatcactccaggaaagggtaaaggtgcagaaattttctcttcaagtaactgaggatcccttcgcaattccagaaggagcagctgggaggatacggagatttattatttcggaatccggcagtttgcatgttcattacgttaaagtcttggaaaaaggagatacatatgaggttggttggacctgttcaaatattgatagcatgcttttgttttctatatacttagcagttaacctataaatgcagattatcgagcgtagtttgccaaagaagcaaataataagaaaggatccttctgaaattgcaagagaagagtcagaaaagactattaaactttggcatgctattgctgttaaaggcattcctaggcaccacaggaatttcatggctttgctgaagaaacggcaagtagatgctaagcgtttttctgagaattgccaacgggaggtattgcacttctctatcttgttggctattttgtagtttggttcactctagtttttgatcttgctgagttaatagcaatgctgcagctttattgagttttgtgtttaaaatgtccaggtaaagttcaaagtaagcaggtcactgaaattgatgaggagtgccgccatacgtacacggaggctggctagggatatgttgatattttggaagcgagttgacaaggagcaggttttttttaatctcttaagcttattgttttttagttccactgaaaccaaattcggaattattgccttttattttttttctaaacaacagtatatggggctgaatactatttaaatacttaaacttatgagttgtatatggctatgtatttcagttcttccaagccactgaactgaaaccaaacaacagtatatggggctgaatactatttaaatacttaaaattaggggttatatatggctatgtattccagtcgttccaagccactttaatttctatatacatggttaaaacttaaaaattagcaccaagtattgtattgttttgcatagcacatgtttttctttttgctgatttttcttatgcgatcttatgatgggagttatatatcttttttttttgtctgtttcatagtatgaattgaggaaaagagaagaaaaggaggcggctgaagctttgaagcgtgaagaggagctacgtgaagcaaaaagacagcaacagaggctcaactttctcctatcccaaactgagctttatagtcactttatgcagaataaggctggtgaatcagcaccatcagatgaggcatctgtccctgaagaggatgaggaagatcctgaggaagctgaattaaagagagaggccttgagagctgcgcaacatgctgtctcccaacagaaaaggatgacaaatgcgtttgatagtgaaactgggaggcttcgtcaatcatctgactctggtattccaactgatgatttagctagtatggagcctaacaagattgatctattacacccgtaagttccactcgactggtttggttgtccttgttcagaattgagcatgttagaaagaatgaaaggacttctaacactggtttctttggggttatcttattttcagctcaacaatgcctgagaagtcgtctgtgcagacaccagaattgtttaaaggtgcactaaaagaatatcagttaaaaggtttacagtggttggttaattgctacgagcaggtacactgttaaaaagttaatgcatctgatcattttctgtgacttctctgctgtttcacttcaatattttctatttcttgcagggattaaatggtattcttgctgatgagatgggtcttggcaaaaccgtccaggctatggcattcttagcacatttggctgaggttggtgaatttgccctttcttaaatccatgttatctttctactattggattaatacccaatgaagcaatctcttttggcctttgtgcttgatcttggttgattcatgatttatcatcatgttctatttcttcctttagaagcatcacacaatgtgtaatttataggttcaaatattaacacgcgtgccaagcttttgatatagacatgtacaccatgcaggacaaaaacatatggggtccctttcttgttgtggctcccgcatctgttgtgaataattgggctgaagaggtaatcaggttttgccctgatctaaagatacttccctattggggtcctgaaaggatggttcttcggaaaaacatcaaccccaaacgtctttatcgaaggcaagaagtatttattatcttcatttgcgttccttccatttataggcgcgtaaaactaaacatgtgagttttgccctttctccacagagatgctagtttccacattctcattacaaattatcagatacttgtgaatgaagagaagcttttgagacgtgttaagtggcaatacatggttttggatgaggcccaggctattaaaagttcaagcaggtaacaattcatcttgcaagtcctttcattttgttgaaaaccaaaatttcatggctcatgcctgtcttcatttattcatctgatatttttccttcgttgagactcttatctgggaattattgtattttatcttttcctccctctgctgcagccagcgatggaagacattactgagttttaactgtcgaaatcgcttgcttctcactggaacacctatacagaacaacatggctgagttatgggcgcttcttcatttcatcatgcctactttgtttgacagccatgaacagtttaatgagtggttctcaaaagggtacttacctacattacaaattatacattctttgttttagtcattatctttattgcttatatttctttggcctgccagaattgagggtcatgccgaacatggaggtgctctgaatgaacatcagcttagtcgactggtaagatacacagccctacactgaacggaacttttatgcatgttatggtttagttaatcttttgaatagtcttgtttgagactgacgtggaattataatgagggcttgaattctcaaatacagtacatgactaaatgacagatgctcaattctcctgttttggacaaagttctgtatagctttggtatatttttgagattatataacttgttctttttctccacagcatgctattttaaagcccttcatgctccgtcgagttaagattgatgtcattgcagaaatgaccaaaaagaaagaagaaattgtgccctgcagattgagttctcgccagcaagtcttctatcaagccataaagaataaaatatctcttaacgagttgcttgatggaagtcgtggcaatctaaatgataagaaattacttagcctgatgaatattgtgatgcagctccggaaggtaacattagcacaacaccttcttgcatgtgatcaatttacttgacttaataatcattaaggtccctttagcaatttcagctaatgtttactctgttgtttctcattggatttcctcccaatgtgttatgtatcacatttaggtctgcaatcatccagagctgtttgagcgcaatgaggggagctcttacttttactttgctgacatcccgaactcacttctttctcctgcatttggggaattgcaagatgtgcattatgcagggaagaggaatccaataatgtttgaggtataattaaacatatggtcagatttttctgtttctaattggcgtacttgcagttaccttatgtattctccttaattgctaactaaactgataggcttctttctgaaccttttcagattccaaagttagtctacaaaggaatcgtctcgaacatggaaatgcctgtgcgtggttgtggatttctatatggatctttcaacaggatgtttaatatattttcgccaagctacatccatcaatcagcttttccagaagctatctcaccaaataatactgttctgttatctggtgcattcggttttacacgtttaataaatctctccccagttgaagcttctttcctggccacttgctcattattcaacagactagcattctcagcagtgcgatggaacaagaagtacaccgatgaacttgtggatgtattccttgactcagaaagtactgatcttgagtccactcataatgatttaacaacagttcgtgctgttgttcgcttgttgctttcacctacaaaagcagagtccagtttcctaagaacaaagattgagacaggcccgagtgatagcccatatgaagcactagtgctttctcaccatgaaaggcttgtgtctaacataagacttcttcgttcaacatatgcttttattccacctgctagagcaccaccggtaagttcctttattttatgtgatgacttgttttcccagttctatcatttgtatgttgcatcaggctgtgtatggagttgtcttacagtattcttaggctactctagtattaaaagtattcaaaacttccatatagtgtaggaaatgtatttattttatctacacaagctatcaatgctcaattggtgctactattgaatgactcattacccttttctttcgtttcagataaatgtctggtgcgcagaccgaaattttgcctacaagttaactgatgagatgcatgatccattggccaagaaactggttctgggatttgctcgaacttctgagttcaatggccctagagaaccaaccagccctcattctctgatagaagaattacatactgatttgccattccccgagccgatgctacaactgccatataggatatttgggtcatctccacctatgagtaactttgacccagctaaaatgcttacagtaagtgttctctaatttcctctgtccatgatgctagggtattgcctatttagatttttcttcatctgcacaattctgtcattcatagttgtatttttttttcccaatgaactgctcaattgctttgaaaagctctaagatttgtgtagaatataactttatcataataagttggttcaaacacctgaataaaggacaaattgtttgtgttttcattaatatgcttttagctgtaccagtgagttctttttactaacatgaaatgctcaatgacaggattctgggaagctccaaaccttagatatactgttgcggcgcctccgagctgagaatcaccgtgtgctcttatttgctcagatgactaaaatgttagacattcttgaggtagtactggtcacttcatgcttgtccactttacacttaaaagtataataccaccataaggtaattgagttttttcttaaaaaaaaaactaaaacaagtgacttttgcttgcgccttttactcataagtgatatagagattctctaagtgcctggagataagttgttttattgcatacaactttagatatgtttttggcattctgcaagtcaacaatctttggtcaattatcagatctcaatacaaaatactttatgctttgaaccgaagcatgttttgtaatatttaccattagacactgcatatgtcctatactacatgtaggccttacaatataagaatattcttgtagcattagggtagtgtcatgacttcaatatgtgagtcttcgcttagcatatcatctttcaggagtttttagtttccatttcttttgctggcactgtgaattgcatcaaccgaaaagtagatattggagtatttttcttgtatttttgctcactaaagttgagcccctttctaactactcagcaattatgcattgctattgttctaggactacatgaacttcagaaaattcaagtatttcagacttgatgggtcatcggcaatatctgatcgacgtgacatggtccgggacttccagaaccggtatgcattagtggataaaggataatgtacagtaagatgatctaacgccatgctattcaaacatggcttacctgaattttcttctctgcaggaacgatatatttgttttcttgctaagcacaagagctgggggcctaggtattaatttgactgctgctgatacagttattttttatgaaattgattggaacccaacacaagaccagcaagcaatggatagaacacacagacttggtcagacaaaggaggtaactgaagcttcagttataaatactttatctaatcatagtactatagcttatagtgtgctcctcagctacgtatttcttttggagcatttttctgccttttatggcaactctttttagtgatgcccctcctttttttttttggtttgacgttggttagctcaaaactgaactaaccaacgtcaaacatttggaaacgaaaggagtattaaatagcactggcacgtcacaaaatagctcaactctttttagcgcattgtccattatctatatttataaattatataacactatcatttgaattttggaatgaaatatgtggtagctcatttccttgtattttctttcaaattggtattgtaggtaacggtgtatagacttatatgcaaagatacaatagaagagaagatattgcagagggcaaagcagaaaaatgcagtgcaagagttggtcatgaaaggaaaacatgtccaggatgatcatctgatgagacaagaggatgttgtttcattacttattgatgacacacagatatcgcacaaattaaaagaaatatcaatgcaggtattttttatactacttccatcttttatttggcacatcgcattgttttcatctagtccacccatatacttgaaacgttgacagcatacatggatgacctagatttgagatgtaagaactagatttataatcgaactaatctccctttgcctaccaatcagtggcatgcttttgttcattttttccccatttagtaacacctgtttggcatatgctattcaaactctttgaatagttgcaaatcaccgtgttattaatgttctcaagatgattgggaaaatctatccccattgggacaataaaccaaccatagggcccaccccttattagattcagtgcaaaaaccttactacttttattgagttaagacttgattcatgattggttgatttctggttctgccaattatcaaggagtttatgtagtgtattattgaaaaacttaagaaaacaacctcaaaaaagtacgaagcttatttctcctgtttgtttttgagattttgcctagttcattttatggtttgcattagaaaacgtatcatcatgaaagcatttggaaacctttcattggtttatggaagagtttggcgaccaactttttttcttgttggtattgtactataacaattgttacacatgtcatcttattacatgttattaggttttacatgctgtagaacaacaaaccttgaattaaaattgctgcagtaatatggcaaaagatgaggttgtttgaattggtttcttaatagaatgtccgttgagttttcgttataatgaaatattgagtatggcatggaatgtcaacatgttttatttaatttcaatggaaaaaagtcgggtgacaatgtttttcatttctatttacccttttaggcaaaggaccgactaaaaaagaggcgtacaaagggcatcaaggttgacaaagaaggagatttgatgcttgaagacttggatgatcaaacttcaggggctgcagaacatgataacacatcaagcaaaaaggtgaacacaagaaatgcctccaagcaatgagttagctatttccatagtagaaaatagtcagaacaatctgcagtttcccgaatgattgctgtctatcacaaatgcacacaaagtcattgagacattaatttaaatacacagtacacaatcttgaatttcaattttaagctaagtagagcgtaaaagttcaaatttgtggggctataattttcactgcttgaatttgataaattgtccatgttaaactcagttgacagacctctataccatatacaggagcatgtactcctatatatgagtttggtgttaggctatattggttagctcgagtttgacttgaattataactcatctctataacctgtgcatttagaggaagagtactaatgcgtaggtttaattagacttgcaacaatttttttttatgaaattgtcatctttgcttctgtaagaccttatcaccttgagacttggctgttcttttataaactaaacctgtttaacagttctggttggtaggtttcaagcattggaaatgtgagccaaaaagagatatacttatcccgttttaagtttttgatgtgagcttttactcatttcttactaccaaactttttacagaagaaaagctcccaaaagaagcttccaaagttgcaggataatggtagtgtggacaagaatgcagaggctgaaggcggtgaagtggaggatgaagatagtattgcagctcctaggcctaaaagatcgaagagactgatgaagaacttgaacgaggacaaggaaccagaacaggaaccaacgactgatggtgacaatccggcagaagcagctgagaataacatatctcctgacgataatgatacagaagaggcaaaagatcggactccttcagcctaactgacaaattaatcggataacaaacacagggtgctaaatggcaaggctagtgtgatctatcctgcccgatttatgacatgggcacgacagattgcatggttcattgtcaagaggaatagtcgttggatcttcctgaaggtgtcacacagttcaataagtgtttatgtgcacatctttttcggaagcctgggaactgggttagttgtatattcgattgtgttagaaggcatcagtgcagtggcatcggttgctgttaatcgtgacatgggcgaatcctctagctgttgctgcggatgttggaattgtggagacctgaccgctgatatctgtgatgctggctgtggccattatgtaaataatcatgaaaaatattgcatcacatatagaaataattttgccgtgtaaagagagtaggtgactatattaaccataagttttgtattgatagctgaaagagaacatagcaggaaagctgctgtgcttccaaattggaaacattttcgaccatttatgaacgtctatgctaatccctatgctaaattgctaattgttatattttatggtcagcatagatttgaatgttgcgaaattttggtttggcaattggtatcatgtgattgcaaaacagaaccagccatgcttaaggaagtaactacaaaacatgcttaaggaagtaactacaaatcaggcgtctgattttttaaataaaaataaaaaatcgggtgcttcattccctgatgctggcggtactccctctaatctttttctctggttggctatctaacacacgcaagacgctatatggatgtgcataaattcatatatggcttaagcccattttatatgcttatcttaagctatttcttaggtctttaagtgaaattttcttctaaattaattatctaatttataggttctcatcggaaagttaaatgttttggctgatcagccaaagttgccttcttcaattcagccaaagaaaatccatcggttggtttgttttgcttaaatggttcgaagaagaatttctacgactggtggttgtagctcctagcttttagctcttgtatatccatgtatatctggctgaaagctctcagcctaatcagcgaggcgatgggctttcgctgaaaagcctcacctcaaacagccatcctatgaggctaataatccaatttgaccattatactcattgtaattaaatctttataataatatctcatagaattatattttgataagaaaaattgaacgttgtttaaccatttataaaaatttgtttcaccacttcgttaaatgttccagcttactcaataaaaatgtttcaaaaaaaatgcaacattttgaatatattgactgcaatactagcaatcattgtatgaagcattgagtcccaacgagtgagacataaaaaaatcatatgaaaaatgcagtatatttgcaaatacttaatattgttgaaacatttttatatcatgtataaaactaacttttgaaacattaaactgaaatactaactaaaacattcaaagaattaatacatgtaacaggggcaaattaactagcactagttgaaacatttaagtaaaattagatgcaatattaaaaaatctattgaaaaagctaaatattattttcatcggaatgtgtattcttgttgtaactatttaattataacaaatttaatagtatggccggaccataaattagagaagtaatttaagaaaaaaaaccatataaagatgcattcatttgtacataaaatggtgctgtggggaagctagtgcataatgagatgagagagagaagaggggggagtggtttccgatatttctccagagtgtcgagcgcctgacgtagggtgttactacatgcctaatataagtcgaagaggttaattgtttatgccacttctaagttctggtcaaatggatttacatattgcaagcaaagtgcaaagcaaacgatttaatgaactggaaattgattatccatctattttctgacaccttaaaccgatcatgttgagttgttttcatcacataggagtagggcgagggattataatccaaataaggagaggccgagaaagaaatgtggagatgagagttgggggtagactattcctcttcaccaagaaggtgcaggcccttcttgtctgcttcgtctgcctcatacttgagggtgctgaccacttttgtttcatggctgtggtcatgagaacaatttcgtttttctagaggagtattttttacctggcctctacattcaactggacatatgcaacctttttaaattaaaaaattagctcctaaaacaattcagaaatttaattctatgaaaatttaaactcaataccttagggtgctattcaattcactgcaaccactgaactacatgagcacaatctcctaccgtggcatgggagaaggccaatgtgcagaggatgcagcaggcagtggcaagtgtgagtggcatttcggggatgatgaggagcgatggctcgttggaccccatttaagtgtggttcattttttctaggttgggcggttttcatttgtgtcggtctatttttggtcagagcagtttccatgtgatacattgggtatggtggtcgaggggatgacatgaacagaactctatcttttaacagtagaggtgaataaatactatttgcattaattagttacttggatagaaaccataagttagtaactcctcgaatgaaataattaaagagagaagaggagcaagaggaaagtcacctaagagcatcatgtgcgcgatcattccatgatccacattaaactgtgtggaattgcaatgttttgaaaagttcaaattaacatttttgtttgataaattactttgaactgggtttaagctttaatgacgtcaagatgaatggatggaatacgtagtactgacccttattgcaccagcaagtacatctaattaatgcattgcctgtcatcatttattgtattttttttgccaatcaattgctcagttatagtttaaaggtaaaatatacagtgatgaaaattcattaatttcttttctttgcgaggaaaaattcattaattttgacacaagcagagagagcacaccacccaagttatctttgcctgaatcacatcatctctccagataatgcaaatttctttttaagactccatgtgggacacattaattctcatcactaaaaaaacataaaagtcatcaagtaaataaggcaaacaccttgaaattaaggtgaaaatcagtaagaatatgttcttttgataagattaaaaaaacgtgtctattactcgccttttcctctatatatagcccattcatcacctctctgtataaactcatccaatgatccctccattctccacacctcaaagcctctcttcctccaaagaagcgtagaaagcaatggtccacgatgtccaccagtggctgccgttggagatccttagggacatcagcatttttcgacaaacgtgcagctgaggggcacaacctcgccatcgtcgaggacctcgccgcacgtctcaccattgtccttcttgctcccacccctctctggttaggtcggccaactcatatggtcaaaaattttgtgccccaccaccgatgaaagtgtggcagttcatgagaaacgatgaaaatctggtgtgcttgttgcaccgccgaggttttgctccggtgatgcggtcaccacaaccagtgctagcgccgctggcaccctgcagacaccccatcttgcaaattaagtggagtgatgccggatgcaacggagttttcttgctgcaagagccaaggcatacgataaccgggcgatccaccaatgtggccatggggatgtcagggttggccagcgtgaagcggccacctcgtccatgtcaagagcgtcagcaatacgaggaggaggcagccatgatgagaattggcgtccgtggacggtgaattcgaacaccgtctgcctcaagcatgcgg

SEQ ID NO: 15268 - DNA, 733 bp, Oryza sativa
cagaacgaaatatatccagcaatattaaagcttgtgaataaagaaatgtgctggtaacaaccactagcataacacaaacttgagataattctcattcatactgaaaggatcagaacacaattttaaaacgggtgaggaaaatttaactaacaattgcagcaattcgtttttttgcacaaacaattaaacacttcagcagtatgtgggcaactgggcacctactttacacttaacaactatgtttgtaaaagctagataacagataccatatggatataacaggctcaaatgtacatacagaaggcaaggatatcaccttatcattaaaagggtcaaaattgctgttcggcttacctcattgagaaaaggttctaacagacgcagctgaagatcggttccttcagctgctatggcgcagaagaaacgcttgaagtttcctaggtggtagaatctgcagaaagaagatcagaacatatatatatcaattaagtttaaaatgatgtgtctcaatagttagcacttctgagttgtcccaaatcatactgctgtgcacaaagaagactcaagaagcatgatggctcttagagcatgacaaaaatgaaggctctatgtatgttgatacaaataatatgcataaagttaccttaatatagatctagcaaataccatttcctttgattgtataattgaagcagatagatggccataccacaaagagagtgaatctacctgg

SEQ ID NO: 15269 - DNA, 705 bp, Oryza sativa
  unsure (1)..(705): unsure at all n locations
nnnnnnnnnnnnnnnnnnnnnnnnnnnnnnnnnnnnnnnttggcctgccagaattgagggtcatgccgaacatggaggtgctctgaatgaacatcagcttagtcgactggtaagatacacagccctacactgaacggaacttttatgcatgttatggtttagttaatcttttgaatagtcttgtttgagactgacgtggaattataatgagggcttgaattctcaaatacagtacatgactaaatgacagatgctcaattctcctgttttggacaaagttctgtatagctttggtatatttttgagattatataacttgttctttttctccacagcatgctattttaaagcccttcatgctccgtcgagttaagattgatgtcattgcagaaatgaccaaaaagaaagaagaaattgtgccctgcagattgagttctcgccagcaagtcttctatcaagccataaagaataaaatatctcttaacgagttgcttgatggaagtcgtggcaatctaaatgataagaaattacttagcctgatgaatattgagatgcagctccggaaggtaacattagcacaacaccttcttgcatgtgatcaatttacttgacttaataatcattaaggtccctttagcaatttcagctaatgtttactctgttggttctcattggatttcctcccaatgtgttatgtatcacatt

SEQ ID NO: 15270 - DNA, 641 bp, Oryza sativa
ggcatgtccacgtggcgttttaagtgggtctaaggactatattaagccgcatgataatctttagggtcttgtttggacatttaaaacatcaaggactaattcgatccctgagcaaaagttgaaggactaaactggctatttacccaaagactttggaaaaatggtgatttaagaacagagcctcagaccggttaacatttgatgcatttgtcagctctgggccatcgaagcaaaacacggtggcccatactccacatggcagaggtgtttttgggctgggcctgcggccactttcaccatcgccgatcggctacaggactcgaacacacacaacgatagtcaactgttatggctctcatcctctgccaaatggtccagcttctctgtgcttcaccttcacggatcccgtcctgttcttttgtgattaggccttgtcagtgcaagtttcaaaagagtttcaatcttatcaaaagatgatataacatcaaatttattaagagagaatgaatgagtttcatttagatgaaattaatattacacgcgaaacaatgaaactgcgttgggactgaatcatttcatcatatgtcttggaaaagaaaataaaccccattataagtttattaccaaatagtttcataaca

SEQ ID NO: 15271 - DNA, 1160 bp, Oryza sativa
  unsure (1)..(1160): unsure at all n locations
nnnnnnnnnnnnnnnnnnnnnnnnnnnnnnnnnnnnnnnnnnnnnnnnnnnnnnnnnnnnnnnnncctaaattgaaactagtttagcactccaaggcctccgaccaaattgaatactgtttcaaggcatttcaaactgataattagacaaatcagcatgctgttgctaacctcagtacggcctggcataataggcctcccagccaacaactcggctagaatacaccccgcgctccacaggtcaacgcccaccccataatccgtggagcccaaaagcaactccggtgggcggtaccacagcgtcaccaccctgctcgtcatcggctgattcttgttgggatcgaacaacgacgccaggccgaaatctgcgatcttcagcatgccattgttatccaacagcaggttcgaccccttgatgtcgcggtgcagcactccattgttgtggcaatgctccagcccggacagcagctggtgcatgtagcacttaacctgcatgtcagcatgccatggaaaacctcaattaatttcacgacattgcgtgctggaacatgaggctgcacaaagatcttggcggggggagacctgtggctcggtgaagctgatgtcggggctggcggcgaggccggcgaggtcgtgctccatgtactcgaagacgaggtagaggctgcaggacatgcgggaggtgacgaggccctcgagcttgacgacgttggggtggtggaggcggcggaggatgaggatctcgcgggccatgaagcggacgctctcgggctccaggttgtcgaaccgcaccttcttgagcgccacgatcttgcccgtcgccgtgtcccgcgccttgtacacgttgctgtacgtcccctgcccgatctgcgccaccgacaacaccgcgcgctgttgatgagctcagctcgcgacaatggcgagcgcgagggcggggggagctcgtaccttgtcgatcttctcgaaggagtcggcgcggcgaggggtccagccgtcgatggcctcgccgacgacggcggagagccaggcgggccagccggccgccacctgctccccgcgcgccctgttggcgaagctccccccgagcccgaggcgggccgactccgcggcggaccgcgacgaccgtgcgcgcctctccctcctggccggcttcggcggctt

SEQ ID NO: 15272 - DNA, 2795 bp, Oryza sativa
taagacccaaagctaatatatgtggttaagtcacgtcacctcaaattaccatagccattagatgaaatagcaacagtttagattgcagtctctacttagcttcccttccattaacagtagcccaatatacatgggcaagcccaatccactgcctaggcccaattcgcccgttcccactacactgccgagcgtttccatctacccgcgccacctgaataacggccgacgcgccggctccctacctcccgcgcgcctccccgcctcctcgaaactgctcgcctccttggtatttggagagacagaaaactaatcgtcgccgcacatggagtaaaatttcattagaaaccgtcttccacagcataacagtcttctcgcattacttcgattggtttcctacttcatctccgtcactggaaacggcctctccctcccatgaaacctggagcagcccctcacctttaagaaatcacacgagtatacaatcttctcccaaaggtctgcttcctcctcttcttgaatcacatatatgttcattcaatttatggcctttatttctttttccatggacgctagatttatttgttcctcttgccactgaagttatcaaagaatagaaaaacagacagatggatttggttttgtcccttctttatgtttctactagcaagattgaaatttatttggtctgtatacttaaaggagtcaattcatggtatttataaggtttctactagcctgttcatggtatgtaaaccattttttcaactttgctgtacctataatttgttgtgtttctaaactcctattgcagttcgtccctacacctattgcctactatcattgtagcagcagctatgggctattactgaggtcagtacccataacattcccatccaaagcagcgactgattgggtttttccatatgattcctctatcaagaaaatatcccaatatattggtacctcatattcgttcatggtcaccggctttcaagatattattatatgatcatcctacgatatcttcttttcaagatattactaagcatttcttctgtaaaaacaccgtcaggattttcatgtatatactatcatagattgcaagtgcaaggttatgtgtgattattttaacaatgaacttaatttaggtacatatattggttcctggatctgtgcatgctatccttccttgctatatgatgtttctactttaagttcagaattgtaagctacagttttgtgattgatgtaactttattcttcggattttgttctgtctgaggtttcaatgtagtccaagaatgtaaatcacatcagccaatgtgatcaaccacaaaacagaaatgcccttgatcgccatcggcagtaatgcatataataatttgattatcccggtgctcaaaactttttctcgccaacttctagatctcagattttttccaaccccccatatggtaagtttattgatattatggtcattaatttctgtttatgctacatattgctttctccttgctttccggagtcatccgtcagatatcacattttctctttagttcattaaaattgtattaaggtacaatgttgtatcaggaataatttcagttatatatctgtttagtcagtaaaatatatatgtggtactcaagcatgaggtaaagctgaccctttcaaaacatgaaaatatttcatggaattgcactttgttttgttgttattgcatatgttctacatgttgcaggcacctactttttgtgtcatcttaacacggtgtttcatctgtagacttgctacattgctccaactccacagatcaaagttagtactttagatggcagcttaattagttttaaggcactagccctagagctaaaaaaataattacagtttaatctgcttattccacttagacatgatttataatataattcacttaaaaaactatttcctttaataatctaatctatatatgcattagattataccacaacatcaccaatcttttgcacccatgaatggtactttgatgcttcagactatcacataatatttctgtactatatgaatcatgtatttttcttattacacaaatgtacttttgatatagtttttaagtttacacatattgcacatgagtattccgcagcaacgcgcggggtatcatctagtattctaaataaaaggtgttaattatctcctgaggtcatactactcttttttttaacaggccaaattatccaataaatttagtgggttacatcccatccaagtgcactttcaagtcaacatagaaatctatttaagggcatttagttttgtgcaaatacaagcaatccggctgagtttgaaaagcaggggatcgagaagatacgtaaaacgagacgatcaattagcacatgattaattgagtattatctattttaaattttaaaaatagattaatatgattttttaaagaaacttgtctatagaatttttttgcaaaaaatacattgtttagtagtttggaaaacgtgcgcgtggaaaacgacgtgttttctcactcaatgtcccctgaacgaacgtgtccgtgtaggagggtgaagtcttactctaaaccagcggcttctttagaacaaaagaaatttgtatggttcaaatcctataataaaattcatacatgcccatttgaaacaaacgaatagccataccaaaatcatacgaaattccttatatttcctctcatcatgagaattttaaagggttttcatcgtaagatacaatctcttcgaaaatccaattgtgtctaactccca

SEQ ID NO: 15273 - DNA, 1042 bp, Oryza sativa
ttttttaacggagggagtatgttctgtctatagcagacttcctttttctgctctaaattttattctttttttttttttgccttttgagatattgcgtttgtcattcatgtgtatcactaaacaaatctaacctgccacgctcctgttgccggtgttcgagaaaagcaagaccacgaacatgttacctacaatagaagtagggttgtgtttagttcaacgcaaagtttagattttagtagaaattagagatgatgtaattgaaaagttgtgtgtgtataacaggttgatgtgatggaaaaggactgaagtttggatccaaactttagatttaaacacagcctactacgaggacttgtgcaagaaaatgtttctgaggtatttgtcacatgtcagtaacttggacttgtgcatttcgaggtatttgtcgctgagaaacttgttacatctgttcccttgcaagaccaagctgttaagtctagtgccacaatatacggctgtcaggcaaagcagttcacaagtaaaggctgtgattttcatcatgcagttgcgtagttgcgtcttgcgtcagacaaaaaaaggctgtgattttcatcatgcagtgtactggtctgctttaaaccaacaacatgtgtatatgtaaaaaatcagttactattggaacttcgtcgatattagagtcatgtagcgaatctacttactattaaagtaaccgctgagataggactcttaacacaacgaattagataggtcctcccagtacgtagtacataacaaatccaaacaagaagttgtctagattcattgtattagaaatcttatctcaagctcggttgctttattttggatgataagggtaataactttcatatggacagtgacagttcacgcatgggatgcttaacaagttgaacctactgttgtactctaaagcctaaaaggcagtagctttttctaaaattgttgtacggagggggacttctgcactacaatagaaagttgtatagctaaaaaaggcaaaacacaatcgagttcactgatgcac

SEQ ID NO: 15274 - DNA, 299 bp, Oryza sativa
ttcgagctcggtaccctaccaccgcacaccgctggagggaggggaaccttccagaagctccagattccaaaccagcaggagtcgcctcgcctcctccttcatcctcctcgtcgtggccgcgggggtcgcctgaggtaggaataccaacaaccccccccccccccccacacccaagcaagcttttagggttttcgaccgcccctcgcttcctccggtttcgcgggaggcggtgggtctccctccctccctgcgtgtggatctcacatgggatccgcgttaccttgttggacttgctgctt

SEQ ID NO: 15275 - DNA, 716 bp, Oryza sativa
  unsure (1)..(716): unsure at all n locations
tgcatgtcaactggtaattattattgttattacatatatattggcttctcgcctgcctagatgtaccatcaggattgatacaggctatcatcatctgttgaattgattacttatgatgcacttgtttcataatgtagggccacactacaatcctgccggaaaggagcatggagcaccagaagatgagacccgccatgctggtgatcttggaaatgtcaccgctggagaagatggtttgttctttttccctttattccgaatttttatttgttccatacctgttaatgatttaacataaccatattagttgtggtcttgtagtccttaactcattgtcaatttgtagtaatactttattccgaatttttatttgttccatacctgttaatgatttaacataaccatattagttgtggtcttgtagtccttaactcattgtcaatttgtagtaataattgttgctgagagtttatttctctgctgtcaggtgttgctaatatccatgttgttgacagtcaggtaagtaaacattcagaaaaagaacattctccgtcatttgatttatggaaccaataccacacatccccttattattctgctgttaccttgtcttttccttctttctttttcctgtgtgttaacatggataaccatttatctgtgtcagattnnnnnnnnnnnnnnnnnnnnnnnnnnnnnnnnnnnnnnnnnnnnnn

SEQ ID NO: 15276 - DNA, 274 bp, Oryza sativa
ctgacgctgctgctggtgccggtgatggcggcgacggcgctggagctggcgcggatggggcccggtgagctgctgtcgctgtggcggtcgctgcagctcgacctcgtccacatcctctgctcgggttcctcgtcgtgttcgtcggcacggtgtacttcatgtcgcggccaaggccggtgtacctcgtcgactactcctgctacaagccgccgcccagctgccgggtgccgttcgccacgttcatggagcacacgcgcctcatcaccgacgacga

SEQ ID NO: 15277 - DNA, 1002 bp, Oryza sativa
  unsure (1)..(1002): unsure at all n locations
nnnnnnnnnnnnnnnnnnnnnnnnnnnnnnnnnnnnacgcgggcgcgctccgcgccgacctgtcgccgcacggccccatccacgccgcggtgtgctgcctcgccagccgcggcggcggcgtgcgggactcgtggcgcgtggactaccgcgccacgctgcacaccctccaggcggcgcgcggcctcggcgccgcgcacttcgtcctcctctccgccgtctgcgtccagaagccgctcctcgagttccagcgcgccaagctcaggttcgagggcgagctcgccgccgaggcgtcgcgcgacccgtccttcacctacagcatcgtccgccccaccgccttcttcaagagcctgggcggccaggtcgagaccgtcaagaacggccagccctacgtcatgttcggcgacgggaagctctgcgcctgcaagcccatcagcgaggaggacctcgccgcgttcatcgccgactgcatctccgacgaggcaaggccaacaagatcctccccatcggcgggccggggaaagcgctgacgccgctggagcaaggggagatgctgttccggctgctggggcgcgagcccaggttcatcaaggtgccgatccaggtcatggacgccgccatctgggtgctcgacgcgctggccaaggtgttccccggggtggaggacgcggcggagttcggcaagatcggaaggtactacgcgtcggagagcatgctggtgctcgacccggacaccggcgagtacagcgacgagatgacgcccagctacggcagcgacacgctcgagcagttcttcgagagggtgatcagggaaggcatggcagggcaggagctcggcgagcagaccatcttctaggcctcgctcgccttcttggctgccattgccagtttcttggtgcttgtaagttgtaaattactacttcatccagagtgtttgtagagatgtgagttgttcttaatgtttcagacgccattagccattcaattgtaccatacaatgcattg

SEQ ID NO: 15278 - DNA, 548 bp, Oryza sativa
  unsure (1)..(548): unsure at all n locations
tcgcgcaatttcgtcgaacaggtggggggcaattcgccccgccaaacgggggtcaggtcaggtcagccagcgtcggcgtgagcgcacggaaggcttggacgaagcgcgttacctgggcacatgtcggggcagctgcccacgatcggcggggcgtcgccgccggtaccagccgcggtggcgctggccgccgccgggaaggaacaggtgnagtagaaagcagnaggtggcggtaaggggccggcaccgcggctgagaccaaggccgcggccttctccccgacctcgccagcctcggccccatccgtggccacgagtggaactccggccgcggtggctcgccatgtcccggcgatccatggcggcctttggcctcgagctccgaggggtagtctggtaatttggtggttagttgaaccgtggagtggaacaatggagcttcaaacgaacatgcttttttagtggagagagagagggggggaggccaagatttttttttaaccttttaaaattttaattttaaagtaatgtcctgttttccaattttttttt

SEQ ID NO: 15279 - DNA, 526 bp, Oryza sativa
  unsure (1)..(526): unsure at all n locations
nnnnnnnnnnnnnnnnnnnnnnnnnnnnnnnnnataataatttttgtattgtcttatagactatatacttgtctctaacatcgagcatcctctcatcgacgtgctcgcgctgctagtgcttcctaccaacgacatcttgtcacgacgagaagccaagctggctagattggctacactttcaaagcttttaaattttttgatgtttctacggtcatcgaaacttgatatttgtggcagagaatgccatcttcttaccccgatgaaatcccacgtattgttgctcgctagctaagaatgtctagcgaacttagccaatttatagtgacaaaataatggccaagtagattttgcccccgagaagatatcctctcgttttgtacatagcgtttaaaatttttgaaaaaaaaatcaaaatagatcaatatataatatatctttccacaaacattcaagttaaaatttgaattatannnnnnnnnnnnnnnnnnnnnnnnnnnnnnnnnnnnnnnnnnnnnnnnnnnnnnnn

SEQ ID NO: 15280 - DNA, 340 bp, Oryza sativa
cctttaagtttgaaatcctattttgcaacttggacaaatttatctcatgtacatgttgcactcatattccaaaaagatcttcaaattttaatttgcaggcctcctggccattttgctacttagaatcattaatgattgttgtagactattcttggccttgggtatttcttattttcagaagtcaattacatgagcttgtatgctgttatttatcaagaataccactatcaatgtcctgtactcttagtaaaatgttgagttttataggtgcatttgaggataagcatgctacagcgaagttgctgaaagaggaagaggaagatggcttacgagacctagt

SEQ ID NO: 15281 - DNA, 692 bp, Oryza sativa
  unsure (1)..(692): unsure at all n locations
tttgttatgtactacgtactggaaggacctatctaattcgttgtgttaagagtcctatctcagcggttactttaatagtaagtagattcgctacatgactctaatatcgacgaagttccaatagtaactgattttttacatatacacatgttgttggtttaaagcagaccagtacactgcatgatgaaaatcacagcctttttttgtctgacgcaagacgcaactacgcaactgcatgatgaaaatcacagcctttacttgtgaactgctttgcctgacagccgtatattgtggcactagacttaacagcttggtcttgcaagggaacagatgtaacaagtttctcagcgacaaatacctcgaaatgcacaagtccaagttactgacatgtgacaaatacctcagaaacattttcttgcacaagtcctcgtagtaggctgtgtttaaatctaaagtttggatccaaacttcagtccttttccatcacatcaacctgttatacacacacaacttttcaattacatcatctctaatttctactaaaatctaaactttgcgttgaactaaacacaaccctacttctattgtaggtaacatgttcgtggtcttgcttttctcgaacaccggcaacaggagcgtggcaggttagatttnnnnnnnnnnnnnnnnnnnnnnnnnnnnnnnnnnnnnnn

SEQ ID NO: 15282 - DNA, 731 bp, Oryza sativa
gaacgctaatctggagcagtataattgaaagtataggaccaacgagatcttgctgcacctcgaactctagagtcgtttcttgtttcaacatagttcatgggtaactatttcaccaaagctagctcacagatactaactaaacatttcgtcaaaactactgaactaaactatttactagtaagttaaactgctcttccaatttaagaagacatgatgtattggtaacaaacaccaaactatcatcttcacttcttcatttgaaattgtaaaggatgtttttcaacaatttggtgcaaggaataaaacatggcaatgcttatgacttgttataattttattacgttttaaccctactttgtgataaccctaggttttaaccagcagtacagtaaaatgtctaatctcaaaccggacaaactgctcgatctgataatcagcaaatgagattagtataatatcactctatgaaatgggatatccctcgccggccatcaccttaagttcgaaggatttgaggtccctggcgagctgctccgcattgatcccctcgcgcgccaacaacctgcagaaagcaaagcccaaaacccttagtgccccgtaaacccccaacaaccgcctacccccgacgaacccgacgcggagaaccgcgctgcgagcctcgccagaggcaaaatcgaaggggggctccggggagaagacacagacctggtggcggagagcgactgcacggg

SEQ ID NO: 15283 - DNA, 1244 bp, Oryza sativa
  unsure (1)..(1244): unsure at all n locations
nnnnnnnnnnnnnnnnnnnnnnnnnnnnnnnnnnnnnnnnnnnnnnnnnnnnnnnnnnnnnnnnnnnnnnntgattttcatcatgcagtgtactggtctgctttaaaccaacaacatgtgtatatgtaaaaaatcagttactattggaacttcgtcgatattagagtcatgtagcgaatctacttactattaaagtaaccgctgagataggactcttaacacaacgaattagataggtcctcccagtacgtagtacataacaaatccaaacaagaagttgtctagattcattgtattagaaatcttatctcaagctcggttgctttattttggatgataagggtaataactttcatatggacagtgacagttcacgcatgggatgcttaacaagttgaacctactgttgtactctaaagcctaaaaggcagtagctttttctaaaattgttgtacggagggggacttctgcactacaatagaaagttgttatagctaaaaaaggcaaaacacaatcgagttcactgatgcacgttaatgataaagatttagttagtggtgtactgatctaatgcacatcaatgataagatttagttagtggtgtactgtatttcccgggtttggtttggttacataacatgtgcttaagttgctgtcctgcaagcttctttttgaaacataaggcggaacttcgttccacttttatatttagaagaagagaattgacccagtttataaggataaccggacccgaaaaccatacatccgcatggttaattacaggaaaaccggctaaaacccaccgctacactactaaccatgatggcggagcccaaatgcaggacgtcgtcgccaagctaaacacaaaagccacccaacagctcccacaccgcagaagaggtgttatcgttgccgagctagccgcccaagcgacccagcagcgccgacttcacaaccacagcgacactaaagccatgaaagtcgccaaagcaaaaagcagctccgacatccaacaatggacatcagccaagccaccgaggagccacttcctttacacggccagcaccacaactcctaggaagagactgcaacatgtcatcgttgccaggcgtcaccgcaccccatcagcgagtagctccgacttcatctgcagaaacaaccaaagagcgtgacacccaccacgagaaacaaagcggacccaagaaggcgaaggcctcgccgaacacaatgtatgagagcttttg

SEQ ID NO: 15284 - DNA, 22866 bp, Oryza sativa
  unsure (1)..(22866): unsure at all n locations
ggcgcgctcgtctggtcgccgcccgtgccgccctggggctgagcggcacgagggccttctcttaattagattatttcacggaaatttttctcctgcaagcttcgactccttcgaaatacagcaataggaaatacagaaataaagtatcgtattggtcgaagcctataggaaaatttggtaaaagacatgtttagctactgcatatgagaatcataggaattttgattcagacgattaaaatagacaaaatatatcagagcaattccaataacatagctttgctattagctccaataatatccacatcaagcatttaagttaactagtaagagtagtatatatacaatagatagctactccatccgtcccaaaatataagcattttaagagttggatacggttattaagaaagtagttagaagtaaatggtggagggttgtgattgattgagtagtggaggtaggtggagagttgtgattggttgggaaaaaaatgttggtggagaagtagttatattttaggacaaatcttgtattagatcatctacacacgtatccgtatgcattcattttttttatttttcttttagtctgttttttttcgggtcatgcttatcctgtccactcgttcttttcgagaaggaagcagtagcccaatgaaaaccatgctgctactagtctttgatcaaatgtctgaaatacttcaaaaagtggatgaatgggagaaattttgaaacatattcttgtagtccaacgagcttcacagaactatattattttataggatttcaatcctttaaaattcctataaaattccatggtcataagagcatccctagcagctcatctatattctatcctccatatgcctatttgaatggtcctacaaaaaaaaattctcacttcatatttatttttactccaacagatcattcatattacatcatctatcctatattttactattatctttcaactgccatctattttatattaactcttctcttctctcttctactcatttctcaactcttctcctctctcgccgaatccccttcacctccaccacccaccgccgccgccatggcctccgacctgcttgcgccggagcaccaggtggcggggcactgcgcgtccaccgacaagctggcaggcgggcaaggggcggcggcaaacgaccggaggcgggcggaggagccgcggaggaggcaggcggcggcgagcgggcggcggtgtcaggcgagcggcggggacggcggcacgggcggctagatccaggtctcctcccctccgctcccctcccctccgttggccgacggcggtcgaacgatcccctccgctcccctcccctccgttggccgacggcggtcaaacggcgaaggtagccaccggtacgtcctctcttctctcttccttcacccttcatgctcgatccaaatgggggcaggagaaccggatgagagcgggcgtttggggatggcgtgaggagaagcgccaaatttggcacttctctctccgtgtttggcgatccgccaattttggcgcatctgatggagcctctgctagagcgatgtttttcccctccatgcaccaaaaacgggatggtggctctaaggaactcaaaagttgagccacctatagcgcatcatgcatactagacggtactgccttggccagcaatctacagtcttaacagatatacaggaaataccaaagaccacttcaaattcagaagaaagaacatgaacttcactgtagggaagtaagaacctgaaagaccttaacagccattgcaatattgcacgaacaagaccctcccggccaaaaggaccaaaaatttcagttcacatagaacgagcaagcacgacatgtttccctattccaaaatttagtactactaggtgcttcaatacagttccactagtaaacaagtctcaagtctcaacagtggtgcctatactatggctaacaggcatggaacagacccggcatgttccattttacagaacagcgagttttcaacccaatgctacccaagattgtctttctccagtgtatccctcattcatcaccatgctttttcttctttttctttttgtctttcttaccagacgcttcggtttccatggcaacatccttagcatcttgtgaatcagatttcttctttttcttcttctccttcttctcaccttcagcggtggctacaggtggctcctcgctctccttggacttctttttctttttcttgccgccatcagcatcggccacaggagaatcctcgctatctttggacttttttttcttctttttcttctgaccctcttggtcaccatcctcttgaatggtttcctctgcacctgcaggctccgcctcttgatgtttcctcttctttgaagcaccttcaggcttctttggtgtttcttcagtggattgtccaagtaccagatcagccgcaggattgtatgtctgacaaattcaggtgccataatcaggttgagatgaattctgaattagatgtttgcccaagtaaaagtaagcaaaatacacaagacagcttttacagtgactggacaaaacgttaggtgcaacgcagtctcgaaaattagtaagtttcttgaagagtggccaagattaacagaaaacattaagcttcctcaatatattttcaagacaaaaatcaagatactacctaccttggcaggagtgattaaagccccagcacccttcttccggtccttttcatacacttctatcttgggctttcccttagtagaacctgcagacctgccaagttctttaccctcaagaacccgaagccgtgtctcaagctgcccaaatggatctcatgtcaatccaaggagtcagacaatattatggataaagaaaaggtatttcagaaagtacataccttgactcgactctcaagaccaatggagttatcttcaccatcaccaagggcatcataccgaatggcaagagcagtttttgcagcaagagaacgagaaatcttccccttgtgctttggagctgcttgaccaattaaggatgcatggtagatgagaccatactttggcgtagcatgctttgtctttagagctctgaacaaagcctggagggaaagattgtgttacttattatttttgtgggaaacaaattataatacaccgcaaaaagctactccctccgtcccataatatagcaacctagtacaggatgggggcatatcctagcattagggaccaagtacaggatgtgtgaaacatattatctcccagacatagactgaaatataagatcaaacaaagtaaaatcacaaacaccacacatgaagcatcctttccccatgttactagaaaacaaacccatacttccatttacctattttgcatcaagtaatctgagtggaaaatggttaaatctttcaagaataacaaatagcaactgaccttctctgcaccaagtatctgaattgtgctgccaggctgcttggccagatttaccaaactgccgccatgtgcaataagtcgagcaccaaccaattcgccaacaagtgcagtcaaatttggtgcgatagtgttcatcctgcttctcagataatcaaacagctgggctctgtactcagaaagagccaacacctgatcacacagctccctgatatttagcaagtcaagttcactaacttctgttcccatggatattactgccgcctcttttagctgtgcttcaacctcatcatctgaaagtatctgaaaatagcatttgcttcttaataaagaaccagttgtggtggatactcacggccattacattctgatcacaaatgtgcagaatttacctcagagaaatcaaggctttctgcgttagtccgatcacccatcatcttcacaacttttgcgtactgtatgttatcagctacaattttagtgagctctggaaagtgccacccataccattcacgaaccctcatggcataagtgttaagctccttgtcaagatcatccaataagccaatggcttgaatgatcatagtatcaacctgtataatcagaaacaatatagtgtttacctcagttaccgtcccatgaaggggttatgtacaaattaaaaatagtaagacctcttgtatatccatttgatgctgaactaaataattgcaggtgcgagttattcgttataaagttaacagaaacataagagtaacaaattgagcatgaaaactaacaaaaggaaaatgattgaatcatatgactcagagccagggagaagtactgaataacatgttcaataaaagcgaacggtaggataaataaaagctcaccttttcaggactgaacttcagcttatatctagacaaactgtgggacaagccaaggctcattggaccaaggtcttgtgcacccaaaccagagataagttcagtgagctggtttcttaaccctctcatgagctccatcacagcactattatgaaggcagtcaattttctgcaaaagcacgtcaaattataagcatgattggttgttctacataaacaaaacaaccaggagcctaactaaccagcttctcctttatagcatttccaagtttagagtcagccacagctaatgtttcaccctcacagtgcttctgcaagaacttgcgcaaacccttggtaggcttgctgtcaataatgagggttgcagcagaaagggcatcagatgtgttctcaaacttgttgaaagccttcagctcaaccacctaaatatagttgatttgttttgtcaggaaagaaaatcaactgaaaagaacaaaataaatagcagtaataggaacaaatggatagactcattgcaattcggcgtaaagtaacatgacttctgtacatgacaatgttctccacataatgtcataaactcaatgtgcacaaatttatttgtcgaatcaatctatagacatcggacggacagaatatgtgcacaataggaggcaaactaaaccattacatctctctcccctgataaccataacacattggaaaggaaattacagttcagaacatggtaggattagtcagtttttttttgtttctcgaaaaccactttgcatctatcaaaatcatatccccaattagcaaggcaaaatcagctaagctaaaacatatgtagtactcaccaacctacagaagccattggtccttgtgctaatttaactgactccatcgacatgtgtcaaatcatgcattaacgctcttaataaacaaaaaaaaagagaaaattttgtgctgtaaggaagaaaagcacaaacctttctcgccgagtcagacgtcgtgaactccttccataaatcctaaaaaaaacaacacaaaatgcgttagcacgattagtccacttaacactccatagaaagtcaaaccaacagctgaagcggcggcggcggcggaagactcacctcgaccttgtcgagcttcccctcgtcgagcaccttgaagagggcgaaccccgcgggcgtctcgaacagcaccagcatctctctcaccgcccgtgtcccgcaactactagataaccccccccccccccaccaaatcaaaaccccaacctcaaacctccacgctcaaaccgagcagcagcagcagcaaaaaaaaaaaaaaaaaaaaaggatggcgcgcgcaaaccttgggtcgattcgattcgacgacgggagaggaaagcgcgaagcgtacgttcccggctgcggtgagacggggatggaggggagatggcaccgccgccgccgccgccgcggcgagggtttagcgcgaggagttcggctgcggcgaggcgggggagaggggagagggagagagccggcgccgcaagggttttagggcttaggctttggggaaatttatagtggagagtagttgagaactgggggcccatctcgccgttggtttggtggggcggagatcgtcagccgttggatggcttattaggtcggggactcagggttgcaatccgtttgattattatggagacagctgtattgcaaaaatggggaacatgtgacgggtgggcaaaagtgaccacaaacagaaaaccagtggaaatgatcgatgccgaaattttcggtgagaaattcgaccaggtttttccactaactgaaactattaaggttaattcggtcatcgctctcagttaattgaatgaccgaatttaaccgaaattagaggggaaagcctaaatagtaagagtatcttagtcttgatggcttggtcataagttgaaagttaaaattgctagattaagaacaacgttttgtgttgcccggtgaaacctttgccgacaacttccttagcctacccctttccatacacaaaccaacgaaggcaaagattcagctaatgatgaacaaactccaagcacttacggggtggaaacccaagatgttatttcgagatgctcgcattgcgttgatcaatcactttcttatggcgctttccctctacttcatgtcagtccttgagcttctagcctggcaattaaggagattgagaagaagtacaaaaggttcatttggaagggtgatgcataagctttcgatgaaacttgcctggtggcacaagagaagttatacttgtcgatagagtgtgatggtcagagcgtctagaatctattgacgcatgggagtcgtgtggcacgctaggtggtgttggatgcgtcaaacattgtccaatcgcccatgggttgcactagcgtcaccgccaaaggttactcaccttctcgcggcggggtcaaatttgatcctcaggaaacgaagacttgcatccggttggaaggatcgttggttgcccaagggcagctcaatcgagagttggacacctattctcacctcctttgtcaagaaacaggaggccgcacagtggcattcgtgctctaggaccatgcatggtttgctgatatcaaaagcgagttgtcctttcaggtactcgtggagtgcttcaaggtttcgatatgaacgcggaggtggtgttggagcccagcactcttgattcccttcctatgggcagtaacgataaatggcgaattctcgggcaaatcgggctatccgatgctttattgtgggcgaactatgtgtgcactgggcaagatcatctggaactggaaggcctgagcccgaagcgatgcaaagttttcatgttcctcactatgcgtggagcttgcctcaccaccgacaatttgcagtgacacgggtggcatgtcacttggcaaactgctactttctctatggcagagagttagaatcatgtgcacacatcttccacaattgtgagtttacagcgcatgtgtgggagcgggtgtgaagccgtcttggctttccttgcccgccgccttctcctaacctatccgattggtcgattgaggcatggaagaagattggcaaaacaagaccgaataatccttcaatacggatgtaaattcagtaacttggctcatttggaaggagcgaaatgcgcatgtctgtgaacggaagaccacttcggctagggccctatgcacggcgattgcggacgagtgaaagacatgggaggtggttggcctgctgaagctggcggacaccagaaggcgctaaggtaagtctatacttaggtagtggaagcatgtgtttcaacgtgagttgagctacctaggagttcaccgttgctgaccgcagttagcctggtgtaagcattgtaaatgttttttctctcccccttcttaataaacttcggctggtttttgccttcctgataaaaataaactactacgatccatcttggtaaattagtgtgttatatattgtttcctattatgttatttgtttgccaaacaatcataaaagaggaaggtgctgccaaattttgttatggtttatttgatttttcaattatcacaaatctcagttatgaccgaaaacgaacggcttggtcttgagttttgcttaacgtatctggccaaagaagcagcagcagccctgatttcgataaacttgtctatttaaccaacgtgtgtatgtcaccagaagaaaatcagttaggttttacgtacttatcaaatctaataacttccgtacgggcatcgacagttcatgcatgagacgcatcttgaagtattggaccagcagcagcgtagtatatgtaggccgagtttagttccaaaatttatcttcaaactttcaatttttccatcacattaaaactttcctacacacaaactttcaacttttctatcacatcgttccaatttcaaccaaactttcaattttagcgtgaactaaacacacccgtagtcgtagtaagaaaatattaacttccgtacggacattgacagttcatgcatgggatgcctaacatcttggagtattggaccatcagcagtgtaatatacgtagtcgtagtaagaaaatatttagttactggtgtaatgatgtagtccacataaaatgatgctccctccgccctctaatataagggattttgacaattcatgcatgggatacttaacatcctggagtattggaccaacaacagcctagaatacgtagtagtagtaagaaaatatttagttagtggtgtaatgatgccgtccacataaatgatacttcctccgtcctctaatataagagattttgatattttgcttgtatgtttgaccattcaatttattcaaaaattttgaaattattatttattttttttgacttactttattatccaaaatactttaagcacaacttttcgttttttatatttacacatatttttaaataaaacgactggtcaaacagtacaagcaaaatatcaaaatccgggacgaagggagtaacatttagttagtggtgcgctggtgcaattccccgtgtttgatttggttgtccagaattgtttttttttttttggggacggagggagtacatacaacatgcgtagcgttgctgacttgctgcaggtacagagataatcagacaagcagccaaggctttcaatctggttggcaaagttgatccaaaagttccgagtcacccatagcatcatgcatgcgtagtgctgccttggcgaccagcaacattgtcaccacagcacatactaacaaaaaagacaacttcagaatcagacgaaagagcacgaactactgttgggaagtaagaacctgaaagacatcaacagcaactgcgagaacgagatctggccagccaaaaggacaagaaactttagttcacatagaatgagcaaaagcatcatatgctctccaattccaaaattcagtaggcaattgaatacaagatccatgagtaacaagtccaaacttgatgcctatcctacaactaaccggcatggaaaaactcggaatgttgcattttacagagcagcgattcttcaaccctatgctactcaagataacatgtccttctccagtgtatccttcattcatcgctatggtgtttcttctttttcttcttctctttcttgccagactcctcggtttccatggcaacatcctcggcatcttgtgaatcagatttcttctttttcttcttctccttcttctcaccttctgtagtggccactggaggttcctcgctctccttggacgtctttttctttttcttgccaccgtcagcatcggccgcaggagattcctcgctctctttggacttctttttcttctttttcttttcaccttcttggtcaccatcctctttagtggtcttctctgctggtgcaggctccgtctcttgatgtttcctcttcttcgaagcaccttcaggcttctttggagtttcttcagtggattgtccaagtaccagatcagccgcaggattgtatgtctgggatcaagtgcaaagcatcaggttgagatgacttctgaataacagatgcttacacaagtaaaaagagtgccttggtaccaataacagatgtttgctaagtataaaatgttagtaatatacacaagacatctttacagtgaccggtcaaaatgttaggtatctaacaaagaacaactgccttgacaactagtatttttcttcaagtactggttaagaataacacaagacgttaagcttcctgaaaatactttcaagagagaattcgtgataccacctaccttagcaggagtgattaaagccccagcacccttcttccggtccttttcatacacttctatcttgggctttcctttagtggaacctgcagacctgccaagttctttaccctcgagaacacgaagccgcgtctcaagctgtccaaatggatcacatgtcaatctcaatgggtcagaaaatattatggacaaaggaaatgtatttccacaaagtaaataccttgactcgactctctagaccaatggagttgtcttcaccatcaccaagggcatcataccgaatggcaagagcagtttttgctgcaagagaacgagaaatctttcccttgtgctttggagctgcttgaccaattagggatgcatggtaaatgagaccatacttcggcgtagcatgttttgtcttgagagctctgaacaaagcctgaaaaaagaaaaacagatgtcagcacaacacagaaaaattgagttgtttgaatcaaacttacctcccagacttagacagaaatataaggagatgaaaaaaaggaaagttacacaaaacaacaatcaagcatcccttccccatgtgcctagagaacccatcatccaagggacaattttgcataaactacaaagagtggaaaataattaaagagttcaaggttcacaaatagcaactgaccttctctgcaccaagtatctgaattgtgctgcccggctgcttggccagatttaccaaactgccaccgtgtgcaataagtcgagcaccaaccaattcgcccacaagtgcagtcaaatttggtgcgatagtgttcatcctgcttctcagataatcaaacagctgggctctgtactcagaaagagccaacacctgatcacacagctccctgatatttagcaaatcaagttcactaacttctgttcccatggatattactgccgcctcttttaactgtgcttcaacctcatcatctgagagtatctggaaaaaagcatttgcttcatattcaagaaccagttgtggtgtatagtcatggccgttaaattcagatcaggtatgtccagaatttacctcagagaaatcaaggctttctgcgttagtccgatcacccatcatcttcacaacttttgcgtactgtatgttatcagctacaattttagtgagctctgggaagtgccacccataccattcacgaaccctcatggcgtaagtgttgagctccttatcaagatcatccaataatccaatggcctgaatgatcatagtatcaacctgtataaccagaaacaatttacctcagttagcttgtcaggatggggtcatgtacaaataaaaacagtaacgttaacctcagtccatcacaatgctgaagtgctagactaattaattgcaaatggaagttaaatgtaaagttaacagaagcatggcattgaaaaatctagtttggaaactaacaaaagataatgatgttgattcatatgactcagagccaggaagaagcactggatagcgtgatcaataaatatgaatagtggaataaataaaagactaaccttttcaggactgaacttcagcttatatctagacaggctgtgggacaatccaaggctcattggaccaaggtcttgtgcacccaaaccagatataagttcagtgagctggttccttaaccctctcatgagctccatcacagcactgttatgaaggcaatcaattttctgcaaaagcacgtcaaattataagcatgattgtttgttcaacataaacaaagcaaccaaggaacctactaaccagcttctcctttatagcatttccaagtttagagtcagctacagctaacgtttcaccctcacagtgcttctgcaagaatttgcgcaaacccttggtaggcttgctgtcaataatgagggttgcagctgaaagggcatcggaggtgttctcaaacttgttgaaagccttcagctcgaccacctgaatatagttaatttgtttggtcaggaaagaaaatcaactcaaaataataaaataaacagtagtaagaggaagatatggagatgctcatcacaattcaaagtagaaaagtaacacagcttatgtatataatactgttctccacaccatgtcattccaatgtgcatcagggcatttatattataggagactgaactaaccattaccctcttctctcaccatacaaattacacatccaaaacaaaactgcggttcagagcatcagagaattattactcagttgtatttttttattcctgaaaatcactttgcttctctcaaagtcacaaaaccccaaaaagaaagaaggttgtaatcacctatgttgaatcaacctactgaagccatgggtcctggcttatttaactccataaatatgagatatcttgtgcaataacgagattattaaataaaaaaagaagaagaatattttgtcctgggagtaacgtgaaaagaaaaaacacaaacctttctcgccgagtcagacgtcgtgaactccttccataaatcctaaaaaaggatgaacacaaacgcgtagcgcaattagtccaccgaacactccacagcagcaaagcaaacgaagagctgaaaccgcggaggcggaggcggtggcggaagactcacctcgaccttgtcgagcttcccttcgtcgagcaccttgaagagggcgaaccccgcgggcgtctcgaacagcaccagcatctctctcaccgcacgagaacacctacacctggatcacaaacccaaatcaaaaaaaaaaaccacaagatcgaaagcttgggtcaaaccgagcagctaggatatatacaccctcaagaaaagaaaatggcgcaaaccttggctcgattggacgcgaatcgacgatggggggaggagagcgcgaggcgaaggtccggctgcggcgagatggtggggagggggagtaggcgccgccgccgccgccgccgccgcgagggtttagagcgaggtgttgtgggatgcggcgggagaggggtgccggcggcgagagggttttagggcttgggcttggggggagtttttatacgagggagcgggcgagacttggtggcccatctcaccgttggttcggcctggtggagatcgtgggccgttggatggattttttttcattttaggtcgtgggagtgggactctggtttgcggggcccgcatgggcttcttcctcgcaggagggaactttagaattagaatggagctgagaggcgacaccggctacgaccaccgccgggcgcgcgagtctctccagttatggatgcaagtccgcgaacccgtttatatgttaaaatagtgggcaactcacgcgggtaacctattaatttgacctaaatatgtttatgggacgacccacttatatctttcgatacggtaagatacggtaagctagaccataataaggaagccaagatttaatatataagtagattcacatgtcgacccgcttgcttacctatctccagctgctcatctaccctggtggctctaccaccactactacagacgtcggtgaacctctgccaccgcgagactccaacgagcattctttctgctatatcatccctgcgagtttgacctggtgagttttttcaattcaatatcctcaactcttttcggtgctcagaccctccatctcctttcttccttgactccgtgaacatatccctgtctacccttcgaattcctcttgcactcactctaatctgcctctttcacttcacattacaaatctcctaaacttctggttatgttcgtaactagagtacttttatgttctatctgtgggttttgagttctctttcgtaaccgttcttatattttttatcaaaaagtctatacaaaccattacgaaaagtaaaaaacaggtcgaaacctgtatgaccaacccactattaaacaggccaccaatcatccgtgacccattaaagctcaaatatcatctcatctgtttaaattaagagagtaattatatttataacgtcataatatttaaaaaaacagtcgatatgtatttatattgtaagttcgtaaattatatatataattttagtgcatttatgatgtaagtctgaaaaattacatatataattatagtataagcacgatgtaattagcacgcgtgggatcgtaaacaaaatagcattgaaaaacacggctcaaatcaataatgatggagtcggcaacggctgatttgggctcaggtggagttgagatccagaaatctcatcattgctcgcagatcgaatcggcaacgacaactccggtgaaatggtgaatcataaacaaaagtaggtcggaaaacactgctcaattcgaaggaaatgcaaagaaaatagcccagtaatctcaccaaatcatgctccaagttttgccgcctccaatcaaaagaagcctgtcgaagattaggcaaagcgaactcaaatctatgcagaaatcggggaaaatcaaatcgtctctccaagcggaacgcaagctgtcgacaaataaatattcaaccggagaacagcagggaacagtaacgtggacctagttaattagcaagtacaatctaaaccgagagcgctctcgatttagtattaaagagcgacgcatccgtgagagaaggtttacttgcaactggtacacttacgtgagagatggtctagttgtttactattgtacaaagtgtatctctttttttcttcttatagatttttctcttaaaatatttattcgatctacaatatgactacaccattgtgttagttggtacacttacgtgagagacgtacgtgagagatggtctagttgtttactattgcacaaagtgtatctcttttttttcttcttatggatttttctcttaaaatatttattcgatctacaatatgactataccattgtgttcgttgtaattaaatatttataacaatatcttacatgattatattataataaaaaatatttatattgtaaattacttttatcatatatatgtaagttacttttaccatacgtataaattacttttaaatttgattaagttactttttagacattcactgaacaatatactttactttatcgttagttctataatatgttgattagatttaatttctagataaacttaggtttttacctccataatagatttacttttgatatcgtgacaagttactttttttacttttttaagttacttctataatatatgtaaattacttttaccatttattgaatttacttttatatatctaagaagtaatttaatgaaatctaaaagtaatttagatatattataaaagtaaattgtatttttcataaaaaaaatattatcatgtgagattttgttgtaaaaatttaattgttacgaatacaacggtgtaatcggatcatagatcggatgagtgatttaaaagaaaattctataagaagaaaaaaaacatgcactattgagtgtactagtagcaacaagagaagtcgttggttaagacagtctagcttacatctctctccatcccataatataagggattttgagtttttgcttgcactgcttgaccattcatcttattaaaaaaaaaattagaattattgttttattttctttgtgatttactttattattcaaagtactttaagcacaacttttcgttttttatatttacacaaatttttttaataagacaagtagtcaaatattgcaagcaaaaactcataatcccttatcctatagaaaggagggatgctagcatggatctcaaaaaccatctaacggctaaaaaacgaatgatggaaggcttataaatctgtcaaatgatagttagcaattccgcttaataccactaccgttcgtatactgaatttgactttgttgaacggtacattatgtgtgttgtacgaatttgatcaaaatagtgtgccgtgcatacgtttttttttctttttttctaaaacaaagtagcaggaaaactcaaagcactgccaagcgattctacacgtctgattctgcatgtccttcgattatctcaatgcgttcatctcgtgtcgttcgactgatgatctccatgtttatctcttgggcccttggggcaatacgttttatatatgggcttacgtatccttaagcaaaactaaaaacaaaaccttatttttttaaaaaaaaacaaaaacaaaaaccctaggtagcagccagcacacgctctccaaacatggcgccgccgccgccgccgtgcgagagacggccagtaagcctgagcgatgacatggtcgccgagatcctcctcctcgttcccgccaactccgtcggccgcctcgccgccgtgtgcaagcagtggcgccgcgtcgccgccgacccgaccttcctcgcggcccgcgagcgccgcgcgccgccgctccagctcctccgcgtctccaggcggccgccgactcgaacggcaggcagtacgacgatgccgagctgagcgtggtcgcccccgccccgctgatctccggcggcgcccagggcgaggaggcgcgccgccccctccccgctacacggcgtcgttccccggcggctacacccactgcaccctcctcgcgtcctgcgacggcctgctcctcttcgccgaccaccggcggcgcctccgcgtcatctgcgacccgacaacgcggcggtggtcgggcctcccgccgcacctgtcgtccgccgcgctgggcttttacctccaccggccgtccggcgagtaccgcgtgctgtccaagggccccgatccgtcgcgcaagcacagctcgtcgtacttcgtcatctcggccggcggcggcggcgaaccccggcggcgcgaccgccgaccagctcgtggagagacacccgtgctctcacctgggccacgtcgccgccggggggaagctctactggatgggcgacctcgtagaggccggcagacacccgcacctaaacccctacgcccccgcgaagctcgtggcgttcgacacggtgtccgaggcgttccggctggtggcgccgtcgccggagacggcggcgaacaacggcgacgacgacgacgtgctgatgttcgagctggacggggcactcgcggtgctgaaaggcggagcgatgtcgacgctcaagctgtgggtgctcgacgatgacgtcggcggcggcggcggcggcgacgccggcgagcagtgggcacctgtctgggaatgcaaatatagctgcatgttaccagtctctacgccggcgagcgtggccgtgtgggatgacgacggcggcggcggcggcgacgccggcggcgccacgttcacccggcgtcgcatcacgctgtacggcgtggatgagacggcggcgagggggagggcgctccacgtgttcgcgtgcggcgcgcgcaacggcgggttattgcaggtggcgttcagggagaacacggtggcgcacgccttcttcaagatgcatccgtcgccagccgtgcgcacgtttgggtttctctgatctcgagaggcggctgcgatgatcgtcgacggtgcacgagtggaattggtgtgtaatttattgcacatggaaaattgctggactcatttatattttttagactagatgtatgcatgcagttttaattttgtatgttttttaacatgcacaagtactatttgttggaaatagtgcatacttagccattaatttagcatatacagcaagcataacctacttgcgacatgataggacaagaaaaactcataaattctatcatgctagatatcaaacaagacataaataaccaagccaagtaagttattaggctaatcacaatggtaatctagccgcaatattttaatctagatgaacagtaccatgcatatacaaaactcaggtacgaacaaaactagattagaaatgcaccggttcctttcctttgtaaacgaaagaattcactcactgaatggatcgacggagatcagcgagtcgaagcactgcagtcaatcgatgatgtcgagcggccgtgtagaaatacgctgcccagaaacctttacaccgcccccgtgcaggtgcgaatgcggcgaaggctcggagacaccgctcgccggaatgctcgttgcacgatgagcaccacggccggcttggatcgacggcgacgcaacacggcggtagttgaggaatttcagagtagatggctgttgtgttctgtgtccttcaaagacgtctccttcactcctatatagagctaacaccgaacggcagcccacgctcaatccgttgctcctccgcgtcaaagccggatcggctccatgagaaacgcagccgccaaacggccacaagcgcatgttctcgcttcacatgagaaccaagtcttcaggtgattgaatcgatcagcagaggttgttgtatgcaagcatcttttcatccaacacatgcttatcgtgcgactaagcattaggcatttaaattgatgaaatgatcaatgtctccaagcatgttatttccatcactattcattatttttgttgaaaaatgctccacctagccgcctctggcatttcctcctctcttacaccgggatgttgaagtgcgggtttggtgaggcctgcaccacgaggacataacggcatgtacaagggttgttaatcactacttaaaacacacacaaatgatatggtattataggtggcggaacagttaaaactggttcctatacactttttctcatccccgcgggaaaaaaaaatagaaccaacacttttcaaaactatggatgccggttataaagaaatactactgacaccaatactataagtgtcagtttacttagaagaaacaacacctataatatattataggtgtcagttaattagaaaaactatatgaaaaaaaaagagccgagcctatcaaccacccatatatcccgtcttgtccttatccctgtaaccccccctctctcttgaccctgctcccttgccctcattggcggcagatctagtggtccttctccctctccaccaacaagattttcttgtggcagatccaatggaggcgatggcatcgttgctccagcgagcggatccagtggcggcggtggctttcccggaggtcctctaccacctccattccccttccgtcccaagcttcttgcacggcagatccggcggcggtgacaacttgttatggatgatgttgttgttgttgtgttgttgtgacgatgattatgatctagagttcattgtggattgatctaatggttcaaagcgtttgattttgggggcgaagcagggtggatgtgctcggtgccccccctgtttttcatcccgagaaccttaaaggtgccggttcctaaactagcatcttcgaggtgactcaaaggtgccactgctaggtgttagttgggaaccgacaataggtgccagatttcttaatcaaaactaacacgctttgtgtggcactgaatagtgatctcttactcttcctaattacgagtgttcgttgatatggaagagagagaaagaaaagaggcaaacaattgttgctactggtaacaacggcttaacaacgacacttagcctctagaacatagaaacactcttgcatgagggtgaaaagaattgaaagaatagtaataaaaaacaatatatttccgttcccatcactactaccaaaaccatcattcgtggcggccattttgggttttcactggcggaatttgaagccgtcacaaagcaaaaagccagtgaaaatcaagatcttcgctagcggttatcgaccgccagtgataattcattttcgctggtggtcgtcttaaggcagccgccagcgaaaatccattttcgctggcaacaggcataagacgaccgccagcgaaaatgaattatcgctgtcgggttacaccatgccagccgctggtgtaaatgctggccaaatttttttaaaaaatgatggacggagcgacaccgntccgcccgccttcatcaacgcttcaccattcaaaaatttcacagaaatttacccaagcattctaaaattcacaaaaatttacattcaaaaatttccattcacccaagctgtcaagcatcacaaaaatttgaagtcgtcgtcgcggcacctcccccatcagcattggcagcagatccggcctcccaggtcatcgcggcggtggatccggccacccctgtcgtcacggcggtggatccagcctctcccgtcgtcgcggcggccggatccggccggccccgatctcctggcagtagaggcgacggcagcccgcggcgatggtggcgacgatagctggtggcggtggaggaggaagagggagaaggagagctcgccaccggatccgtcgcctgcgtcgtcgtcgtcaccgagactagacgtcgccgagcctgctggatccgtcgcgccagcaccgtccccgctgcagagcccggtcaccgccacgacccatcccctttgccaccgccggagcctccatctcctgcgccgtcggtggagagggaggaggagagggctacgcgtcgttgggaagggaggaggagggaagagtggatctggaggatagagtggatctgggagtgttgagaggaggggatgggagggcaggggtggcgcggggagccgctggtcactgccgccagagccgccatcgccgtcgccggtggggaggccgggatggaggaggagagaagaggaggggtaagaagaggaggggatgtggagagaaggagaagaggatgaggtaggtgagtggtttttaatgtgagggatattgggtacgagctgggttttttctggcggttctgtttattggccaccaggaaaaattcgaccgtcagcgaattatatattttcgctggcggcgcacctaagtgaccgccacctatcagggttatggataccacatacctaatagtagttgagtaaatctcggcaggacccaccacataccatgtcctatacggaaacaacctgtggatataggaggagttccgaataaggaaagacaaccagagttctacatggaaacgacaaggactactcggattgtatccatattggttttcctagttctacttagacaaggggacacctatgggtataaatacaaggccccctaggaggagaggggacacggacaatcaacacccacaatcaacatacatggaacaacagatgccacaacatacaagccaacatacgccaagacaagacgccggatatcgacttcggagataagcacggctagtcccctacggtgtctccggatactgtcaggagagactaaagcgctatctctgatctcgccgggcatggattcgaggaggaagactaccctgttgtcgactatgagtcagaccttcagaccgccaagtcgacaacagttagataggctacccaaaatattgtactggtgtgattatggtgaataagagtaatatcggctttggccaacaggatgtagggttattacctgacaattcaggggcccgaacctgtataaaaatccctgttcccgtctcttttacctcagtctcgcgtataccctggtaccaatgatctccatactatgcaaataccggaatcgcaacatcaaacgtcgacaccaccaaaaattgacatttttttgctggcggccgctttagacgggccaccagtgaaaattcattttcgctggcggtcggttcccccacccccttgttacgactttgctggcggtttttacatttttccgccaacgaaaataataagccaacgccataaaaaatcattttctaatggtgaattattataaagatatgatctctaaataataatttttgtattgtcttatagactatatacttgtctctaacatcgagcatcctctcatcgacgtgctcgcgctgctagtgcttcctaccaacgacatcttgtcacgacgagaagccaagctggctagattggctacactttcaaagcttttaaattttttgatgtttctacggtcatcgaaacttgatatttgtggcagagaatgccatcttcttaccccgatgaaatcccacgtattgttgctcgctagctaagaatgtctagcgaacttagccaatttatagtgacaaaataatggccaagtagattttgcccccgagaagatatcctctcgttttgtacatagcgtttaaaatttttgaaaaaaaaatcaaaatagatcaatatataatatatctttccacaaacattcaagttaaaatttgaattatacaacgcaaacaaataacaaatttgaccacagattacgcattatattcatagtcaaatttcaaatttgttgtttctcttctacttttacatattgaatttgaacatacacatatttgtgaagtaatatatcatatattgatctttgttactaaatgtctttaaatttttgataactttttaagcgacatgaaaaatcctaaaggtatgaatggagtagtttcccaaataatggcaacaatatttgaagctgaatgtgaatcgaagcaagtaaatataggaaaaacatggtaacctacgttttcttttagccacttggaagaatggcgatagaacgggagacggattctaataacttgagtggacgtccacccgtttattgtatgtcaaataaatggttatgaaaaaaattcaaaaaaaatgactagatagatcgatatttaatatatcacactataaacatacaagttcaaattcaacttctacaagttgtaacaaaaataacaaatttaactgcaactatacatnnnnnnnnnnnnnnnnnnnnnnnnnnnnnnnnnnnnnnnnnnnnnnnnnnnnn

SEQ ID NO: 15285 - DNA, 2269 bp, Oryza sativa
cccttcccacccccacctcaacccgggaccctaacccgtagggtcctctaccggagtctagggtgtcgccggcgctggagaagaagaggaggtcgccagagttggaggagaaggccctggagcacgaatcacaaagtttatccggtggaccaaaatctacaagatttggaggtagattttctgtcgacagatcgttagcatttccgaaatacttattggccacatcttaaagaaaaataatcggagttgccagaaaacttcgccaagttttttttcctagaacttttaaatttgtgactattggagagttgtgcatgatggaaaaaaccgatgcggaaaggaaaaatcgggcacccgtctctctctcgtctgttccccgtatctgtgttccagcgccggcggctgttcgcggggtggtcggtggcggcggcggcgtcgtataggagggtgaggaggcggatgatgggccagcttatggcggcggcagctatgcaaaggtcattggtgacggcgttcgagaaggagcggagctgggggtcgtccttcatccagaagcactggacgatgcaacagctccggcgaggtgacccgcaatcgtggtgaccgcagtgcggcttgctatagaagtctgtcgctgttctcgagggttctcaagggttggatgttcgagaacttcctccgcgcgtaagctcaacggcctcttcagccggcgatgcaacagctctcaagggctcgatgttcgagaacttcctccgcgcgtaagcttaacggcctctttagccggcgatgcaacagctccggcgaggtgaccagcagtcgtggagccgcagcgcagcttgcaagagaagtccgtcgaggtgaccagcagtcatggtgccgcagcgcggcttgccagagaagtccgttgccgttctcaagggtaagggttggatgttcaagaacttcctccgcgcgtaagcaatgtttcggctagtgtactcgtgatgtttttctatgtatggatcaaatgttgcagtggattttaaatattgtttaatgggtctgtctattcatttgtcgtgtgatttctaacaaaaaaaaatcacccaaattttttctgcctttatatttacatacaacgaactacaaaagaaaataaaaaatacatatttactcacacattatttttataaaaaattatagtgcacttacatatcatatcaactgaatttacaaatgtaattttagttatgtaggactgtaattttatattttaaaatataattttagttatataagactgtaattttattttttttaaaaaaataacaaatacatatttacttataccaaaattacagtgcacttacatgtcatatcaactgaaattacaaatataattttagttatatatgactgtaattttatattttaaagaaaataacaaatacatatttacttacacattagttttatcaaaattacattgcacttacatgtcatatcaactaaatttacaaatgcaaatttagttatataggattgtaatttatatttcacgacgacgagagggacggtgtcgctcgccgaatagcgttggtcgtactgccggtggccggctcgccggtcagaggccaccttgccaccatgtttctctatcatggtgcacgcgtgggctagctgacacagtccgtgaccgtgagctgcagctcacatcacaagtggtgcatagcgtgcggccaaaaaaaaaagtgtgaaatgccatagaaaaattcacacgggagatggatagcaaaatcgttgtttaataatatcatcttgacggatacggggtttattgttgtacatggggtaagtgtttcaatgactttaaatcgtttgttgcatatgttgatctaatttttttcatctagcgatctgaccgtgcttctctttttttttaacaattgaaacattctttcgcaattgatgaaataatgctttttatagggtgaagcaacgtccgatttaaaaaatcgggcgcccgatttataggggttcgtttaaattttttttgcacacggatcacgcgccaaccgaaccccgggactcgacgcggacgcgcccaccacccgaagccaatttgatcccacgtcaaggggggcgcctctgcgtcgccgtcggagaaaaagctacagtagctggccaccaggtatccttggtgctccgggccttccgctggcaagatagatcttgtcgtccgaggcgttccggatgatgtctcgtccgccggcaacgacgaggcggtggg

SEQ ID NO: 15286 - DNA, 1004 bp, Oryza sativa
ggcgcatcttcgcgtccgacgcgtcgcgattcgcgttcagggagaacatcgcggcgcacgcatggcttcttctcgacgcatatccgatccgttccatatgatgtacgtactagatcgacggtgcatacgaggccacgtacacacaaacaaactacggggagatggattatattagtttgagatttgtggcatcagttttttttgtgtttttttaattatatgatgaggattttttttagataatggaattatatgatgaggataatttgttgaatggagttaggtattctgtactttttgtttagcacaggaaccatcatctcttacgtcaccccatacgtcaccggtcgccgtcgccgtcgccgtcgaaccatagagaagccaccgctcctccctccctctcgactcccgtcacctgtcatccttgatcctccctcccctccccggcaacgctccttagtacgccctcgacaacgaccactcatcaccatctctactcctcttgacaactcgctactatccctcctttttactacattataaatcgttttcattgttagaccctgtttagatgccggcaaaatttttcaccctgttacatcgaaagtttggacacatgcatggagtattaaatataaacgaaaaaataactaattatacagattgcgtgtaaattacgagacgaatcttttaagcctaattgctctttgatttaataatgtggtgctacagtaaacatttgctaatgacgaattaattaggcttaataaattcgtctcgcagttttacaggcggagtctgtaatttgttttattattagtctacatttaatacttcacatgtatgttcgtatatacgatgtgacacgtcaaaactatacactcctgatctaaacacagccttatacaaaagtttgatcaaacttataaaaacacattaacattcatatagcatcaaattaatgccattatatcttaaaatttgttactatttttatgttactt

SEQ ID NO: 15287 - DNA, 4458 bp, Oryza sativa
cctaattgctctttgatttaataatgtggtgctacagtaaacatttgctaatgacgaattaattaggcttaataaattcgtctcgcagttttacaggcggagtctgtaatttgttttattattagtctacatttaatacttcacatgtatgttcgtatatacgatgtgacacgtcaaaactatacactcctgatctaaacacagccttatacaaaagtttgatcaaacttataaaaacacattaacattcatatagcatcaaattaatgccattatatcttaaaatttgttactatttttatgttacttgattaaatctaaatgggtttgactttgaaattaaaacgacaaacggaaatggtactacccaccaaccgagatgcggacgagactccgctgactttgtgcagtttgcagttgtggcaccgacatgtgggccttatagccctgcacaaagttaggggatctgtttcctcgagatgttgggcgcctgacacgctgaccctactcccccggacgtcgtcgtctccaaccaacaacaacggcttgtttggcaacttgaggtaaaaggattgagagtttacacgagggaattgatgatgagattaaaatgggaatttgatttttatcccaatatcttgtttggtggaggtggtggaaattgataggaagtttagttggagattaggtcattaatgaaaatggatggctgtgatttgtttaggcaaagtaaaggaggaattccctcccaattaccacatctacccaggtattgaaaagggggacttcctttctcaattccctatcccatcacgccaaaattcacatgtctcataaccaaacaaaatactccctccgtattttaatgtatgacgccgttgactttttaacaaacgtttgatctttcgtcttattcaaaaaaatttatgtaattatcatttattttattgtgacttgatttatcatcaaatgttctttaagcatgacataagtatttttgtatttgcataaaaaatttgaataagacaaatgattaaacgttggttaaaaagtcaacggtgtcatacattaaaatacggagggggtatttaatagcctcatctttctaaactctcaatcccttgtaagagcaagtacaatagcaggctataaaccagctataaatatattttaaagagataaaggaagagagagaagagcagcgagctacagatttgtagctagttgcaacacggactacaagacgtaatgtgtatgacatgtggtaccaggtattaatagtatagtaagcaactattgtatgaattggctattacattggttatagatgatttggagctagtagtgagttatactattgaacttgctctaaaaactccctccgaccaaatgggccgcaaagacagtgataaataatccatgtgaggcagtcacaggtaaaaaaaaaaaaaaagcttctctaatcctagctcgtgacctgacacctgtccagatgtgaacgaatcgagcggaggctagcgaagtagtagcgagtgtagcatcttctcgcgcgctggtctccccaccgtctctttcgccatttgcacaattctctcactcctctttccccctcccttcttcttgcttcttatcccccaagcaataacgaggcgtcatctctctcgtcatcttctactctccctcctctagtcctcttcttcttctactttgtacgcgccactcactctccgagcttgacggcggcggcggcggcggaggtcgtcgagtggtggtcggggagatgggtcaagatgaggtggaggtaggtgcggagaagaaggatcaagaactaccggaggtggaggtggtcgaggaggaggaggaggagggatccaagaaggcggcggcgggctgcgactactgcggcgacgcggcggcggtggtgtattgcagggccgacgcggcgaggctctgcctgccatgcgaccgccacgtgcacggcgccaacggggtgtgctcccgccacgcgcgcgcgccgctctgcgccgcgtgcgccgccgcgggggccgtcttccgccggggcgcgggcggcttcctctgctccaactgcgacttctccaggcaccgccacggcggggagcgcgacccggcggcgccgctccacgaccgctccacggtgcacccgtacaccgggtgcccctccgcgctcgacctcgccgcgctcctcgggatctcctactccgacaaggcggcggcggcgaccgcggcggcggggggcgacgacggtgggtggtgggccatctgggaggagccccaggtgctcagcctcgaggatctcatcgtcccgaccacctcctgccatggattcgagcctctcctcacgccatcttcccccaaggttcgcttttacagccttctactgttcactgtccgaaaaaaaaaaatcccccccttttctgaatcaacttctatttaatttactcccatttatccggcttaattcttgtctgctgcaaaagattcagaactcgccggatgggaaggtgaatgaggaggtcatacgacagctaaccgagctcgccaattcagacggcggcggcgcgcagatttgggctcatcgcgaggcggcgcaggccggcgatcatcagttaccttcatggggaacaacaacacaacacaacactggacatggcaatttcggtactgcaaacagcaatgaggttgcaaccatgccgacgcctggttatgaggtttgatctacaatcttcagcatatctgactaatttgcagtgctgtttaccctatggatgtacttttgtcactgcaattgttagtcaagcgataaatggtactagattggtagtgtccgcagaatcttcgtctgaacggtagaaactatacagattctgtatcatatgcggtgaagatattcctaggcatgctttgctgtacctatgttgatggggaatttattctgtagtgtcaactcaagcgctagcaactcaagatacatctgagtcagaataaagtcattctagtgaagaacccctaaattctctttctctttttcagagagaagaagccccaaatttgatatgattctgttcttttcctatctattgtcatattcgtgattttgtgtaagattcttatttggtttacacctactgacacatacattaattttttaaacctggacaaggataccattctacccattgattatttattgacagtcctgttcagatagggggaattgtatccacactgaaattggccatgaaaaacgcagagtaggcctagttgataaagagctaagattttgattgtcagttcttttgcgcaaaatagatgcttacttggctatctattaatataactttatctatatggcagaatggtggatgggataacagcgattaccctgcgctaaatgatccgtgcaaggtcgagttcacatatgagcaacctccagccagctcagctgaagcatgtatttcatcatttgttcagatgtctgaactttgccccagcatgagcaatggtagcagcatggaggaaacccaccagacaaaccctggaaatggcacgccaatgcaagttctacccaaaatgccagaatttgttccttgccccgacaggaacttggtcatttctcgctataaagagaagaggaagacaagaaggtgacataagcttatggcaagcatgatgtttttatttcctcttgaagcttctcttggactcttacccaggatttttcgatttgaaacataactgtgtgacaatgaaattctaattattgcagattcgacaggcaggtccggtatgagtcccgcaaagctcgtgctgatagcaggctgaggattaagggccgttttgctaaagtcaatcagatttgagccttcatttctgtaatatattttgcatcttggacatgagtaatactaattaggaccaagcagatatagtacaagaaaaaatatcagcattttgtatgtaactatgtacccacccagtggctacgccacgctgaggagaatttagtttcatcgaatctctgtatatagtgttgcatcgaactcagtgatactatttacatgcaaaggatattgtcattatggctgtttccccatggttttactgcaaactgtctgctgtgttactactgcaaaagctctcctttgatgaggatcagtaaaatagtgtcaaattcggatcgcagatatgttgacattggagaggacaattctgtgttaagagatgagtaactcgtttcatggcaaaatggttacaaaatatttaattccctgtaatcggcttgtcagtttgtcatgaatcatgaattcgtgatgctagaggataaaacagagtctgctgcataccagaagctaatgaaatagttgatgcacgacaaatcacagtaatctgtcaaaagattagctttgatttatttatatcataccagatctgacacag

SEQ ID NO: 15288 - DNA, 4850 bp, Oryza sativa
ccgacgcagcaggcggtggctctaccgccgaagcaaggaaaggccaaccccgccgggcacccttatgggcggcgttgacggcgcggaagtagaccaagcttggcgccggtcgagcagtgggggacgtggtgtagtatgaggagccgccggtgaggtgggaggagaggaggagggcagccatggcggctgccggctaggaaggcggaggtgctcgacggaatgcggggagggaggcggagggccacgtggaggccggcagtatcagagcccggccggcgagcgtttgtggtggtggtggcgtcgcgaccaaatccgagagcgcgattgcgctgacgtcactttgatattttcattttcattttttggattttggaggagcagcctctcatcaaagcaaccccaaaaaaataaaaaaaggaactcgccactgggctgaaatcagcaaagctcaatgggcctcgctgtgaaggccacaataacagaggcccactcagagcccgtctttccaaggctttattaaagcgagaggactcgatggccccgagacgaaaccctagccttcgccgccgccgcatcagttggcgatcgatgcttctccaagttccgtcgtgttcaaccgttttcgttcgatctcctctttctgattttggcctctttgtcactggtttatcgatggcgttgtttgtctatccccatttgtttctctcggtggttttttgttcatctttgaggttactgtgatttattttttccttcctgcaatacatcgtcttgatttggaagtttatggattggtcatgctcttgttctgtgtgtttttttttttgttgttttacatcctgattttcgatctagcgattgttgaatcttggagagttggtggtgttggccggtgatgacagcgtatggtatgagcctcagtaactaatctgcgcatcgggtagtgataaacccgggttattgacggccaagattcatgtgccaaaatgctaatctgaggccagccaaaccatctctcccttgagcaacttaccttacttcgtttccatatcttaaataacaagcgtaaagaaatggcgagctagtgttcaaacccaattaggaatgacatctgaacaagcagaagattgagaaatgtaacgcagacaccgggttgatgccagtatgccactcgcacataaattacgcaacatactccttatttgcaggcacagtagtacttttgagtttttatcataacttttaatcattcgactttgtttgcgatttactttgttatcaacagtattttaagtataacttattcttttttatatttgtactaatttttatatttgtactatactggacggatgtagtagaacgcagcgctgtaaaaaaaaattgttactttgttcaaaatggttctaatatggtccaaaataatcgctccaatcgttacgaggtaatcccgctgccgcgatcaactgtgtttgatcattacataccgccgccgtaatgatcttaattatcgtcgtgcctaagagcaagtttaatagcagagctcactacttactagtcaatgctataatagcagagctctttacttacttactagttaatgctaaaactaacatgtacagtagattagctataaggttatctttattttcttcatcctctctctttctttcactatgaatttaatatataatatttggagcttgtgtgtagttagcttttgcatgatagccaatactccttacttttgtttatctctcttctatataaatatataacttgcttatagcctactattattcttgctctgagttgttcacgcattgctgattgcatgttgattgctggtggcgtggattgatctctcgcttcgtgtggtgaatccgtccatgctggttgctggaactggaaggctgaacggctccttttgctgttgcctagaacatttccgctgtcacattcctttgttccctcgatcgcacccaaccatttcgttgtccgtgacaatctgttccaggtttcaaccaagagagggcccatggccttcgtaatcctcatcttaaaagctactccctccgttttaaaatatttaacaacgttaactttttagcacatgtttgaccgttcgtcttatttaaaaaaagtttgtgaaatatgtaaaactatgtgtacacgaaagtatatttaacaatgaatcaaatgatataaaaagaataaataattacttaaattttttaaataagacgaatggtcaaacacgtactaaaaagtcaacgatatcaaacattttgaaattggagggagtatatcaccattatccaaatggagaatcctataacaccattatccgccgaagcatgaattcgacttctttttttctttcttgaagattatcagttcctcttttgcatatatatttttttctgtctcgtttaaagttcatttttcacgggacagcaattggtagcgtattgtttcacgcaaactggatttcctttacatacacttctgaccaaattatagtactccgtaaaagtctagtagaacactacacggccattctccccagcgactgcacaataccaatttttcgccttcttctcgggacagtcggttgctcgctcgctcgccgctactcccttcgtcactagaaagaggacgtggttgcacaaatcttaatactatgaaacttaatactttctccgtttattttataactttgacaagtttaaaatttaactagctaacgttatacagacaaatttggaggtaagggcggtggctattgttcaagcccaattaggaatgacatctgaacaaacaaaagattgagaaaaggcatacaccggattggtgtcaattgcacataaatgcgcaatatattagcaggcacagtctgaatacgagcatacgagtaaaacttatcgctgtacaaaaattgttgctttgttcaaaatgattttaataaacagtgtttgatcattgataccggcgccgtaatgaccttaataatcgtcgtggctgagttgttcacgcattgctgattgctggtggcgtggattgatctctcgcttcgtgtggtgcttgaaacggcggctccttcgctgtcgcctagaacatcttctcacgtgacagtcctttgttcactcgcaccaccaacatctttgatacttcctccgtttcataatataagttattctagcatttctcacaattatattaatgctaatgaatctatttatattgatgttaatgaatctatatatttagattcattaacatcaatacaaatatagaaaatgctaaaataatttacattgtgaaacgggggaggtagaattcatccggcccatggcctccgtaatcctgatcttgaagctaccggtttatccaaaaggagaatcctatatatcgttattatccgccaaagcgtgaattcgacttctttttttcttctttcttatagattatcgattcctttttgcatattattttttttttctccttttgtatcatcttaaagattttttttcattggcctgtatccggtcgggtattgttctacacgtatttctgccgaaatttatttagatagaacactacatggtataggtcattgtcccacacggctgcacgataccaatttttcgccttcttctgccgtcctccggtcctcgggacagtcagtccgtcggtagctagcacctgctagcagacgtatgaccaaaacaacgctcataacccacgtgaagcggaaacaccgagaaaaaccgcggaaaacggccgaaaccaacgagtggattgtaaatcctcaaaaatacatttccttgttatttacatataacctactaaatagttattttttaaaaaaattaaaacaagataaattattatatgataaatcactccataaacatacaagttaaaattcatcttttataagttgtaacaaagaaaacaaaataaactataactagtaaacgtatattcacaattaaatttactttattcgttgtaatgtgtaaaagttaaatttgattatgcaggtttgttgagtaatatatcatatattaatctatcttgtttattttttaaaaattttatcatatactcgtactatttaaatgaatcgtacttccttcgttcgataatataggagattttgatatagatagtgtaagtgaaatatgaaaatatcttatattaggagatggttggagtaaacagcaatgctcaatccattgttcgagtagtttttccccgaaccaacgcaatccacacgcgacgacgccgcgaaccggcgcccaatcgacgcacggcgcgcggggccgtcggtttttggcgccgcacagccacgcgtcggcgcccgccgagtcagcaccacgtcctcctcctcttccgcccagatccactcccacagtatggccgccgaccgccgcgtgggcccaacatctcagtcagcgccaacgcggtactactagctgcctgccgggtgggccctccagcccaccgtccaaatccacctacgtggccgcacccgcgtccctacgtgccgccttatccacaaagaccacagacctcaccccggttggtgtggagtggggcccacgctgtcattcggtggacgaggccggtgcgggccccgcgcgtcattggatggaggaggaagcgagcggcggaggaaaaacaaaaaaaaaaaaagaacgcgaggccacctggcgcgctctgtattattgcggctgctgctcgccgtgccacgtggcactcgactggcgcttttttcggtgtttttctttttgtttcttttcgcttcgctgtgaataaatacgaggcgaaaaattaaaaattca

SEQ ID NO: 15289 - DNA, 1240 bp, Oryza sativa
cccagtaataccagtatactgctgtaattacagcagtacaatttactattactactccatttttattaggaaaatcagcggtaaattctcagtgtgtagctgagaattatgagatggatgatgccccctgtattagtggggtcaaatgagtatttgtcaaaaatggtattttgtaatgatcttatgatcgagatgagagattgtattctagtgatgctattgcatcattgttacctcaagaatcagaacatgagacgtgtaccccaataattcttttgtccatgacattgcaatgcttatacgatgatgattgatgcatgattaacatacgtaatctgcatgattagctcgcgttggaagaacacgagcttcttatcctcaactgagattaggtccaacaaaatactgcttcggattaacaaatacacacagttttggctctcagatacatcctgataccatggtaaccactagtttcttactcagtagaatttataaggcccattaggcattataaaaacgctcgactcaaatcaacaaatgattaccgtatgtattcgtcaacatatagtagtatatacaagtcagaatgtgaagttcaccgctgaaacgtttgtagcttctctcgcttttgccctttcccaaaaataatttaataaaaaataattaccattttacccttccaccttccatacctgattgcccttttaataccttttttcaggtaccttctctctatcatatctgatcaagggtcctaattaatttcaagcattgaagaagatctctactaacaaatcacacaatccacaacactgcttttgacactgttctcagcactgcagcctattactccatgtattacactaatttaaagaacacatcaagttgcaacttgcaacacacaacttggcatttttggctacacaagcctgccgtttacaatgtaaattgggggagattaaaaagaagaagaaactctctaggtttcaacagccggcaccgcccaagaatgtgtaacaattagaaaaaaaaaacaaactagaacagaattacaagccaggaggccagaaagatcacaggtggctattatgtacactgcagcagcagcatccggggcagcaacttcaggagatggacttggtgtttttttttctgcccaaatccaaacaaatccttgtgcttcaatgtcaagcgtgactcgtgcacgctacgcctgccgatccagcttatcatgctt

SEQ ID NO: 15290 - DNA, 12485 bp, Oryza sativa
  unsure (1)..(12485): unsure at all n locations
cccaagaatgtgtaacaattagaaaaaaaaaacaaactagaacagaattacaagccaggaggccagaaagatcacaggtggctattatgtacactgcagcagcagcatccggggcagcaacttcaggagatggacttggtgtttttttttctgcccaaatccaaacaaatccttgtgcttcaatgtcaagcgtgactcgtgcacgctacgcctgccgatccagcttatcatgcttccacggttcgtccttcatccagcacctgcaggtacattgcattcgcggccaaaaatcttgattaggatgcggttcatctgattgtgatttagctgcatgaatgcagctatgcctggacagtgatggaaaacaactgcgcaactgcagcttaagaggtatttttgcgagttccattggcaactcgtcagcctataaaccaaggctaaatttgaatttttgaaacttaatttcagattggtctacgtggttttcttattgttttctatttaaaccgctaagagtagaaacataaaatccctactctaaaattatttttctttgcttcgtgtcacgtttcatggcacataaaccgtacccaagcaagtatgcaactgtagtttacagaacaggctgaatcagtagtgattacggagctaagggtaaaacacagagggcagctatcatctggtgcaaattgcatacatgtgttgccatctattctcttctgatgtgacatcccaacagaaaagctcgatttgcatatgggcagaccgatgaattcagatatgcctaacagccagctcagattttggatcaactactgctctactagtactcctaatctgactatctagtgtctgaagtttggaaggttctgaaaatgtgagtcagctttcataatactgttgaagaaacaattaggtaaactgaagaccatctagataaaagcaagtattaagtgtcattatatcaagcagggtaagtaaccatgtgtaaatgtcgatagtagtaaagctgaatagagagaaatgatcaccttatctcattcacaggctattttggtatcaaaactgctcagacagattgcaaatgattgaaatgctgatatcggataacggtagtccatggtgaacaagtccttcccaatctttccaaactggagaatcaccttgtcctgctcctggttagttggcccattttcatcagacgccaccagctgaaagtttttcactgaggcaacagtaacccgtccacggaagttgaggcaccaacattgcagttgctcatgccacctaggagatttattcttcagaaccagcttttcttccttctgagtggataattgtgaagttgcactatctattcgagctgattttgatctgaagaatgaaattgatgggaaagagtcgaggccactgagaggaaattcagtctgtgtcggagctttcccaccctcttgaacagctgatgtggggatggaatccataatgcagttcatccttcttggacctctgcaataggaatgcatcacaaaaatcactgcaattttctacgaagtattgtagaagcagtcaaatctagcatgcaaagtcaatcaacaatgaaaaggttgcgtatatggaattatgacagctggtcagccgccttctctatataattattcctagccatgtgtgctcaaataacagccagaaggctcacggagttgtgatgttatcaccacttttatcattagagccttttcttaaaaaatagattcagcatgtctaattgatcaatcatgcaattgcagtaatcaccactgtgattctaactatcgatgaattcacatattaaggtctcaggtgttgatgacaatatttaccaatactatccatagatttactcggcataacacaagtgctgattcaataccttgcacccaaaacattcaattcgtaggaaatatgtgaaactgggtaattcccggcaggaactctcggggagacttggttcagaccaaccacacgtgcagaccgactttttgagacaacagctccatcatatggtggatgggcatcatagacggtaaactttgttccgagaaagtttgacctgttaaaacaaaggtggttagctggttcttttaattgttattgtaggctatatttttagatctgtaagaaacaaacaaaaaaaagatataactgaagattaagtttgagtaatgcacttgacatccaaatacatacagttttgttctaagttgaatgaatagtttagatgtgaaatgcatagcacttcaatttcttgtactttccaaattctaacacttacagcaaaaggagagggggaaaaatgccatgtgatgcttttatatgaaacagcctatagtacatctaaagggccttccttacacatactactaaagaaactaggaacaaatttagctttagcttttcagtgatgaaatctcaaaagatcaccttagcttgccaatataggtgttgctcccctttgacatatcactcatgtcaagggaaatcaggtagtctgtgcatgtgggcttcctgcatttgcgtgcagcaagtaggaacttcccatcatcggcaagtgctgtaaaaagaaacttcccgaaaatagtaagcatatatccattatacgccagcatagctgtacttaatttggcgtaccaggggtggataaacagcataccttctgtgagcccaatatacagataatatgtctgagtagtccggtttcttcttatgaaacatttaagagtgccgtctcttgggccaggctgcacatcacgtagacttgagtaaattaggactaagatgacactaaaatgaacttgtcaaccaaaggttacagtcaatgaagtggcgtcaatttctacgaaaatgacagcagagaaatggcatttgatactggaatatcatgctaaacatgtgaagcaccgcaatcaaaagggaaacggcttcatcagatagcatttatgcatccatcacattttcttgatatgcagtttgttttctagcccaaaactagataaatcacataagggagacaccttccaaaaattaaaacatactagaatgccatggttcacaacatccattaaaaagatgatttggctgcttgcaatccatcagagcaaagccgacatacgcaacagcgcaacagaatgcagggctttcatccttcaccgcttgacgaacgcaattcagcagctaaccaatcaatcataaagtgttgacacaatgaacaaataattcctaaagattaaacaatgaagcttcaacacaatgaacaatcaaattactaacagttcgacatcgcaaccgggaatttcagaatgaaacgagagcgcgaacctgcttgagcgagatggggaaggtgagcttgccggacgcctacgggacgcggacgatctccttggtgatccccctccagctccggcagacgccggcgcacgccaccacgttcctccaatgacggccaccacacctccgactcctcgatcctcaccagcacctcccggagcagctcgggcggcagctgcgcccagcagctctgttgaattgacagcatctccgccggccccaccgtcgtcacccgcggcgcgccgtcgccgccgcggtgggaccgcgaccgcatgctgtgccgcgagatgctcccgaactcgtccctcatctcctggatcaggctcctgaacgacatcttcctcctgctcgattccccctcctaatccacacctcttctccaatctctcaaatctgcaggctgcaaccgcgccaagaaaaacccggtcacgnnnnnnnnnnnnnnnnnnnnnnnnnnnnnnnnnnnnnnnnnnnnnnccaaacggaacgccaagaatcgcaagaacagggggaggaatttcaccgtactgaccgagagacgggccgagctaatttcaccgtaatgtctccatggcgtcgccgcccatgccggaatccatcgatgaacaccaacaaggcaccgaactgagctggaagcaagcagggcggggaccaaatccctcgacgcagcaagcaagaaatggcagaaatcctcacgcggaggtaggtgtctccgccgctgaatcccagaatcaatccaagggccaagaaaaccaccaccagctcgaagaagcaagaaaacggctcgaattcaagctctcaacccaccaaacagaacacccaacatttatccgaaattgagcacgaaaattctgcaatggattcttggctggaaggaggaggcggagggagcaagaacaagaagaaggcagaggcaaagattccaagaaacgaaaggcggaggtgaggagggaggaggaggaggagcaggtgccttgggaatttttaggtggtgaatgggtgattgataggtggtggtggtgtaggaaggaatggttggggaatgccagtatactagtactacctatgattgctactacacaaaaaagggaatggaatggagatggagcttgagagcaggtaggattagggttcctccctccctcttccttccttgctgagtggctgaaaaagatgggcatctcacaactctccctccctccctccatgcacacatccatctatccatccacacattcattgtagcacaattaattaactaataaatgtgtgtataagtacagctgactagtactaatccactcgtttcaaactataataagggttggctttaatatggagtaaatattaagaaaataagtagatatacaaatgaactagctaagactatatatagaacacatagatggtacaaccagaatggacaatttactgaataaaatcatattatataaataatagggttttatatttataataatttcgttttaaaagttattacttactctatattttactcctacagtactggttaactttgcatgagaggcgaattataatactaatagaccacacttgtggaaaagaagaaaccaaattatcaattattttggcatgacactctgtcccaatgtcattgtcagggcagggatgatgccactatagccaagggaagcatcattgctcaagcttaacccaagtagtactagtactcctcatgattgattgcttccatctttgtgctaattaggcatggagtgcaggacacttgactgtacctgcccctcactttccaagtgtgagtgagattaaagcacaagaaatgaggatttctttttttttttcaaggtacaactctgccagtttggccaagcaaaatgttggtactatcatctttgcatcatcatcatcatccacctgaggaaaaacagtagaaggtcccttttaatgttcaggtgaaaaacatgagatgttttattgggcttttctgctatttttctttcacctcacatgtgttagtggcctgcatcaaataacggggttttttttttgcatgcatcccttacatgtgaaggcagtggtcgcgcgcggagaatcgagaaagtaaatgaccggcgtcactgcctctcattctaaccacaaatagttaatggtcaataaaataaaatgagttactagtaatctctttctttttctctcaaaaaaagttactactatttctatttacagaaaaaagtttattcccctgtatttatactcaattgcatacgcaccccgtttataaatattacttcattgtcatgatctttgagataaaatatagagcttttattctgtaacttgatgattccccgtatgttgttgtaggatattagcttaacattggtgtaagctttggtgggaaaaatatactacttgtgcacacagagttgcatgatgcaaagattgtaaaaagttgcaataaaacatgtggttatatgatttaaattaaaactttactttagtgttgatttccggagttttgatcgtagtctgttttgcagccttagcttccaaatgctagtagtaataaacatgtttatttataatttataatttgttatttttactttttggtggtttattcggcaaagcttaagtaatgagatattgctcgtgcaaattcgtatccccttcatccaaaagtaaataaactaagtacaggatatgatacatactactaggataaaagaaaaattaaaatacgaggttagtttattccaaggctgagagagtaggacacactagatttttcataatttggtccttttgaaaaccttattctacaaatatacctctgaaaaaacttattctagaaatggtcttttttagagcgccagagttaatggtgccgccccctgccaccatggcggccagatattgacgtggcaaggggagcgcaccagcctctctggcgccacccccagctccgagtcgggatgctctctctctgctctcctcaaattcactcgaaattatataggtaagagagggtttttttatgtaagaggttgttttccgttgtttttgtttttcctatattccaaaaaaccaaaaaaatagtacattgccctttttacatcctataaaaaaaatagagtttgttgagtttttctcttttacattcaaagtatcattccttaaaacaggcataactttctcatacggactcgaaatcgagcaaattatatatccacggacatgtacagaaaagttacatccgattctccatgcttctttaggtttggaaaaattagaaccttcaaattccgcttgaaagattttgtttttgaggcgagaagtttttcggtagagttttagaaaattataaaggttgcatatttcatccatttgagtttaacttttttatggttggttcttgtggactcttaaaaatggttttaaaaaaaaccatttttgggataagttggttcagggagtctatttttaaaataattttttggaaaggactaaattttgtaaaaaaaaatccaggtagaacacatcggtttgttcctactactagtagctctatccccatatatacgctggcacacaggatcaggcagctgtctgtcctggcatcacttgcacagtgctaccggtggcagctgtaatggagatcgtactagtaccgacggacgagaacgcaggaggagcaagagccgcagacagacagacagtgcagcaatgcatgtccgaggagggtcgccctgcaacttgcgtccttgcgtgcggccgccggatgatggatggaaatcgtcaggaccatctgcctgcactcgcaatcggaatggtcaaaaaaaaaaacagaggattcattccctcaactagagaaacatgacaagagggtgagcaggcgtgacaagagaccgcgcccagccacgctacgtcgtcacgggctctatccagttcttctctcctctcctcttcggcagcacggtagtattaactcctggtttcagtgaaaagctttcatgccgctttcattgctaggtactccctccgtttcagaaaaaactcaaattatagggataaatctggacacatggagtttgattctttttggatgaagggaataagcactactcccgatcttatagggatgtggcatatcctagtattcctaatttgaacagaccatgtcacatacctttaaaatcccttatattataggatggagggagtagtaatggtgaacatgggcttgccctgaagactctagcggtggtgtgtttggttggttggatgacggatgagtccttatttttgaaattcaaaggaaatttaaacgattgtaaggttttaaggtgtttgttttggaaacatgaatcattcatggaagaaaatattccctcgtaatgatatgacaccgatctcatacatcaattgtatcagctcacgccacttgtgtacaccgctcgtcattgagactcacatgttatcacaccatttatatacctccaactaaagtaaaatacgttcttaaaaaaaagaacccaaagaaaaataatggtgatcctatccctttaaccaaataagagacgagaccatcctatcttatgtcgttctcaaactaagcgtgtgctagcatcttttttttttcaagctttgagcttgtcggagaaataatattctgctataaatcacaaatggatatgagttctttgtttaggactggaattggatatgtggtgagggcatactagtatttatttgttgttaaatttaaccaatttggtattgccaaaattgcttacactttggttacatttagcggggtccagacagcgcttatccatttcgtggcttgatggtctaaaagaacacaagcatccttccaaattagttgtacaagattccaccctccattatatctaacatgaatcactgtacatattaataaagaaggatatgcataaatttattttaggagcaagatcatgagctacttgacctgcattaataattaacctttccgaattaaagaagcgaaacaaacatgtgaaccttttccttcaaaagaaaagtatagcaacatgtgccttttttataacagaaaaaagggttgcaaaatgagtggcacactacaccttttacttgccttgttgaattttatagcttacttgtgtttgtggatcaaaaggggcacactcaaagaggaggagatcaattgagaatattgccactggtagtatattactccatgatccgtgaaaaagtgtggatacacctttgagtatctcaaggacttgggtaaagcaggctagaagaaaacaaatcatcaaagttgcctttccatttggcgacgcggattcgctagtgtcatcatcttcacaaaaactagcaaaatactctgtgttgcaccgggctataattatattagatgaactaattaaaactaaatcatcacccttaagctcctattaacgatgataggataaacagtgtgttgtgtacactgtacctgaagcaaatagagcttctcactctagtacattgttggtcaacaatgacgagcccacgagatagatggtggcccccatttgtcatatagatggagtgacagaaccaccaccactggtatcttttaagatagtatagaaatatatatattctccatttttaaatatattagtgtatgacacaattgacttttagatatacgtttaacctttcgtcttattaaaaaattaataaaaaatataaaaacaatgattcatgcttaaaatatattaataataaaaataaatgatacttgtatagtttatttaataagacaaactgtcaagctcattcctaaaagtgcatttttttttagaaaaaaggaaagagtatcacttaacattatattttgtggaagattgttaaagccacctgacctgcatttgtaatgtagatccaccctcggttcaccatgactattgtaatgttacttatttagtattctaagtgccgacgaatgatggataaaactaagttcacgcagttatatatttgaagacaaaaacgaatgaattacgtattagaaagttaaaatggttcatttaaaatagttctctaagaaataccactgttcttttacaaaacaaacatacggttaggagcttggaaggtgcgcacaacgagtaaaagtaaacagctgtgctcttcatctctctttggggttgtattttggaagagaaaaacacaacgaattaattcagaagaaagagacgaaaatgcaaggtgcggtggtgctattgctcaccctgcgaccgaggttgcccagccgtttcggttcggttggggagtcgtccacatcttcgttaattcgccggccgatgcagctggtgaccgtaagtaatcggttgagacagggcaaaggatgagtcaagaacaagaagacgctgctgctgctactgctgaacaaacctgagtacggcagccatggctccaatgtcgcgtcgcacgtgaaatttttggatcaccttctccagcaaacgtattcctaaggctcccagcagctcatgatttgcaatcgcaccaaacggcaattatgcttgaaaatgcacccagaaatcaaagacgggaaagaagagaaagatggaggatctgagcgtgataagtaatccctccatccaaaaaaaacttaattcccaaaaaaaaaacttacatagtttatttaataagacaaactgtcaagctcattcctaatttaaacaatttgtccagactatactacgagggatcatatatctgcgctatagcggcctctgtacagtccgagttagctctagagcttcgtcggtaaaatctgggcaggcgatgttctttttcgagtaaataccatcaccggtccctaaacttgtatcgttgtgtcatcgcggtccctaaactcgtaaatcgaccgttcaggtcctcaagcttgttcaattgtgtcatcccggtccctaaaattgcagatcactcgtttagattctccaacttgttcatttgtgtcacctcggtccctaaacttagatttgaatatcatctgggtcaaataggacggtgtaaagattttatatttaaaaatatttcataacgttttcatgtgaactctaataaagataaactttatatcaaacttgtagccctcgacactttatagttgatttttttattttaagtcattttttgtcccacaatgtaattttaaaattaaaatttcaaaatctataaacatgcaacaatattttgggaccctaaacagttttaattcaaaaacttatcaactacaaagttgtaggtcacgtcgagggctataattttgatataaagtttgtcttcattagagttcacatgaaaaagttataaattatttttgatataaagtttttagaccgtcctgcttagggaccggggtgacacaactgaacaagttggaggacctaaacgagtgatctgcaagtttagggaccgggatgacacagtcaaacaagtttgaggacctgaacggtcaatttgcgagtttagagaccgggatgacacagcgatacaagtttagagaccggtgatagatttactctttttttttaaactcatgcatttaattaaagttcagagagagaaagtacgtgagtaggtacagtgctcagagcacaggtctgcaagtttagggaccgggatgacacagtcaaacaagtttgaggacctgaacggtcaatttgcgagtttagagaccgggatgacacagcgatacaagtttagagaccggtgatagatttactctttttttttaaactcatgcatttaattaaagttcagagagagaaagtacgtgagtaggtacagtgctcagagcacaggtcactgggatacatccagttttgcaaaggagcccctcaagattgggcaaattacactttaagacaacattttgcagaaaaggacttaacaagaaatcgaaaaagcaatcaggtccttctcctttgtctgccttcaacgctgccgaggagttcttgaagctcggctctgatggaggctggatcaagatgagccgcttaagattaagccaccacagaatcccggaaggggcctcacacacatggaggtttggatggtgacaagcaatggaagaaatcagcatcatcacatataaattctaacagagctgaaaaagaggaacaacaccaaggcagtgctttcaaagatgataaatgaatacaccagaccagcgaaaaatccaagaaaaacatagcgatctgctgcagaaaccaggaggcgaatccttatggggcctccgcgcataggaggttggaactgcctcggtggagcttgaaaacctcagacgccttgaaagagagtttcgctgaatattgaaaacaaggctgccatctttggaaggaggtcgccggagaaagaaaagaaggccggcgctacctttgactccacaagattggatgaacccccgatgaaggcgcttaatagacacccagctccaacgaagaccgtcaccggttctgaaaccggcggcactcaccgtggtaccaggacgagggaagccgacgctgacggctgcctcggaagccaaaagaccgaaaacaactacgggagaaccatgaccatacgggaagacccgactaaaactacaactaatagaggggtggaggggccggacccctctccatcccttccacggcggcgagccaccggggaggaggagggagaggggccggaggggacgaaggattcctatagaaaggattcaagagaactctcgagagaggaggagaagggtcccccctgtctagtgagctcgcaggcgatgttctttacggatgattggatagagtacgaatgttatagtgacaaattgtatattagtatatgtattatagatctataaaataaatttgcttagaataagttttctaagcaatgcggatacagaaaaactttgggtgaatacccaacatgatccttgaactcaggggcagagctagagtgaaatggagggtggtgccacttagttaatttactcactttagatcaagtttaagcttatgcggatgcctaagtttgtattgaggagggtgcatatatggtgaaaatagatgagg

SEQ ID NO: 15291 - DNA, 25060 bp, Oryza sativa
  unsure (1)..(25060): unsure at all n locations
aannnnnnnnnnnnnnnnnnnnnnnnnnnnnnnnnnnnnnnnnnnnnnnnnnnnnnnnnntatattagtatatgtattatagatctataaaataaatttgcttagaataagttttctaagcaatgcggatacagaaaaactttgggtgaatacccaacatgatccttgaactcaggggcagagctagagtgaaatggagggtggtgccacttagttaatttactcactttagatcaagtttaagcttatgcggatgcctaagtttgtattgaggagggtgcatatatggtgaaaatagatgaggtatagctaatttttttttaaccaggttcctggacaccccctattatatactagctccgcccctgcttgaactttcgtttaaggatcaatctagtctctaacatttcgtattgtccaaacgagtaccttaagtttattgtgtgattcaatatagtccttagaccctctaaacatgccatgtgtacatgccacatcatctatgcatgcaaattcaatatttaaatgtcctttacacccttatgttttcataggaaataaagaaaaactattgagaaaacacacaaaaaaaaaagcttttgaccattggcaaaaatatgtagcattgatagataaaaaaaattgacatttttctttgttttatgattgcttcttcttgtttttcttttctttatttgatagaaaattgaagcttaaaaatggacatttaaatattatcttacatgcacgaatgacgtggcatgtccacgtggcgttttaagtgggtctaaggactatattaagccgcatgataatctttagggtcttgtttggacatttaaaacatcaaggactaattcgatccctgagcaaaagttgaaggactaaactggctatttacccaaagactttggaaaaatggtgatttaagaacagagcctcagaccggttaacatttgatgcatttgtcagctctgggccatcgaagcaaaacacggtggcccatactccacatggcagaggtgtttttgggctgggcctgcggccactttcaccatcgccgctcggctacaggactcgaacacacacaacgatagtcaactgttatggctctcatcctctgccaaatggtccagcttctctctgcttcaccttcacggatcccgtcctgttcttttgtgattaggccttgtcagtgcaagtttcaaaagagtttcaatcttatcaaaagatgatataacatgaaatttattaagagagaatgaatgagtttcatttagatgaaattaatattacacacgaaacaatgaaactgcgttgggactgaatcatttcatcatatgtcttggaaaagaaaataaaccccattataagtttataaccaaatagtttcataacaccattgaataattaaatgatatgggtagcatatgagaaactatgaaatgaaactgtgtattggagacttttgtttcattcatcaacccaaatatttttagattatgcgacactcctgaaaagaacaaaatgaaacacccaccgggaatggtcttaaggtatagaatttatattggttttcgttatcacgtttttcaaactgctaaacaatatattttgtgcgagctttctttatagaagttgttttaaaatatcatataaatttatttttcaactttgtactaattaaaactcaattaatcatgtactaataggtttcttgttttccatgctctaacttcatctttattttcaatagaaagaacaccaccatagaagtatgtcaatcaaagtagaaccatatataaatattatatagagtatatatagaaatccatagcaaagagaacacattataaatccacaatatgcacagtttcacagccaagttagactgataggtgagataggatggttcttgatataggatatttctataagatcctggttgacattatccatgaaaaaactaagaaaccaatccaattcatttttttctctcgctgatatataagccatcacttggaaagtaggaccatcccatcccccattttaaacggatagatcaataggactctatcccatctaaagaatagggatgaacctaacccttttcataccgatcacacaaaggaaactataatttattttcttaaaccctaatctacactaagcaatcaataatgataaatgttttaggacagaatgagtaataccatggtctgtatagggctagaataatcctactatcccaacaatcactacaatggttcaggtcatcagtgatgagctcagactatcacctcttacgggtagggcactggtgagagataagtggtcaatgatgactaaacttatctctattatgggacacctcttatgagctacaaatggtaacccgtcagaggtgatgttgacccctttgactggtgacatcataactcgtcacaggtaacacctgtgacaggtagcacaatgcggcccatcaatgatgtagattaccaatgaaaaaacaatatttgttccattctattgctcattcagttgcattcatctcacaaattcacaaatcataaaaataatcacaatcacattctcaatcacacatccgagcatcacggaatcaacacgaaacacatcacaaaattaaccagaatagaacacggggcaaaggaggatatatccagtggtccccaactacctggacaccggatctagcgccaaggagctcggcgtgacggaaaggcggcagtccgtgaccttgggcgcaaggtgaaggaggctagagctcagggatggacgagacgagcagacaatggcagcggcgaccgacgctcgaggggccatcccgatccagtggctcctaaccacctagagactagatctagtgcaccagagctcgaggcggctgccgacgaccttgggcggtgggtgaaggaggcagtggccggagcttaggggcggagagacggccgacaacgcttgggggtgaatgagatgagcagacaatcggcagcaggcgaaggagacggcgatgcttgtggaggctgaatccgatggctgacgatcgtgggaaagaggtcagtgcggctgatggtcggcggttgcatgagggcatgggaagacagctcctaacaatcgacgacgacgataagtggtcggagaagaagaaagggagaaagagaaaagggagagagatcgggggagagagatcggaggaggagaggagaagggacgggaggaggggaggagaaagggcaagcaggctagcgggttggcaggcccggggggatttttttttagtcatcactaacggttataagaattgaacatatttgagtggggtatctcatctgtgatgaatgcaaactcaacacccatcatagataagaggtcatctgtgatgggcctgtgtgtgagctcatcagagatgttatgtgtcggtccttatataaatctatcatagatgagttcttacatgtggctagtcatttccttgagcttcattacaacgggatttagtttaactcgtgtcagagacaaatttttttggtccatcgtagatagaccgtcatagatggattggtctggcgcaatgaattgtgttgcttgatctggatctattggtcaattaaaatgaagtgctcccagctgagtttaattcttcgggtgtggtcggtgagtatgccagatatccctttcacacacactgcttgcagcagcattagtgtcaacaaaacgtggttggaaatccgtcaaaaaaaaaaacgtggttggaaattgccggtcctttcagaatcggtgtacacacaagacgatggtactcgctcgggagagtaataacgtaagagggttagatggcagtattacggccatattcagtagagcataaattgtaaattcaacgatgaagattattatacgagtagtatttgaagcctaatcttcaagctcatctatcgaaaattattgccgtgcttctaaaaatgaaatttcttccccgaaaaaaatattcttaaaacactttattctaccatattatttatagtactactctccctccgacaaacattagatgtccaaaaacatcaaaaaagtcttttcatcagaggttatttttcagtattaacatttaaatcgttaagaatacacaacaccgtcgtttctcttattcgggaaaaaagcgaaacaacatatttacaaacgaaaaataatttataaataaaacttttatatatgtgtttttagcgatctaaatgcaaagatgaaaaaaaaacttcgatgaaaaaaatcttaaaataaactataatttaagattgaaaatttcaaaatttggttgtgataaacatgagcgaaaagatgagaccccaaatttttttaattaaattattattataataaataaacgagggccctcaatgttggctggtggctgcaactgcaagctgccagtttgactacaaataccaccgcacaccgctggagggaggggaaccttccagaagctccagattccaaaccagcaggagtcgcctcgcctcctccttcatcctcctcgtcgtcgccgcgggggtcgcctgaggtaggaataccaacaaccccccccccccccccccacccaagcaagcttctagggttttcgaccgcgcctcgcttcctccggtttcgtgggaggcggtgggtctccctccctccctgcgtgtggatctcagatgggatcggtgtttccttgttggtcttgctgcttcgcggggatttggggcttcgggcgggctgggggtggggggggggattgttgtggatgttgattgatcgatcggtgttgttggttcggggcgattggttggttggtggggaggaacggctcgtctcgtgtgtttgaatccatatgcaagttcaagtgatgcgagagtgttttgatgcgtggacctgctgcttccttttttttttttccttttgagcgatgattcgtgctgctgcggagggatacggatttgttagttgccgattactagtaataatcattggaattgtgtactgggctctggctgctcatgatgcgatgggctttgtgatatgttcatgattagatttagacatgttttttctgcaagtgtggagttgattgcagagtgtccttccctgatatgtcgggggattgggtggatgtagagaattgtagatttgggagttattggactagccaacagacagtttcctcgtgaattcgatcccttcatgcagaaatgaatggagggataggatgaaatggggtgagaagaatggatagctaagattgaaacttaccctttagatgggtgggaaatcatatcccaaaccgattttctagggataattcctctatactagacgtgtgttttgtttgtatctagtatgtttgcagtgggcagtggcatttgttctatgatgcctttggtttacatgctttggaaaaaacaatagatcattgggccatattgttatctttttctgactagtagtaaatgatgcgtctgtgttgcttctgctttaacatcttttcaatcttcactaggataatttcatagttcaatatgttctttgggaacttggttgggttttaggacctctagaggctacttctgccacttgctaagtaactgttttgtggaatttgtttacagatcacattaacaatggtgaaggctgttgttgtgcttggtagcagtgagattgttaagggcactatccactttgtccaagagggagatggtatgccatcagtcatcaccattttcatgattgtcttgaattgaattttagtccttgaatcgttgagatttactggcatgtttgattcttaggtcccaccactgtgactggaagtgtctctggcctcaagcctggtctccatgggttccatattcatgcacttggtgacaccaccaatggttgcatgtcaactggtaattattattgttattacatatatattggcttctcgcctgcctagatgtaccatcaggattgatacaggctatcatcatctgttgaattgattacttatgatgcacttgtttcataatgtagggccacactacaatcctgccggaaaggagcatggagcaccagaagatgagacccgccatgctggtgatcttggaaatgtcaccgctggagaagatggtttgttctttttccctttattccgaatttttatttgttccatacctgttaatgatttaacataaccatattagttgtggtcttgtagtccttaactcattgtcaatttgtagtaatactttattccgaatttttatttgttccatacctgttaatgatttaacataaccatattagttgtggtcttgtagtccttaactcattgtcaatttgtagtaataattgttgctgagagtttatttctctgctgtcaggtgttgctaatatccatgttgttgacagtcaggtaagtaaacattcagaaaaagaacattctccgtcatttgatttatggaaccaataccacacatccccttattattctgctgttaccttgtcttttccttctttctttttcctgtgtgttaacatggataaccatttatctgtgtcagattccacttactggaccaaattcaatcattggcagagccgtcgttgtgcatgccgatcctgatgatcttggaaagggtaatattacagacaactgtttgtgctcatttattttgtctgtgtgcttgtgtgctccttttcttctcttttgctaaggaagatctcactactgttgggtctatgatgacaacaatcactttctattgaatggattgcataaacatgctgagttagtagtcagaaatgtgtagggtccttttgttttatcataccaagttgcacacgactgtgttgtaggcatttttacctttgggggtaaaggatatctgaactttacatggaaaatttgaataagttgttctgctatgccaggcactatttgacttgaatctcctatctgtgcacttcaccataaactatttgacttgaatctcctatctgtgcacttcaccataaacctatctgtgccaattctcattgcagtgagccagttatcagtgcagcttaaataacattcattggttttggtgctcttttaggtgggcacgagctgagcaagaccaccggaaacgctggtggccgtgttgcttgcggtaagttcagaggccgtacaatccagcccacctgaaaatcagcttcgtgtcacatattgatcgactcaccacttcatctccttttctctaattctttcccaattttacttcagggatcatcggacttcaaggctgaaacctggaggtgtgaactcaccttccatctcccagcaccagaagcctgaaactctacgagctcttagccgtttcgtctttacctgagtggctactctagattctacaataagcacctgatctctgcgcatggtttttggtgtaccattctgtcgcccgcatcgttggcgcccaatgaactatgtgttttgtgttaaaccttaagctgaagggtaccatttgtagactcgatgttgctctcttcctcggaatgtcgttacatctgttcgctcgtttcgtccgtacttttgcgattggtcattgttcgctcgtttcatccctctgcttttgcgagtaaacggaacgcaagtaagattggcaatcagtccccgagtccaattgtgtttcgcttatgcttataagtcaaaaattaaaatttaaaatttaatttggagttgattttgtagttttctcaatgtagtttattttttagtatttgttttttaattgcaaaggaaacgtatataaaagtttttctcaatgtggtgaaagagaggatcggatcgtctaggctattgcccaaaagcgtttttctacggggatacggttgtatttcttcaccgatggctaggccagttgcccggttggtctctgccatccaagtggggcgcagcttaacgcgtaaaagtgcagttgaaacttgaaacgagtcgaatagaacgtgcacagcatgttaataagtacacaagtacgaaacgtaggggaaaaaaaagaacaaaaaaaagatagccgggggcattccgagaatcgaactcgggacctctcgcacccaaagcgagaatcataccactagaccaaatgcccttgtgtgatagattacaaacataaaattatataaatttatcaatgttccagtgaaacatataaccaaaattcaaggacacgcaaacacatactcacctatctgctagtgcggccccttgacacacgttaagaaggcggagaaaatgtatttacgtggatgtaatattggtagacaccagcatctgaatcatacaacgacagtttatacctacgaagtttgacaaatgtcacaactcacaatatcgactcatcaagccggtacgaatcggtaaatcggtcaagcttaaaaataaattgaactgaaattcaatttttttttggtagaaaattttttcgggtttcactcgttttcgtcgataacggagatgtaatcatgtctatgcatcgacaaaaccactccaaagctgttttcagttaccgaattgctttgtaaaccgcgtcgttattagatgatccacaagcattacaagatctgttctaactacaaataaagattacactggaggtggagtcgtcgcaacttcttcaatgacactagcaatggtcgcagtagagctgtagaggataagatttgagagcaaagagcaaatccattgttgtcaacttggctgcgcctgcgatcgatcgttggacgcacgacgagaatcactcaaccttcagttgagccaggaagcttcagccgcgtcaacccttagtcaaaaagtagagcgaaaaatcctgcaaaaatccgtcaaatcctgcactaaactcgtgcacatgagatgatcataagcaagctataactacgccatggtgctagccgtggcagatcgaaatgcgcctagtagaaaacattgcatctagaagggcatgcaagcacaagaaacgtttttgttctctctaaaaataccttgcgtgcacacatgactctgcaatctacatcgatcttttgctgaaagtatatgaagatccacaaggcatttttttacagatcgaggaccggaagaatggactaacgtaagtgttttacgaggaagttgcaaataatttttacataaacctcactatgagtcaacacttggtaaggacaatttttcttcttttctgcaagaagaatcaaatatttagataaaaacgatttcatacatccaatcagggctcgcaatatcatttgaattccgtcacccaaaatttaattttaattcattcatccaatcaatttgaattccaaattatattcagctttttattgattggatgtttgaaatcaatttcaaaatttcccttaaaattcatgaaattgatttcgaagtcaactaccataagacttcatacctccaactagttatgttttttctaaaatcaaaatttcccttcaaattcatgaaatttgtctgttttgttccaatataaaattatgaacacttgtccaaacaagccacacatagctacttacaccatctgtctcaaaataaaccaacttctagatatgtatctgaatataacctagatagctaaaagttggtgtttttttttaagggagggagggaatatagtctatagtcccttgcaagaaattgtgcagggatcaaaatcaattgcactccatatgcattaggatcatgctagttagtgtttatttttaatgaagatgaagacagagttatagcacgaaaaatatgaaattaaactattagtgcatgattaactaagttttaattattataaacttaaataatagatttatctgatattttcaaccaattcctactagtatactccctccgtactcgtaaaggaagtcgtttaggacaatgtttaagtcaaaccttgggaatataagggccgttttggtttgataccaaaatgttgccataccaatgttttggtagtttaaatagtaaatgtgatgatttggtttaaagccaaatatttggtaatgcctatactcaatttggcacaattctagaatgttcttcaccataatttgaaatttggctctcaattggcatcaatccaaagacactcatttacaattctaccctaccaaaatattggtagtgccaaaacttgcctagagtttggcactaccgatatattggtagggtactaaaccaaacaagccctaaatcataaataactctcaagttgttgagtttgaaaaagtaaaaattatatgaatagatttgtcttgaaaaatactttcataaaaatatacatatattatttttaataaatatttttatagaaacaagaagtcaaagttgtattttgtaaatcgtatcactgtccaaaatgacttcctttacgagtatggagggagtatactataaagttttcatacgaaatgtacagtttaaccgtttggatagcgtggtgacgaaagatgaggtgaaatttgtatctttatataccaacagcaaggacagtcattgggacagtttgaggcccatggcacattgctttttcctaatttcggaaccaaatcaatcaggaacatgtgggaaacgtacaaagatgggacgctggaatccaaaagaaaacgtaaccgaggcaaatcccgtccttccttcccgtggccttctagaaggcagcccagccctgcactgcacagctgcacatgccgtttgcctaaccctcgtatccttctagaaggagatcaggaggaggaatcaaatcagctggcacctgtcagtatcataaagcctgctgttttcctctgcaattatgcatgcatatccatctaataaaggggttgtacaattaatagacacagtgttccggctggtcggctgatgccttccgagagcaagtacaatagcagactataaactagctataaacagatatctaagacacaatatgcatatgatagatgagaacatacattaatagtataatatatgtttataggtaactattctataaattagctattaagttgactatagatgatttagagctagtagttggctatactattaaacttacttcgaagaatatttatcatatcgaaatgaagagtaattgtttgcaatttaattaataaattataagttatccatttgtcttttctaaaatataaagtagttatattttaaaacagattgagtacataataatgagtggattgtaaattcacgcagcacgagggaagaggggacgaacagttctctaaatttgaagagtactagtaaagataatgatcaaataaacactataatttcacaaagttcatagtaagagtttgttcatttactctcctctgaaatgtggcaaacattttacctatggactatatggcaaacattattctgctgtacgtgttctaattttttaacccaactgatcagacgagaataatacatagcttttccaccgaacaatggttgaccaatatattgatattaacgacctgctcgaaatataatttgacagcgataagcacacgtgatggtaactccagtgtttatgggtgtcactatgtcagagcttactaaatgcaagattagatggagccgataacaaatggtgcatgtagaagggatacttcgaagtatatagagcattggagcacacttttcacatcccttcttctaaagctgcatctcattaccaaaaagaaaaactgtatctcattttgaatttcaaaataaatttaggcaggctttccttcatatatatatgtagcttccgttgtcaaggtttactttcagatggtgtgttcgactgttattttcgcaatagttgcggttgcagcagttcaaaattactgtagcttacagtgattttgaactgtcacagccgcagcggttgcgatagtcttagctacccaacatggccataatttgctaggaagacaactcaaaaaacctaccaaaaattatttttctgaaaaaaaatcacatttcatttttttgtcttttattaagtcacaatttgtttttttttcatgaacgcgtaaaaagattgcatatcaatatattagaagaaaagagttttagttacataacgcaatcagctagaccggcttatgccagaggaagggagaaaagtcaaaataaaaaaactgaagcttagaaaactacggtggctaaacacaaactccaaacaacggtaaggggccaagctatgttacactcctaacagtccccaaaagcagcaacacattttgttttttgatcactgaacaaccaaattgctactccagcttgaactgcttgcttggcagctgcggccgcttttaattattcatcaggagcaagcacagcttttattatcagttaatattcggcaaaacgtgcatgcatgtgcacgtagtacacagaaatactactaatattccctattaactaccactacttggctaagccaagtaggcttctccacgtgtgtatatatatatgactatgtgcacacgtacacgcccaaacttaaccaaaatccacaagcattttcttttacccaccaaacaaacaaatcgatctcttgtgtctcatggccaccgtgcggccacacccgccggcgccaccgtctccggtgcaggcgccggcgccggcggcgccccctccggtgagcgtcgccgcgcggccgcaggcgccgtactactactactgccacggctggaaggagggcgtggcggagtcgcgctgcccgacgacggatgcggcggcggcggctgcggcggcgaacggtggcgtgatcgagctctcgtcgtcggacagcaacggcggcggcggcggcgccggccgatgggacgatgacgacgacgggtgcagcagctgcgtcgacggcgacgatggcgcggcggccggcggcggcggggcggggcggcgccgcgacgaggaggagaaagggaggagccagcagttcggcagctggtggagccgccatgacagcagcagcagcagcagcttcctctggccgccgccgccgaatgacaacggcgacgacgaggacccggcggcggcggcggcgaggcggcaggaggaggaccgcaagttctgggaggcgtgcctggcctcgggccttccatgaagcctgaaagggtagctatagcaatcgagtatcggatgcgacatacaaatccgtataattctagattgatatattatgatatcggaaaatccgtatagtcgtagattgatatattttgatgtagattgatatattttgatgtcggatgggacgtacaaatccgtatagtcctaagttgatatattctagctggagggagtacaaaactgaccagtaacgtatgtgtgcaatattgcttgttttttgttcagtataaattggttttgtgtttctggattaaacaaacagttttaatcagtaacaaaccctgtggttttggcaacgttgcaagctacaattatgtgagtttggtgcgtgaggtgatggaaagagaacaagggtggttaccttaccttacttagtactagtagttgcttaggaactaacctcttgttgttgatacatagtgcgtgagtgcaatcaacgtgtaggacagattgttcctctccccttttttctttctttcacttttttgcacaaaaagaacattaagaaatttcgttgatatgtaatgcgtgttagcgttgtgttttcccctttacttccttttatttctctatgtaaatagagagttaaattaacgcacatacacacgagtgtacctcccctaacgtaaatcgacgcctaaaatcagattttacaaataaatccacgacaaatttgcatcgcatgcatgtaagtcatgtagctcaatcactaccatgtactagtgttgtcctttgaagacttgaacaagaatggtttgaactttgaacaataatggttggtgggaagcgccaacgtgcttaattttgctgcttccatgactccacccaccagaggcgatggttcttcgatgtttctcattgtctgcgactgcatctggacatctcatctggttcgtctgaacaagaacaactgggtaatcacagtaacaaggggtaagtgaggatacgacgtcgacagaggcgtcggaattaagattcaaagcctaccgttaattttgattaaaaaaaatagtaaccttggattatgtcattatgccttgcaaatgatgcaagggaagtatctcaagtcaggcatggttcaagaagaataaacgaggttaagaaagttaacttggagaagttgaaatgagcaagcggatttgacccaggatttgcattttcgatttcagccaaaaattcggttggaccaaaattttgtgattttcggcactctttggatagttttttttaattttaataaattttgactagatttgaataaactttgaccaaattcaacaaacatttgagaaaatccgaaaatttcggttgatatattgattagccggtgggggtctaaaattaccgaaattacaatcattgatttgaccatagaaaatgtgcatgtaggatcaggttatgtcagcacaaattctcccagcaacggagatgcatgaaacgcacaacctcgcaatgtaaggtcatatgctttgtaacctgcaagtccctgcacattttctcacagttacagggtatcaatggccttacctacaaccaagccactcaggagctgtgcaaatactgcaaaatgtgtatcaagttaaacaactggtaataaagaaacacataaagatgcgatggtaccatccaaatggcaaactgtgtagtatcaagtgaacaactggttataaagaaacgcataaaagatagaacagtaccatctaaatggcatcatgtcttaccatggaaagtgaagcatcctggggacagagttgcttgtaccctccaaaagagaatgggttcctctcatagcatggatgatggagccccaatcaaagaactcttgcaagtaggggagaacaccgtttgtatttgggcaccgcagagtagatagtaatctactccctccgttagccgtttaacatttttcctagtcaatcttctttaactttgatcaaatctatagaaaaatatagtactattttcaacacaaaataaacatattatgaatgttagatttaatgaaattaatttaatattttaggtgttgctaattttttctataaatttgatcaaacttagtaacaaaaaaattaaaccataatatgaaatggatggagtacttagtattttaagcatatctgctggctgtcgcagagacgctcaaatcactggaccagtttgagatgtcggtcgcctgaatgggacaaccgcacatcgctgtcggttggagatactgttctccaattcagaattcagggtcgagcaacttgaatgacatgaactggcaactagaaaaaaggcagcgttcgtttggaggacatcgagggagaaagcatctcgttttccgtacgcacgcttcccaaactactaaacggtgtattttttgtaaaaattttctataggaaagttgctttaaaaaatcatattaatccatttttaaaatttaaaataattaatactcaattaatcatgagctaatggctaaactcgttttgcgtatcttctcaatctcctcaatccccttcttctcaaacacatagtccagcaaaggtctcaagaagaagtcagacagataacagtcgcaccaacaaataagcaatttgagcactgaagaataatatatcttaaagaatcagaccagcaactagatatcatatgctgatatatatgataaaataagttattgttgattcatcttttaggaaaatagtttcttgcaatttctagaattggtaggaagagctaacttactggattttatttatgagagaagatcagcagaatcacatttattctttttgtcatcattcgttcagtgtcattgtttattccatttttgctatgcttttcccttgatggttcaccattcaactggaccttaagataagttctctgcacttttcttgattacaccttccttgttctagccctgaaattacctcccactacctacaactagatgttgatagtttctttaatgactttattataaccgatagaaaagttttttgggtttcaactgattgtcacgccacatttggaatcaaataaagaaggttacttgaatgcttgcttactttattctgtccaaaggcaaatctatagtacagccaatgttttgtatctgaaatgtaaaggtaacctatatacatgtgttggtctcttgattctgtcaagccatcaatctactacctccattttaggataaatgacagcgttgaatatcctgttcaaactttgaccaatagcaatttctatgttgtcattgttggtaggttaaggccctgtttagttccaaatttttttttcaaacttctaactttccatcacatcaaacctttcatacacacaacttttctatcacatcgtatcaatttcaaccaaacttccaaacttcagcgtgaactaaatacagcctaacaatcacactgcttagatttatttcgcatcatactgccataatggtattgtggagttccaagtatataaattcttttgttgaaaaaattgtggtcaaactgtgtatagttcactcaacactgtcaatttggagtacataaaagggatgtagtataatttagttacctgaagcagtagagagcacacacgtggagtacaaaatgatttcaactatgaggtgaaccactgagcaaaatcatcatgaaaaccaccatgtatctgctatgctaatgaagattaaggtattccggagattaaaaaatccaagcacgttggcatgaagattattagagcaagtttaatagtatagctcactactagctccaatttatctatagccaatctaatagctaattcatacaataattatttactatactattaatatatggtcacacctgtcatacacatattgcgtcttggaatccgtgctgcagctggctacagatttgtagcacgctgctcttctctctcatcgtttatctcattaaaatatgtttatagctaactaatagcctgctatctcattacaagcacacagacttacccagtagcttttgagaaattcaatgaatacttgcatgatttcataggattctgtccaaacagtttcctgcttctgtttgaagggtctcagtctctcagcaaatcttgacacagattctggcattgataggtagcttttccacaaagcagaatcattgttgctaccagagtatcaacagacataaatagtgatactgtattactgacctcttctctgaattcacaaaaacaagtgagaaatcatcaacatcatagaagtaaagaaattgcttcccatgctgctgatatctctgtgtatgctcccggatgaatcttcctgtattgactatagtattgcaaatttagcttcataagaaaaacttcaagaatgtttctgtttcttaatgtcaaaagtagaataataacatgatatccccaaccccaccagtatccttttatgttctcagtctagaggaaattcagctcattaagatctcaacaaaaacgccatatctttatttgatctgcagcatgattgtacaaagcagcacagagaatgtaagccgattaggaccggacatcattagggctttgaccacgactacacccccttcagcttgcattatacatgtatttacataaggatcaccaaagaaaatcatctgaagttgacagccaggtccatttgcaaaatggtgatccaaggttttcaggaaattcaccatctgggagaaacatctctacagtagtcgcatacacaggtatacgagtgatgtaatgacccagcagggggacaataggccagaggctgatgctgcatcgtgttagtgcaaatgtattagaaatttaccaccaaagagaagatattgagttcttttagatagagaagggagtgaagaagtcatcagattacatacacaaaagataacagtgtaaagctccatttggcatagcagtgggttatcataatctcgtttagtgtaaccgcttttagtcattttggtgtttgacaaattactttttatttaatccattttgcaagcaataccattattgtgttccaaaaatatggaacaattgggatagttgataacaattttacctaacctaaatctgttctgcgaaaagtataacgatcataggttttcatttccatgacaacttaaaacaaataagcagggcaacaaagcaagcacagaaaccacaaactaatcctttaaaaaagaagagttcgtatatctttgcgcttgtttcattctatgccaggaaagttcactttatacactatattcagatctgaagaaaatatttgttatccgaaaaaggaattaatagttagcgacataagaatattgtttacggaagttttagttgctgtaaataagacatgtatgatgtatgctgacttcacaattctagatggcattttgtggagttcatgaaacatgctttactggcaaaaaaaggaaaatcaatcatctttctttttttttgaacggacaaaaaaaatcaatcatcttgaaaacaagacggtgttccttaattgtcaggattttcatttcatggatacaagatgcggtgtcatggtttttcattatactaaaggcagggtagtctacctcaactatcatcctacacttgtatagaaaataaaaagtgtcaagagttaagacccgtcataaattcaattttgcaatggcaatagatgatctgtcagtaatggtaaaaacatctatagctgaccttagttaattacttggagggagagatttcaagcttgtagccccaaattttagttggtaaaaagaaacacgaatattagaaaatgacctaatatcaaataataagaaggggtgaggtttcgaacccaggttatctagcctaccatcttgtgaagctagccggagcccgaaaaacctttaggtgtttctcaaattatagttggtactcaactgatttatgcgcccaggtggtcagatgctagccagtcctcaagttttaattgaagtctataacaaatcctaatcctgttatccaaggttcgattaagaagacaccaaagaaagaggcaaacaaattgtggacgagccgacggcggcacatctctgagcttgttcacggcaagggtgtagagattggaggaggccgagcgctgccgaggctgtcggccgggtggcgatggcagtgtctcggaggaggagaggctaggaaacccgctctcgctagtccgggcgccatttctttggcttctcgagggagcatggttgcgcgagacataaggcagcctaatcaacacgttacgtcagctaaaactgtcgtagaaaccattaggacccccaaaaaagaagtaaaaaaaaagtaaattacacccacagtacaacaacttgacatatggatgcgatatagtgcaagaacttgataattgaacgtccgagtgcaacaacttgacaagtggttgcgttctagtacaagaacttgacaatttaatattttggcgaatcaatttggctaagcatatgctaggtaaggtttttcacgatgtcaatatgccaatacacagtaatcctatggatattaccttataatattgagtttaatttttaagaattatattgcacatacaatttacattcagttacctttaagaatttttttgttttcttcaccttatcaaatatcaaccgaaatataatagtttctacatccagtttaattgactttcagttattaattattaggataaaaatataaatatgtttatacaaatccacgctagtatattgtcaagtatttaaaattttgaatttatataaaaaaatgctccaaataattaagttatcacaacttcttaatttattgtatcaaaatcgtacctatcttgcaagttgttgcatttatacgatcacttataaagatcttatactaaattgcacattcttgccaagttgttgcactataacgctcattttttaagttattacaccaaattgcatccatctgccaagttgttgtaccgtgggtgcaatttacttaaaaaaaaagtctctttcataatatctcgcagaatttctacatttctgttccccaaaaggggccatgaaactggcatgcaggaatccttcttttatgccaagcaacacggaacgcgaaaaagtaatcacaactcacaagcgcaaaacaagtgcttcattatttgaggaacaaagatgatttttttttgggacatggctcgttcaaagatgtcgtcatgattggtttcaagtgcagtttggtcgtaggatactttagcctaatctaaatcgtcgttgtccttccagccgcaattatcctaaattcccaatcaaaattcaaagccttttcggaagcgacactgccatccactggaagaagaggggaacaaaacaaaaaacaaaacgcagcaagattcctcgcagtctgcatcatcagcccatgccgagccaggcagctgaacccaaaatcattcgagcccgtacgcatcacgcacagcaattgataggttctcaattccagcgaaaactggtcggatcagttcaataagacaaaccactcaatatcctgttcatcttttttaaaaaaaaattcaaactgtttttcttgttttgacaaaatctatccaactctcaatcttgttttgccggtttaccaatgttttccgaaaaaaaaacccggagatatcggttcggtgaccggactgtcaatcctgaacccagctcaccaccaccacttgtaggcttgtggcagcaacaagctgaaaatgacaaggagaaatggaagaaaaaggcagagtctcgctgtgatcacagctcactgttggggagaatgaaaaacggttgtactcccttcgttccataaaaaaccaacatattaccagatatgatactccctccatccaaaaaaaaaaaactaacctagaagttggatgagacataatcttatgtcccatcgaactcctaggttaggttttttttttacggaaggagtacctaaacatatatctatattaggatatgtcacattgatactgatacgttttttatgggatggatggagtactaaaccatttgctaggggcataatacagggatacaggaggaccacgtgaagtttccaagtgattaatgcactgtggatagacaaggatctgtctgaagaaaccagcacggatggatcaggacaggaagagggccatcaccttccccatgaattcatatcaaatcaaaggcttcacatcataaccaccaagtccagttgagataagctcaagaaactatcaagaggagaatatagttatcttaatctaggtagcaaaagcatatggagtagcagtaatcaagagaacatcaactgcatcagctgagagtttttgagctgcaggtcaagtttccagctgcaaaaatctgatgaacacttgacataacagtattgtcacagagcctaccttattcttttggataactatccaatgctgcctgcatcattgactggttcttcacatgaggcagtgaccctattggttagtggagtcaacaagataacaagggtaatatatagtttaccatgacttaaaaaggaaatcctacttaattaacgagagattccagggcacagcacaagtggtctggcaaatcatttagacgccagtggtcaatactatacaagaaccaataacatgccatagcacaacagcgcaactgttcttgggaaactttgtataaaaatcaattcatgcctatacattgagaaatcagtatgaagatggcattttttttttcaaatagacaggtttaagagaaaacaggattgtaagcagttcaattcaaccttataaaacgcacaggcaaatagtaatcaggcagaatatgccaacatggatgacacaaggacacaacctagcattaactagtacttatttaactgaaatttcaggcaacttgcttctatattatatcatcatgcttgctaccattgatcccttgagatttacagctaaaaaaacgtcttaatgacagttgacagaagtatattctgctgtagaacattaagtaatacaacattaagaaaataaccttctctagctatctaaacaagtatcatactatcgttaaccttttatgtaaacagaatagtaaaagaagtatctgatatgaagctgtggaaggatatacttgcaaggaaaagcattccgtggtgatcataacaagccatacattacagattggacgataagatgccatgcataacacccattttatgagcatcttcgattaaacagtcttgaggactccaaccagattaccaggctaatctaacgagagctagagcttgatgatcggaaaggccataggaacgagaacggattccttctcctttgacgtccattggttctcccattgctacttgaactctgactttggttggttgatcttgtgcgcgagcagctagcaccagtagagctctgtggtggcaactcatatcggcaaacagggcaggaattgtgctgttccagccaaggaactatgcaatcagagtggtataaatgcttgcatggcatctcccttgcttctgatcccagctcaaacttgtccttgcagacagggcaatgtgagtctccactgagatgcctctgtgtaatcttcacagtaggcatagcatcaatcgatgattgagtggcaggtggcggccctcgtcgatcattctgagttaattgctcaatcagatcatccagtccaggtccaacaaagtagtctgcaatgtttgctctgcgcatgccaacaccacggcgtccattgatgaatacatcaaaaccattgtcttctgagagatgaccaggaagctggccacggaagagcaaccatggccctgagccaaactccatctccaggtcagaaaatatgtttggccttcctctcacatcaacttcccggttcgttcccgccatgccatgcctcatcacagcagagattgcctccatgataccgaatcttggatcacgatggaaatcaggatccatcccaacaaagtggcgcatgagagcatcaacatcatccatttcagacacaaaaccggaatcacaatagggacactccatatcctggccgcggggcctcacccgctgtctacattggtagcaccagtatgattgcctacctcctgacatttcttccaatcaacgtactgcttccccaaaatccaaaggtgtggtatacctcctccgcactgcaaaaaatggcacaatttctaacatatcagggcaacagctccactagtaatgttacataagcatatcattccaatgcaacttacaaaatccaacaagactgaatacatgaagtttcacaatggtaccaaggcatatagacaagtcaaaaaggcacacagatgggcacctaccatccagtaccagtccaaatcactgaactgtcaaggattacttagaattattcatcaattatcacaaatccgcctaatcgaagtaataattcgctcatgaatgataaagcgattgtttccgaagatataaatttttcgcatgacatttgttaatgaataatcctcctaattaagacatactgcaacatgggaaatttatacatgatccaaactgatgatctttgcctgatctttgcttttttcagataggaattcttgaactcgcaacttctttcagacacatcaggtttccctcttatagagccagggatagtttgtctcacagactaatactagatacttatgttcggttcataggctgcctcacactgatttattcccaaaaaaaaaaaagaaatcaaactggatcaattacactagatgctgcaaccaggctaaaatccaagaacaggctaaattcccactcgcccgtagatcaatcagttcatggtaagactaaaaactctacaacagccaccttttccacacgattcactccattcaaaatgaaaaaaaaaaagaaaaagaaagaaaagaaaactgattgcagataactcccaagattacgcggcccgagcaaacaaattgaatagaaaaaaaacacgcacacgaatagcggtttccgctggttcgattacgataccagataggagaggaggaggcggcggcggtttgtggtggcgaggagcggtgggaggaccggaagaggggaaggcgagatgaactccaccacgaacacacgaacagaaaaggcgaaaaaataatattggaagaagaggaggggatggatccagagagaccatattttatacccactcgagtcgccgagagccccactctcctccccttctcagtgctgcggtggcgcccacgctgtcctcccgggcccacatggcagtggcgtcaggggggaggtgggccccacaggcctcgattcttgagccgcgtcgtccccctcgctttccgccgcgagaaagatgcctcctcgccccgtagcccacggcctgcccggggccagcgcagtgactggcatgtggggccagagtgcgcttcgggcccacgtgtcagtgtgggctttggacatggtgggggtgggattttgcgtcggggacgatgtggagcgggggaattttaaaatattcggagccacggaatacgaggctagatcggccgtcggtgggaggaatggacggcccggatgggatgtcccgtcacgtggttgcctcgtcaagctgtcgagggcggccatttcggtcctcaccgagaaatcggtccgggcaatcgcgcaaatgggaaaaaccgaacttatctaaaaaaccatgttccggttaaccgaaccgcagtttgatcttcggtctaaaccaagctgaccgcgcagtggcactgtggcagatctcgcattggggtgaatctcctctgcggtattaacctctgact

SEQ ID NO: 15292 - DNA, 697 bp, Oryza sativa
  unsure (1)..(697): unsure at all n locations
tgaacctgcccaagcccaagaaggggaagaaggccaagtacagcctcggcgtcgtcgagcccaaggtcggctcccacatctccgaggtcaccggcatcccgtgccagagcaacgagttcgtccaggagcttctccgcggcgtccgcctccacttcgaccgcttcatcagcgagctcaaggtgataaacgattccgctttatcaccacaaaccctcttactagtagcatataacgatttatttgcttcgtttgcttgatagcatagcgactagaatgcatatgtgggcgtttgtttgttcaaagaaaaatgcatgcgttgggcataagttacaaagaaaaatcttgtatgtgtgcttaagttcaaaatctcgtaaagaaaaaatgtatgtacacccgtttgcttattctggttttgtgtgatttactttagaaatcggacttggagaaggcgcagcttggcctgggtcatagctacagcagggcgaaggtgaagttcaatgtgaaccgcgttgacaacatggtgattcaggctatcttcctgttggatacacttgacaaggacatcaattctttctccatgagagtgaggtctggtttcttcttccgtgttttgggttaatatgatgcatttttttttgttgtggacannnnnnnnnnnnnnnnnnnnnnnnnnnnnnnnnnnnnnnnnnnnnnnnnn

SEQ ID NO: 15293 - DNA, 523 bp, Oryza sativa
gatccaaatgaagaaatgggagtttgatggtttccctcaaagcatctaaagtctgtccagctcgagcaagcctatagatatggagaatagcttcaagctgtctcagtacagtttgttgctcagatatgaggtccttgtcttgaacactgtaagaacgtttccaataaattgatcaaaacacagctttaaaaagcataaaggattaatgctcaacttgtgaaaaaacagaagaggataataacctggcttccgaatatctggcagtttccataatttcattaccagaatgaattagagcagcagcacgactttcaccatctaacatactgcgtgccatggcacatattgcatccgacaggcacttatttattgtctgaagtgccatggcaaaagctccaactcttttatgaatttccactgactgagctcatgcagagcgtaaagtgatattagacggatatagaacaactcaacaaagagagtaagaacaaagtgcagaaaacatagacatcttcaaattcat

SEQ ID NO: 15294 - DNA, 7491 bp, Oryza sativa
ctcggtaccccaacagctaaagacatgtatcagcataagactgcccaactgcaatcagccatcaggtacgtaactgtctgtgtgcacacacaagagaatgcttgcgagtggtataacctgctagttaaggtatgtggatgtgttactaaacaggttcttcaaattatttatagtttacttatctatggtagtttagcatcacattttctctgccattatgaagtgcagtgcctacatgctcattgtataagtaaatgcgcaaaagagattgaatacctttgacttgactgcacgcaaggtcccatcagtatctctaacattgtccatacaatttagagcaaccttcaagagatctggcacacaagcttgaacatgcggtgacaagtttctgaacacatcaactgtcacatttggagcctgaggatccaaatgaagaaatgggagtttgatggtttccctcaaagcatctaaagtctgtccagctcgagcaagcctatagatatggagaatagcttcaagctgtctcagtacagtttgttgctcagatatgaggtccttgtcttgaacactgtaagaacgtttccaataaattgatcaaaacacagctttaaaaagcataaaggattaatgctcaacttgtgaaaaaacagaagaggataataacctggcttccgaatatctggcagtttccataatttcattaccagaatgaattagagcagcagcacgactttcaccatctaacatactgcgtgccatggcacatattgcatccgacaggcacttatttattgtctgaagtgccatggcaaaagctccaactcttttatgaatttccactgactgagctcatgcagagcgtaaagtgatattagacggatatagaacaactcaacaaagagagtaagaccaaagtgcagaaaacatagacatcttcaaattcatatggtaaatatctacttctgtaccatgtagcttgccatcaatagtttataaaattatagtcaacggttaaaatgcacgcacatatatcagatttgatgaagcatgtgtgatatgtcctacatgtgacaatcaagacgagtttttactactactatcacaagaaaagagcatttacttgtttacttactttgtcatagaggcctgcctcatgacactgatgggcagcttcaagtaagaattgctgcctgcttctccaatccatcatatacttctttaattctccttcttcccccattccacttggaccaagcaaaagttgaatgccaccatcccttagtaatatctctgtcagcagttgcttcaacattagatttcgctgccgctgctgatcagcattccctcgaccaatccatgatacctctcctccacccattgcagcagcagactgtgcataatactccaaggccaaatcaaggttaccattacgcaaataaatagagccatactgccgtattatactggcagcttctgcacaagcatccatgatacccatcttctggcctgacccaacaccatcagggagaacaccatgatcagataaagcaattgaaatatgcacagcatctacatggtatccttcctctccaacttctttagacaaataaagaattgctggaagcaattggatgcttaacagcagaacatatggatagaccaaggggtcttttccattctttgtataatatgatggttcaaatttgtttaagtaactttgcagatcctccagagtataaggcaccaagccttcatttgaaacattagaagaagatgcactggtgtactcccgcagagctgacaatttgaaccacaagaaatcctctatagtattgaaaagtgttggcagatctttaagcaatctgtcgatttgacgtcgacaaccacagatcatggcataaaggagcaacttcttcctatcataaccaggacggccaggtcgatcacccattctcagcattttgtcacattcctcagaagctgtcagagcagtctctggggatacagcaccattagtagtaatccattctacaagctgcaaagaacatattatttgcatgtatggtatcaagaacaagaactcatcgcaatttatgacatgtcaatagtttaccaggggagcaaagttgaatgcagcacgagatgattgggcaacttgtcttgcctcatcatagtatccggttctcaagcagaaataaatctaaaaaaatgtcaaacaataatacttcaatgttagcagtacaagattaacaagttacatgaaaatcaaagagagagaacattccatgaaggcgcaactgagaaatatttgttgataaattagaataaagcacatgtacccacagaaaactttttatgcatcagatatggctttactttagagtattatagcctacacttgaataaagtaagtcatagaataagccgaattgacctagcataggaatgataccatgaaaagcctaagctagagttgaaaaataatgaataataaaaacactcatggccccagtgttgcactatattcaacacgatgttctcataaaagctccagtattcttcagttgctgcacttactgtattttggtggcacggttttatttgaatgtaaccaattgttttttcatgattttaatatgccattactagacagattgaaatggcaccaattgcaattttgtgttaaatacccaaaactaaaaagggaacctgttgccatgttgtgtccactggtggctgtctacgcagatcagttgcatcaaagtctagcacaccatgatcccgcaaacggacctgccagtcataaggacaaagatgcatgaagctcatgtagaacccaaattgtacagcatcatttcacttgaaaataaaatgatgtacagaaacaatgaaaagggagagaagcatcaaatttaaaacatacccgaagaaatgcgcgaatcttctgaagattgccaacagatccaccaagagcagcctacaaccataaagcacaatcacagcttaattaagatctattgatacaacagaaaagctcttgcatgagtaggtttcctaaaacataagccacatagtaaagtgagagtagggaacatcatttgctaaaagactaatggaagatcacaaccatgtgttaaaaaatcaaaaaataatgaactattctgagttgctcactaacattaaatattatcttccataaatatgcacaattggtagaaagcacatatcacatcacaattcaccttcaggacattcaagaaagaaaattaatgctcaaaaatatgaactaaggtgacatgacacaaaagagtggaatacccataggcaacataagaaaacaggtgtagtaactctcaagagttcagttggatcaacaccaaaattattgtcagaatcttacatgttatattctattttcataaggaattttgaaagaaatgtcagaactaaaaagtatgtgaaaatactcactagagccggatggctattgatggtctcaagtatgtacttttcatgaccccactcaaggtgtcgtctagcaccaatcactagtgacatttttcttgaaatgtttcgatgagttgacccttccccaactaatgcctgaataagacaaacaagaagcaaagtatagctatgagggaataatagataaggatatatcatatatattggatggaaaagggccaacagatgtcagcatgagtgctacacaaaaatcaattttattacctgaattaaatgccacactttatgcatggtcactgattttgtcccaatagcaccaacagataaagactcataagcagccctgaatgctgtagcaggctaaccaaaagataactttaataagcattagcagaactacaagtacatcaatagaatttgcttatgctctgatgataacatgtcgaggctacataaaaaaaaaggcacttgatctatttctcaaattaaattatttggagaatagaactatggatagcaaaaaccacaaattcaatctataaatgaataaatgtccatagagggactaagtaacatgttgaatcatagcatatgagtttaacacttacaccaaaaggtaggctgcgccctctagcatcattaagatctctcacaactgcagcataaactgaagatttgttttcaattatagttttgttaggtatgggcatgacttccttagatggcagaccggacgaagattggggactggaagctgaagatggcatcagagcaggacgagaaatcccactggccatgagattagtgtttcttttcggtaatgtagagagtcggcttagactctgcaagaagtctcgcttctccttctgccaatcatcctacaacatagatgttatataagttgagaaccaaaccgtaaaataatttgaaacattcaccactgagcgacataggagtacaagaccaatataacactgaaaaatgtagacatcttagttacctgaaatggtagtactgtactgttcaattaaatcaaatcacaagttcacaaccctatgacaactgattttgttttctaatgtgcaatgcaataatacatataggtaataacatatacaaacccccagatgatacagaaatttgccgagaaacttttaacatataccaagatgatataagaaagtgcaatctgaaaagcacttcccacaggcttgcaacaactaaaccagatcatatatatatatatatatatatatatatatatatatatatatatatatatatatctactactacttaaaaaataagaggtgctttcatcgcccgtcaaaaaaaccgggtgaaaaaaaaccggagcgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagaaagagacgacgccgccacctctcccgcccccgtcggaccgcagccgcctccatgccgccgaatctggcggaggcgaggtccggcccgacgcccctcccacccccgccgggctgcagctgcctccacaccgccggatctggcggaggcgaggcccaaccagcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtatatatatatatatatatatatatatatatatatatatatatatatatatatatatatatatatgtaatgaagttagcagcaggaaagggtaaacaacctcgagaacttgcatcatataattgttaaaactccttaagttgtccttttgtgcttcttgaatggatgagacgattgccatttcatgaagctgaaaacacatgacatgtttcaggatatattccatgaaattaggagaaaatgcatgtaaaagatgtatgacggtatgaagtgtgcacctgctgcaggtactcctcgacagtagttgcttcagatggaaaaacatcctcaaatgtggtctacaaaacctcaattttaatcactatgatgtatattcaagtagtctagcaagatagagtagaaaacagaaaatatacaataagaagctgcagattcacatacagcaacagagttgtaaatgtattaaggtatactgatgaattaggagtgaattttagagaatgggacatggggcatacatagtgaacagtaaagttatggtggatatataaggtgaagtgcgaaaaatcgtgcgctgttattgagtaatgatttccggtcaagttttttatatcaagagcccgctgatccaagcaaaaaatagtagcatttacccaataggaaaggactgattcttacactattattataatgaatacatgctatcgttatattagctgcatttaaatacacaaagagaacattgcatagataaagcatagaaatatgagctatcaatttcttactcaagtagataactgtatgttaagtttcttctacaatttaagtagaaaattgaacgctaatctggagcagtataattgaaagtataggaccaacgagatcttgctgcacctcgaactctagagtcgtttcttgtttcaacatagttcatgggtaactatttcaccaaagctagctcacagatactaactaaacatttcgtcaaaactactgaactaaactatttactagtaagttaaactgctcttccaatttaagaagacatgatgtattggtaacaaacaccaaactatcatcttcacttcttcatttgaaattgtaaaggatgtttttcaacaatttggtgcaaggaataaaacatggcaatgcttatgacttgttataattttattacgttttaaccctactttgtgataaccctaggttttaaccagcagtacagtaaaatgtctaatctcaaaccggacaaactgctcgatctgataatcagcaaatgagattagtataatatcactctatgaaa

SEQ ID NO: 15295 - DNA, 4430 bp, Oryza sativa
caacgtgcagaaagcaaagcccaaacccttaagtccccagtaaacccccaacaaccgcctacccccgacgaacccgacgcgaagaaccgcgctgcgagcctcgccgaggcaaatcgaaggggggctccggggagaagacaccgacctggtggcggagagcgactgcacgggcgcctcggcgcgcaccgtcttggccttgagcttggtggagagcacctccagctggtccaggttcctctgcgcgcggggacaagcacacgggggaacacgtcaggcggaaaaagctatgccggcggcggagaaggaggaggcacatgcgggggggaggaacgggagaggaaagcggcggcgcacctggaggggagggaagtgcggggtgggggcggcctgctcgaggagcttagtggaggagtggaggagctccgaccacccgcccatctccacgtcgccgccgccgctgctgctgccgccgacgccggccatcgccgccggggggctaggaggagggtttggttggtgtcgtagggcgtggtgcggcggagcggaggggggagtggagcgggtttttcctttttcgggggtagggaaaagagggctttgttcttgttgtagatgggcctgggcctaccggctcttgcgaatttgtgcccgattcaggtcagatcggcccatcttctcttctgcatttttttttaattataaattgtgtctatggtatacgaacttgtgtgatggttggaaggctgtgtttagttccacgttaaaattggaagtttgaagaaattaaaacgatgtgatggaaaagttagaagtttatgtgtgtagaaaagttcaatgtgacggaaaagttaaaagtttgaagaaaaaagttggaatcaaaacaggccctaaatcggtacaataacatgcaaatcgtttggcccggtaaaacaacttgcttcgtcagtgcgaattggggtcaaatctcacagtgaaaattcacttcacgtcagtttccacgtgacacagttcgattgcatattgcttttctcgaatgcgtctattcttgtggtggttgtggcataaaaactactccatccgttttaaaatatagcaaccttatactgaatgggacatatcctagtacaacaaatatggacatactcatgtgcaagattcattatactaggatgtataccatccagtataatgttgctataagataattattatgtaatgcaaaactagaaattaaacatcaccaaaaaaaagtttgagattatttgcaaaagctaccagaacagatgaaaacaaatggaagcaagctgaaactaaattgtgctgcatggaaaccaagtcagcgatatatcagttcatttagattgtgacacccgatttgtcctgaatcttgattcgcatgaattcagcaagttattgtatcggattaaacgattcgcaagttgttataccaatctatacccaccacacaacgcaagttagtgtaccgtggtgtgtaatttactactccctccatcacaaaatgtttgacgccgttgacttttttaaaaatgtttgaccgtttgttttattcaaaaaatttaagtaattattaattattttcatatcatttgatttattgttaaaaatatttttatgtatacatatagttttacacatttcacagaagtttttgaataagacgaacagaagtttttgaataagacgaacggtcaaacatgtttaaaaaaggcaaacgccgacacgcctgctcactatgatattgtgaatgtggtgtatagcatatgcgctcttaaagagatgaagatcagcaacaaataactaaccttgctagattcttaaaattcttattgaaagtagactgggagtccgcattttcgtttttgtttcatttttgaaaagcttctgcatgctactacgatgctatcaggtaattgacagttcacctctctctcataaaaatgaaatagttcaaactatcatatcaaaaatgttgtgtataggttgacgtgaattcaagttcaaattaacaataaactttccccgagaaataagagcaatgattcattctaaaagaaagaaataatattgattataagcattaaaggtgtaccatctttgctgcagtacaactggaaaattcaggtcaccatgcaacagaccaatcaaaacacaagatttgctttggatcgatgaggaatgattacacaggttgcaattgaagaaaggtgttacaatggaaggggatgtcctgaaatgctagagatctaagcttccactcaaatgaatctaacaccaaatgcaccagggctataagaattgaaaaacagaacctaatgtacacaggtaaactacctgagctccctccacagcctatacaaccgatgttcgaaaaataatccaatgacaataagtcaagaagaaatcaagttatcatcgcatgcctcgtttgcgaaacagcgcatggtagctgctgaggagtattttctccataactgaagactctgtctataaatattactcttcagttccttttccttaccgagcacgggcagtggatggttgttttgatgagcggccaaacttgtgtttccatttctgtttcccaactgcagagagatcagccaaaggaccggaccaagtaggaacagagcttttctcttgtgtaaatacagtgctaaacgaagagggatcttggggttcgtataacgggtccatgtgatttgtagaaaccaaagagaccgcaccatcctgatgcggaggaggaaacttttcactcttgctttttgcatttgcatgtgttactaatctccttttctgtaagatataaataaatgggacaaattagagacattgcaaaattacattaagagagtgccgggctccattttgggccatagtaaatcaaatgagaccagtataggtaagacaagaaaataaagtggtgataaagtgttactgcgacggagatgagactaagcaagtggtttcaccacctccaccttaaatttagatcgctagcctagtctttaagtaaaacagctcaaagaaacaaaaactaaaacactactggaattagtcagggagcaagtatgttcacatacatcgatatttatttgaagttcagcatttgcctctggagccggtactgccctaggtcgatcgcgcgtctttgtcttcttagctccatcattagtcctaccgccagcagctctcaaactgttgatcatgccatgaataggtcaggtagcaatcaaatatttctatacacgctcaactcacatgagagcatggacagaaaacatgaatcaaacatcaaatatactaggatatgtgggcatttggatcacttagtgagcaaaaattctaaatagctgagcccagatggtgagagactgactatcagcccaacgatgaggcatgtgtcagacaaattctgtgaaatccagggacattagtaccacagcagtatgtctacttaaagtttcacctaaatcagcacttgcattgcactaaaattacatttgggcaatgctttcataatttgattatatataactttgctgcatgaacattgtgtgccatctctttaggatatatttctatgctaataatattgcttacgggaaaaaaaaacatccatattaataccaaatatcaacaaacttttggtgaactttactgttttagcacttattagtcattttcttgtaatccgacaaaagagagtggcttccattctttttataaaaaaaacaaaagaaagagagagtggccctgttatctgaagacagcactttgtacaaatgtttctttcgaaaatagtgaaattgtttttagtttattgaactattccatatgcatacccaaatattagaataaatacatgttttttcttgtcgtaggtattaaacccgagcaagcactcaagtatccaacctaggtccccagaaaaataatgtgccatttgataagcaacagttatatgtttaaagttaaagatgctatttctcaaatgccaatttaaaaagaaagtgctacaaccacagagtgtccagtactagagagacagccaaggaccaaagcgaataacaaacaaataataaaactaatgagtatcaaggtgacaaaccgtctggcttcttcatctcttcgttttgcatccatttctttgcttggaggatatgctgggagacttgatggttcacatgcataaggttcagttgtaaagaactgcatagattgtaataagcaattctttagtaaaagtgtaaaacaatgctacataatttcaacaaagatgacaataaacagatctacttcacacattatccagtgagatatgtcattcaaaccaaatgtatgctattgaaattcgaaaatcagacttgcagttatagagtgctactatagcctagattgataatatctgg

SEQ ID NO: 15296 - DNA, 1788 bp, Oryza sativa
caatgctacataatttcaacaaagatgacaataaacagatctacttcacacattatccagtgagatatgtcattcaaaccaaatgtatgctattgaaattcgaaaatcagacttgcagttatagagtgctactatagcctagattgataatatctggtaggaagatgcttccatgctctttataaatcaaaaaatcatactttattaagcaaatagaaggcctaaattgcagccacctctaaataagatacaatggtccaaatgagatcacaagcatcatagtgtcatattgcacaaaagaattagtcatgtcatacttcttggaatatgggataggatgcagaaaaaatatagtggtcataatgcttgcaagtaaattattggatattggctaaatctacactagtagctacccagaacaaaatctagccaaagcaccatgttctgaaaccccaattgcaaactaagttattgcaatgaaaacgtaaatcacctacacccaagattttctaaaaatattgtgcttatagagggcaatgactttgaggcaaacacagaatcgcagatttcagaacttcaaactgtgtcgtaagacaccaaagccaacttacatcacttcttaatgcagaagtcgctgttaaacgatcagctggatcaattgcgagcagtgtttcaatcaatcgcagtgctgactgtggaaaatctttgtaagtctctgatattcgccttttgtatggttgttgaggcttaaatattgttgcatgaggtagcttggactttttccaatattcttctgtgggggagccgcacagcttaaaaattttatgcagctgttccacctaaaagggacagatgattattaaattaaataaacatggaacataaatacaattggcattcattagattggctggaatgaacaacattacgtgcatgaacagtgcaacaggtcatattggatctagcataatctcaagtacgaataaaaaatatagtacaaaataagggttcctttggaacacgggattgaaaaaacgaaggaataagaaagtcacaagattgcaaaacacgggaatcagatgagtgagatagaatcaaaaagaaattttccaagaggttggagctcttgctaattttcctccgaaatctccataggattgtacattccataggaatttcaaaggaaaagataggatttaatcctttgtttcaaatgccttcctaggattttttccaataggatcgaaatcctccatatttcctatgtttttcctacaaaccgaagggggcctaaaagtgtaatacgttgaacatgtggtactacagataaagttagaacttttggtagagcaacgtttccagtttccacatgaaaagctactggttttatcaaccactatgtttacctaaattgaaactagtttagcactccaaggcctccgaccaaattgaatactgtttcaaggcatttcaaactgataattagacaaatcagcatgctgttgctaacctcagtacggcctggcataataggcctcccagccaacaactcggctagaatacaccccgcgctccacaggtcaacgcccaccccataatccgtggagcccaaaagcaactccggtgggcggtaccacagcgtcaccaccctgctcgtcatcggctgattcttgttgggatcgaacaacgacgccaggccgaaatctgcgatcttcagcatgccattgttatccaacagcaggttcgaccccttgatgtcgcggtgcagcactccattgttgtggcaat

SEQ ID NO: 15297 - DNA, 770 bp, Oryza sativa
  unsure (1)..(770): unsure at all n locations
nnnnnnnnnnnnnnnnnnnnnnnnnnnnnnnnnnnnnnnnnnnnnnnnnnnnnnnnnnnnnnnnnnctcctcttcacgcttcaaagcttcagccgcctccttttcttctcttttcctcaattcatactatgaaacagacaaaaaaaaaagatatataactcccatcataagatcgcataagaaaaatcagcaaaaagaaaaacatgtgctatgcaaaacaatacaatacttggtgctaatttttaagttttaaccatgtatatagaaattaaagtggcttggaacgactggaatacatagccatatataacccctaattttaagtatttaaatagtattcagccccatatactgttgtttggtttcagttcagtggcttggaagaactgaaatacatagccatatacaactcataagtttaagtatttaaatagtattcagccccatatactgttgtttagaaaaaaaataaaaggcaataattccgaatttggtttcagtggaactaaaaaacaataagcttaagagattaaaaaaaacctgctccttgtcaactcgcttccaaaatatcaacatatccctagccagcctccgtgtacgtatggcggcactcctcatcaatttcagtgacctgcttactttgaactttacctggacattttaaacacaaaactcaataaagctgcagcattgctattaactcagcaagatcaaaaactagagtgaaccaaactacaaaatagccaacaagatagagaagtgcaatacct

SEQ ID NO: 15298 - DNA, 190 bp, Oryza sativa
cgaagaggatgtcggggtcggcggccgccgccgccgcgacccaggcggggagcgcggagccgtgggtgtcgagcgagacgcggaggcagagcccggcgtcgcggaccatggcggcgacggcgaggtaccctgcccacccgagctcgtcgccggtgggccccggctgcgtgacggcccacgagaccggcag

SEQ ID NO: 15299 - DNA, 647 bp, Oryza sativa
ttgagttatacactctccctagcccccagcattgtcatcggagaattcttctcggaagataaggctcttggacctttgacctgcctcggttgaacaagcactgatcctagcccccagccgtgaagttggaaagtttatttccgattacacggcttggttaatacgcatggcgagaactcttacacgaccagatcttacatggtcttttgtctctacaggatccgacaaggtcttatcggctctgggcggacccagctgaagttcccttaggttcctcggaggccttgttaagacagcgtaaagggacatgagggtaggtttcaacgctaggtgtaatctaggtaagggatcatcgggaaggaacactttgattttggtctggacctgaaaaataggctttattgaagctgtaagatgtcttacaagtatggatactatcgacttatacatagaatttacgtaattgatgaatgttccaggaatttgccaactcgcgacaatcgccatctgcaattttgaatgcgcctggccgcagaacttgtgtgatcgtgtacggtccttcccatttgggtgagagcttgtttcgccctgcttggctttgaacacgtcccgaggacgtagtctccgatcgaaagcgtgcgtgctcg

SEQ ID NO: 15300 - DNA, 511 bp, Oryza sativa
aaatttcgtgaccgggtttttcttggcgcggttgcagcctgcagatttgatagattggcagacaggtgtggattacgagggggaatcgagcgaggaggaagatgtcgttcaggagcctgatccaggagatgagggacgagttcgggagcatctcgcggcacagcctgcggtcgcggtcccaccgcggcggcggcggcgcgccccgggtgaccgcggtggggccggcgtaggcagccgcgatgcagcagagctgctgggcgcagctgccgcccgagctgctccgggaggtgctggtgaggatcgaggagtcggaggtgtggtggccgtcgcggaggaacgtggtggcgtgcgccggcgtctgccggagctggagggggatcaccaaggagatcgtccgcgtcccggaggcgtccggcaagctcaccttccccatctcgctcaagcaggttcgcgctctcgtttcattctgaaattaccggttacgatgtcgaactgttagtaatttgattgg

SEQ ID NO: 15301 - DNA, 2494 bp, Oryza sativa
cccggaagaaaaatgcaaaaggaccgctgagtacacttacattgatggcaacgtcgcgctcggctgcccctttctcgcaaagggggacttggacgttgctcgccgttgtcgggccagtgatcatcagttggtcgacacggcgctccacggttgcgctgtccaagcctgtagatcgagaccagaatccgataagtcgggaagaacacgcacataagggagccaatttaactaaaaagaaaaataccccgaggagaaacccgggtcgcgtcctccggcccagaataatcaaaggctggatgggctcgagcctggagcggctagatccgcctaccaatgaagtcggcagcgacttcataccccgacaatccccgtactcggaggtcatcaatgatatcgatgaaagattggagggatggggtcaaggcgagtttggcggtccaagatgaaatcttgtctagttgctcctcaggaacaataaaaaccggatccgaatcttctatctgaagatagaaccacctcccccgccatttgctgcgagatgaggggcactggaagaggatgtatcgcgacttcaggccatcccgaagtcggaaaccgacacatccagacacctttttgggttccatccaactcaactcatagtaaaagcggaagaggtcaagaaacggctctaccccaatgtaggcctcacaaagatgcgaaaagatactcatgaaggcgatggaattggggttcaaatggagcaaggaaagactgtagaaattcaagaccaagagaagaaattcagaaggcggaggaagaaaaccacagagaataaagtcctcgatcacaaccatgcgacctaggacaggttggggttcagtacctcctacttctctctccgcggtcccgcgaccgggaagggcgccatcctcctgcaacttctttagcgacgtgctggtggaggtagacttgtcgagatccattgccgccggggatcgccggagaaaggaccgagatgagctagctagggttttttgcgggagcggagaagacgagggacgcttgggggctggagagttttttcacaacaggcggacttcaaattggatccccaaaactcccttaaatagacgcacttccgacgggtgcgaatccaaagaaaggagaaagatggccgtccgaaatttctgggtccgttacgcgcggcagtttttcggacttcaatttaaattcactcatgaccgttgagcttcacctggcgttgtcgatcactccttgtctctcagtcctcacaccgagaacgacgacaacttcgacatcagaagtcgcgatcggtttcacgagttcatataagcagaagtcgggggctactgtcagggttacgggtaaggtataccctttacccttcgatatacgtcacatattgatatggtatacttgcgcgtatacggacgttttcggcatacgttaaggaaattcattatggagttcacagatggaaggagtcctactcggatagaactgggtcgtcattgtatcgtatcgggtccgatgtctccgagtcttacttggagaccagttgacctgtggtacaaaagggaccccccggggaggaccttgggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactggattatggctattacctatcaaggggcctgaaccagtataatctttgttttctgcctactcgatgtcgtattacgtagatcctcgtaccagcgtaccccaataccctctatatccggtctactggtaacccccgtcgacaatttcaattataacaaaaatgttgcaagaattgagaacgttgattatctaaaaaaaattgagaacgttgatatttagagccggcttttggcatacctttatcctaaaagctatatatcttaattttgaatttaaaattacattttggttgccggccttatttccatttttacaagagaatgacttaaatttaaaactgatatataattgttataaaaaacatattttacaattttagatattaaaaataactataaaaacaaagatatttaaagaccccgatgaaattgacacttgtctttgctttaatttggactcattgtgacaaactgaattgaattgtttgagaagcgatactttttaaaagccaccaaataggacttggacaccctactccctactaagggtggacaaaaaaaaatcaagaccgaagaccgacaatgaaaaaaccgtatcacgattaaaaaaaacagataaattagtcactggtctcctgttcggtcttagctgtgagaagaccaatcaaattctcggttcttagctcttatttattggttacccggatggccgaataagac

SEQ ID NO: 15302 - DNA, 458 bp, Oryza sativa
gctgcacacgaccgtgacgcaacggcgcgggcgggcgcggagtacgacggaccggcggccggagatggggcctggatcggcgacgaaggaggtggagagcgaagtggaggccgggaggtggagcaatgtggccgcgggagcgagggagaggagggtgatggacgccatggcggtggagcggagagcgcgcctgagcggcttgctggtgtgggtggatagaaggggataattggggaaggacacgagggagataagacggttggataaatgggccatgaatccaattaacccttgggaatttgggcctcttttccctctattttgtgaatggtttcgtattactcactttgcttcttgtttattaaaggattttagaaggtttacaaaagtttatgaatagaatagaactgaatttatcttcttaagaaatggggtaccgagctcgaattcgccctata

SEQ ID NO: 15303 - DNA, 370 bp, Oryza sativa
  unsure (1)..(370): unsure at all n locations
nnnnnnnnnnnnnnnnnnnnnnnnnnnnnnnnntttgcgaaaatgcattatatatatctgtcgtacataaaagtaccggcaaggtgaaaaaaaatatagtgaggtgttttactagatgctttgttttgtgcaatctaactaaaaagtgaagacaaaaacgaacaagtgcagatacataccacgcccttaagaacaatatcagtttctgaatcattgttttggtacacaaccccagggcagtcaatcagaaatattcttttagtcagagtaatgtactgccacaccttcgtctctccaggaattggagccacttnnnnnnnnnnnnnnnnnnnnnnnnnnnnnnnnnnnnnnnnnnnnnnnnnnnnnnnnn

SEQ ID NO: 15304 - DNA, 511 bp, Oryza sativa
tcgatgccgtaggcgtggaagaggccgtagccggacgccgactcgaagagcaagtacagcgccatctcgccggcggcgtcggcggcggcggcgggttgaggtttgggggcggcggcggaaggggggttagggttttaggggagcgaggggaggcggacaacggcgcgggggtggatgatttatggctcacgctgggttctccgcagccgttggatcgcgatcaagccattaggtgattattgccccttttttttctcatttctcttcctctttttcctttttgtttgatgagggtccttctttttccttattattgcatttttttttacaatgatttgaattattgatgagaaagtggttggttggatagtaacaaatagagtaattttcactttggtcaccttttattactactggtgttttgttttggaccacattttaactaatgtttttactttgatccgggtaattttgcatttatgttattttggaccacccttaacttcttttt

SEQ ID NO: 15305 - DNA, 695 bp, Oryza sativa
  unsure (1)..(695): unsure at all n locations
tatagggcgaattcgagctcggtaccccaaagataagcatggctagtcccctacggtatctacggatactgtcaggagagacatagcgctgtctttgatctcgccggatgcggattcgaggaggaaggctaccctgttgtcgactacgagtcagcacttcagatcgccaagtcgacaacagttagataggctacctcaaatattatactggtgtgattatggtgcataagagcaacgaccggcttcagccaaccggagtagggttattacctgacaattcaggggcccgaacctgtataaaatcctcgcccccatctcttttacctcaatctcgcatatatcctagtaccaatgatccccatactatgcaaataccgtagtcgtgacatcaaacgtcgacagtattgaaatactttccgagtatatgaatgcgaattttacattatgttcgtgttatattgaatatactgctagcttatctgggagatgcgttggtacgggtataatgtttggttatgcaattactctatgtcatgaagatgatattagagtagtatctagtagtttaggcgtggtgtctagattacgggatattattatttacggttatatgctgcggatgagaggtgggccgannnnnnnnnnnnnnnnnnnnnnnnnnnnnnnnnnnnnnnnnnnnnnnnnnnnnnnnnnnn

SEQ ID NO: 15306 - DNA, 668 bp, Oryza sativa
ttcttttactgggatcaattgctttccgtattggatacttggaagtataggtgctttagcacacaactgaacaagtgaagaatggagtacattttacattcgctacaatatttttttcacctttgattctcccttgatatgtaaatgccattaatttgaggaattgatgctggtacgcagaaactcgcctgtttaggagcaaaagctttcgtatcttcgttgttgctaatttcaagtccacataatctacaaagagtttccaggtccagctcctaaagaagttccaaaacaagaatcaacatccagctgatgattttagaactgttcactaaagctgcaactaaaatgcacaactgcagtaaaaatatatgtcgaagggtggtgtccgcgtacctcgatcattaggatttctgataaatgtgtcaaagggtggtgttgaagtttgtagccactatgattgaagtacattaatgctctaacacgagcctttggcagcaaagcaggcaaaaaaaattgatatgtcagaacgaaatatatccagcaatattaaagcttgtgaataaagaaatgtgctggtaacaaccactagcataacacaaacttgagataattctcattcatactgaaaggatcagaacacaattttaaaacgggtgaggaaaatttaa

SEQ ID NO: 15307 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnncaccatgttaataatatggtttactttagttgaatttacctccattctgatgtcaagtttttacatgaactgctgatgcagcctttgctgaactttaaggtccccttgccggaagatcttgatcgctataggcgtagtagcccaaatgggagtatgagtagccaaggtaaaggctatttaaaaaaatccacctcctagcattgacactccatcaaattgtggtcttgccatttctttacatatatctacttctgtgtttgttctgcttaccctacttttccttttaggtcaagggtccttgtcagaccagtataatggaattaatgatgcttcccatgggctacatcggaagcgcaaaaggaatctggatggtgctagcgatgatgatgaggtagatgcctacagtaaccaaataactgaggagcactaccgtacaatgctgagtgaacacgttcagaagtacagaaggtcaaagtttaaggaggatgtttttagttctgatcctcctcaggtgatagttcctcagaaacacaaaaatggtagtgcaagagttacaaagtacagaagtgatacaaggaatgttgcaatgttgggtggggtagaagccacagctgagtataatgggacaaaatctactaatgcatatggtggtttcaataaggttgaagcttcactggattcttccta

SEQ ID NO: 15308 - DNA, 477 bp, Oryza sativa
  unsure (1)..(477): unsure at all n locations
nnnnnnnnnnnnnnnnnnnnnnnnnnnnnnnnnnnnnnnnnnnnnnnnnnnnnnnnnnnnnnnnnnnaggagcttctccgcggcgtccgcctccacttcgaccgcttcatcagcgagctcaaggtgataaacgattccgctttatcaccacaaaccctcttactagtagcatataacgatttatttgcttcgtttgcttgatagcatagcgactagaatgcatatgtgggcgtttgtttgttcaaagaaaaatgcatgcgttgggcataagttacaaagaaaaatcttgtatgtgtgcttaagttcaaaatctcgtaaagaaaaaatgtatgtacacccgtttgcttattctggttttgtgtgatttactttagaaatcggacttggagaaggcgcagcttggcctgggtcatagctacagcagggcgaaggtgaagttcaatgtgaaccgggtaccgagctcgaattcgccctata

SEQ ID NO: 15309 - DNA, 302 bp, Oryza sativa
ccagcatacaaatggcaccctatgaagcgttgtacgggcgcaaatgccggacaccgctattgtgggaccaagtgggggaaagtcaagtgttcgggactgatatcctgagagaagctgaagctaaagccagaatcattcgggataatctaaaggtggaacagtcccggcagaaaagttatgcggataaccgtcgccgtgacctggaattcgcagtgggtgattttgtatatcttcgggtcacgccattgcgaggtgtacataggtttcagacaaaggggaagctcgcacctcggcatgtgggt

SEQ ID NO: 15310 - DNA, 632 bp, Oryza sativa
tacgaggtaatcccgctgccgcgatcaactgtgtttgatcattacataccgcgccgtaatgatcttaattatcgtcgtgcctaagagcaagtttaatagcagagctcactacttactagtcaatgctataatagcagagctctttacttacttactagttaatgctaaaactaacatgtacagtagattagctataaggttatctttattttcttcatcctctctctttctttcactatgaatttaatatataatatttggagcttgtgtgtagttagcttttgcatgatagccaatactccttacttttgtttatctctcttctatataaatatataacttgcttatagcctactattattcttgctctgagttgttcacgcattgctgattgcatgttgattgctggtggcgtggattgatctctcgcttcgtgtggtgaatccgtccatgctggttgctggaactggaaggctgaacggctccttttgctgttgcctagaacatttccgctgtcacattcctttgttccctcgatcgcacccaaccatttcgttgtccgcgacaatctgttccaggtttcaaccaagagagggcccatggccttcgtaatcctcatcttaaaagctact

SEQ ID NO: 15311 - DNA, 728 bp, Oryza sativa
agctaacaattaaaactaaccacccacgactactatatttcttgaatttattactgatattaaatgagttcattaaagttcaagttgcttaggccaataaaataaagacaggctccgacacagttataccacaaccggcatagccatgccccacacgactccaacaagaagacaaacgagaaagaacacacacgcaagcctactaactgctcgtctaccgctgcgacgggccagggcggaaggtgagcaacagcgcatcctccgtgctaccaacgccggaggtttccccctcctggggaaccacgggcgcaggctcggcacgaggggtctcgacgaagcaggtccacgccagggactgactaacaagctcgggcctggaggtgctcttgcgggcggtgatcttctggctgcggcagacgcttgggacggcagtcctctccctgagcgatcttgagctgatgcagctgcgcctccaccgcatctaggtccttcttgagctgcaggttctcctgacgcagctccaggatcttcatgttgttctcgaccatcccgcggcgcaccatctgatggaaatcgatacgagccgcgtcgtacgcctcaccatgcgcgccaggtgcgcgatggtagcgtcatcctccgagctagcatcccggaaggaggcgtagtcgcgggctcctccgcgactaaggtggtaccggtagggcgagtgctgcaactcgtccgggtag

SEQ ID NO: 15312 - DNA, 750 bp, Oryza sativa
  unsure (1)..(750): unsure at all n locations
gggtgtaaagctgtcttggcttgccttgcccgccgccttctcctaacctatccgattggtcgattgaggcatgcaagaagattgccaaaacaagaccgaataatccttcaatacggatgtaaattcagtaacttggctcatttgtaaggagcgaaatgcgcatgtctgtgaacgtaagaccacttcgtctagggccctatgcacgtcgattgcggacgagtgaaacacatgggaggtggttggcctgctgaagctggcggacaccagaaggcgctaaggtaagtctatacttaggtagtggaagcatgtgtttcaacgtgagttgagctacttaggagttcaccgttgctgaccgcagttagcctggtgtaagcattgtaaatgttttttctctcccccttcttaataaacttcggctggtttttgccttcctgataaaaataatctactacgatccatcttggtaaattagtgtgttatatattgtttcctattatgttatttgtttgccaatcaatcataaaagaggaaggtgctgccaaattttgttatggtttatttgatttttcaattatcacaaatgtcagttatgaccgaaaacgaacggcttggttttgagttttgcttaacgtatctggccaaagaagcaccagcagccctgatttcgatacacttaaatatttaaccaacgtgtgtatgtcaccataagaannnnnnnnnnnnnnnnnnnnnnnnnnnnnnnnnnnnnnn

SEQ ID NO: 15313 - DNA, 373 bp, Oryza sativa
  unsure (1)..(373): unsure at all n locations
taannnnnnnnnnnnnnnnnnnnnnnnnnnnnnnnnnnnnnnnnnnnnnnnnnnnnnnnnttccatgccaagaacatgcagctcaaatgggatttttattctccaagcgacatgagggcgtgcgctgtcaagtgagaggtgcgcggccacattggggaggaagtatcctctttgtgtctttccaggtacttaacgctacacattaccgcgaaacttgtgccctttcagattcctagatcgatctagctggtaagtgaggtcagcaaatatgtcgtcctgtactgctagttgtcttttactaatcgatgaagtaatacgactttagccccttagaaaataaaatgtggtcacctcaaaacccgaattatcttat

SEQ ID NO: 15314 - DNA, 765 bp, Oryza sativa
  unsure (1)..(765): unsure at all n locations
accnnnnnnnnnnnnnnnnnnnnnnnnnnnnnnnnnnnnnnnnnnnnnnnnnnnttaaacaataatacttcaatgttagcaatacaagattaaacaagttacatgaaaatcaaagagtgagaacattccatgaaggcgcaactgagaaatatctgttgataaattagaataaagcacatgtacccacagaaaacttttttatgcatcagatatggctttactttagagtattatagcctacacttgaataaagtaagtcatagaataagccgaattgacctagcataggaatgataccatgaaaagcctaagctagagttgaaaaataatgaataataaaaacactcatggccccagtgttgcactatattcaacacgatgttctcataaaagctccagtattcttcagttgctgcacttactgtattttggtggcacggttttatttgaatgtaaccaattgttttttcatgattttaatatgccattactagacagattgaaatggcaccaattgcaattttgtgttaaatacccaaaactaaaaagggaacctgttgccatgttgtgtccactggtggctgtctacgcagatcagttgcatcaaagtctagcacaccatgatcccgcaaacggacctgccagtcataaggacaaagatgcatgaagctcatgtagaacacaaattgtacagcatcatttcacttgacaataaaatgatgtacagaaacaatgaatagggagagaagcatcaaatttaaaaca

SEQ ID NO: 15315 - DNA, 865 bp, Oryza sativa
  unsure (1)..(865): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttagattgctcgctctggcgtgctaccttgtccaactgcacagtctgatctctgtcaattattgtgttttcgttggtgcttgccattatctgttcaccatctttactaccagtggtgctcagatggtgagaaactccagaacagttatcacatctccattccagcagctcttctttaaaaaatagtgctaggcactcttcaatcgatgcaagagagtcgttatcctttgccttgccataagccatattgctaaactgagctttccccttgtcttctgaagcaccttctacagagcaagcatttttcttggcttctatactaacttggggctcaccggacgtattctcaaaaccagcattgtcattttgccctaaatcatcagccttacttggcgagcgctgttccacttcaacagaatctgcagaatcaagcatatataaggctataatttatctgcatcagcaacaacacacaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15316 - DNA, 10144 bp, Oryza sativa
  unsure (1)..(10144): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttcttttctatgagaggattgaaggctaagatgtctggatcctacagagtagcaatcacaaaggaagcatatgttatcagattaacaagcattctttggacgaccaatgattcaattttaatcagtgtacatatactgacgtaggttcgtgatcaagttgaatcttgttgcgttggcttagtcattgcaggactccaatttgaccgcaacatgtacataccagttgagagaattcggttgttcttgaccagctgatatcccttttttgtccatgagtgtattaataatttatttgaaaacaaacggcatagttggacattttgcattagagaatttgagcaaaatcattatgtaggcacatggacaggttttcttcttctttttgaagtaagcaaaatcattatgtaggcacatgcacaggttttttttcttctttttgaagtagaagcaccggtacagttttgtcgattgttactgttacctgtaattagtttacactaaagtactgtggaaaatatcattcgccatgttgagttttgcctcaatatttttttatggcaaagagacattgtatgcaagatgattgagatacaccttgagaattttgcattcgttgaaaaaaacaaactagagacttgagctggtgattgtttagccatcgatatagttttgtcggatgatctgttatctgcaattgctttacagtgctgtggaaagttcgaatagtatattatccgcttcactttgcctctatttttcttgtgtcaaggtgcaattaaaacatgtctttttagcaagttgccacctgtgttagccctccatctcaagagaaatttggggtctcttaataagtgaatggggcattaatttgcataaaagatcatatatttttgtttgcagctgtacacgatgacggttgcatgtgtccttttatctaccatagtaaagaatagtagtacaagataaaaaggacaataaagaaaactggaggagacaagagagtggatctatcaaaaaaaaaaaaaagtgcattgccactctctttcatctcgaggggtgctaccatgttagctgcatgcattttctatctcatccctctcttctctctagtctctccaagttcagcattgtcactacagctgtgtcttgccacgcctgacacgagtcgacacactgacacgcgtgtctcgataacactgcttctgaccagcaccttcgttgcttgaagcctcattaattttcttctttgacttcatctccaagtaccatcgttttacctgtcagacaagtatcaaatgacttgttctttataaattttgcaagtgtaagagagcctggcatgaaattggtgagttaagagtacattctcaagtctacaacttactttagcgatgtggggttgattcttaagtggaatgtaattgcaattcaagtaaattggttcctcgtccacctgttacataggaaaataagttgattggagagttttatatcattagagttaaggaaatcgtagggtatcctaacctcttccagaatcctccaccttgctttggggtaagcatctaatatatctgtgtctgtttccaggatcaaaatggatccatctttctgcggtagtgtcatcaacaatttaaagggggcagcgtattaaataaaatattgaaacaaaatattttcaaataaaaagatggccggcattatagctatagggttaatacctcgcgaataagattgaatatgtcatcgccccggtaaagaatagcatattcatccttccctaatccttggcataaagactgatatctgtgtagttgagatgataatgtattaaatgagtgaattgcagtgttcatcaaataaaataaaagtatagtccctagtgtccaacatacccataacttgtaaactgattccttgcagccaacaaatcttgcaataagaaatcaaacataacaaatagtaaaataaaaaaaaaatcaaatcatgggatttattgagtaaaatgtttgatgatattacaatcttacttttgcttgcatccctatccctctgtgcagcttcagaattatcactccgagcatcaagggatgaaatgtgtgattccaggtcatcagaagagaaggacttgaccgtctcatagatgttatcctcgggattagctacccaaccatgcaccaattcgatccccagcacacaaattaagctacgtccaaaagaatccttgaatgatgtgaagctgcaatgaaatatagcacggcatgaatcaaaacaattaaaaagaaatacaaagatacagaagtaatgacaagcaatctacagtaactatttgcacctgtcaagaacaggatagatctgatgagtatctgctgtagaacgtatgaaacatttccagataaactcacagttatacagcttttcatgttttgatttctcgcttttttctatctcaccaagtacaagtttgagatgtgcaatgatcgcgtctttcacctctctctcaggcagaaattggagttttacttccgatggtttcactgcgagagctctattcaaaactaaatggttatagagagcagtccaaagtgaatatcccttgtggcaaataatgctagtaagcaagttctcatgcttgaactgaacaactctatagtgcagtgtctcatcagaagcctgtttcgtttgcaatattgcttcctgatttgagagttttccctcacttcctgttggcttctgaatagaagcttcatcctttgttacatttcttggagcatattcatttcttgaattcaacttctcatagtaccatagttttgcctgtcagacaataagtatcaaatgacttgttatttataatttttttaagtgcaagagagttagcatgaaattggtgagttgggagtacattctcaagtctacaacttactttagcgatgtggggttgattcttaagtggaatgtatttgcaattcaagtaaattggttcctcatccgcctgttacataggaaaattagtagattggagagttttgtatcattagagttaaggaagttgtaggatatccttatctcttccagaatcctccaccttgcttgggggtaagcatctaatatatttgtctgtttccaggatcaaaatggatccatctttctgcggtaatatcatcaacaatttagagggacagcttattaaaacaaaacgtcatcatattttcaaataataagatgaccgacgttatagctatctatagggttaatacctcgcgaataagattgaaggtgtcactcccccgataaaggatagcatattcatccttcagtaatccttggcacaaagactgatatctgtgtagtccagatgataatgtattaaatgagtgaattgcagtgttcatcaaataaaagtgtatagtagtccctagtgagaccaacatatatacccataacttgtaatctgattctttgcacccaataaatcttgcaataagaataaacacaaaaattagtagaacaaaaaaaaatcaaatcgtgggatttattgagtaacatgtttgatgatacaatcttacttttgcttgcatccctattcctctgtgcagcttcagaattatcattcagagcatcagaaatgtgtgactccagatcatcgcaagagaaggacctgaccgtctcatagatgttatcctcgggattagctaaccaaccgtgcaccattcggatctccagcaaactaaataagttgtgtccaccatttgtcttgaacgatgtgatgctaaaaaaagaaagaaaaaaatagcacaacttgaatcaagacaattaaaaggaaatacaaagacgacaaaatctacagaaactgcatatatatctgcacctgtcaagagctggacagatctgaagtccacctggaagagcatgcacaagacatttgcattctttctcggcctcatacagataatcgaaatttgagctccaacctttttcaagatctttgatcttatgttctacgaatgcgatgatggaatatttcacctcttgctcagtcacaaatcggggtgttatcagtggtaagggaatccacgtcagtagagcgaagttatacagagcaatcgaacaagaatacgcctcgtggcaagcaaggccaacaggcttgccctcattctcggatcgcacaaatctatacctttccatttaggcactgaaagcttagaattattataatgtagattattagaagtaagctgaaacaaacagatagtttattataatagatcattacaatctataagccaaattactataatctggtaattaatccactctaaaaatattttttagattattaggtggctaagagctatctatcagagaaacaagcagcgaacatcttattcaatgtcgacttattataatccagcttacagtaatatgtctcaataatctatattattataatcttaaaccgaaataaatggggcattagttttctcggatccaaatctacatataaacatatatataaacacacacacacatatatatatataggatacccatatgggactccatggtgcctaggctccaaggtataaaacacacaaattctctcaaatttttaaaaatgttcaaattgtgagtatatacctaggtatatgaatttgattcatacaaatacctaacaacaaaacaactcaaactcaactttatttcacaattcattattacatacctaactaattatatgtttggatattatatacttagaaccaaaatctaacaaaaagaaagttcaaacttgaacttgttagtaaagaagttaatgtttatatctaaatattttaaaaaatttcatacccattaaaattgggtatatactcaatttgaatcttggagcatgcatattcatgtagcaccagttaatttacctctttctctctctctctctctctatatatatatatatatataggatctaggattcgaaatcacatcgagagaaaagagagggagagagaggaaagaaagagagaatcggcatcagctagggtttagaaagaattggagaccatcataacagaggccgatctaaaggggcgagaaagatggatatatacataccaggatttggagacgggggcggagcttggatgatgaccggccgccgctcaaatctccgacgcggcaagatgctgagctgctcgcggcggggggtttagggtttaagagtttgagtttgccggcttagcgaaagaatgctaattaacgacgggtttaattagggttttgatcagtggcggcgagtgtgagatatatatacgtatcgcttttcagcggggcagccgcgcactggccccccaaaatggtggggccctccacctacccctctgtgattagggatgcgatcatgcaattagactagagattagcgctacgctgtacgcaaaagccaaaggcaacagcacgtgtagataactatattattcctgattccagctgatcccgatttcttatctcttctctgcaagggcttctagctagctgattggcaattttagtgttgttgattgctttcttctagtaatatattaacattaacgtgcaatcctcttggtgcttgagaaaagaaaatatttgtttggattaatcggtgctaataatttaagttgtataatctatatgagttcgaacactaatacattatttttacaattcttagtccattcttcacattatgtcgcctcgaaaataaatgattaaatgagaaggaatcgttagatgtttttatgaaaagcgaattgctagatgagattactatcaccaatgaattcgcgtctaaaaatatctcaagaaatttgcaatgaaatatttgtgaggttcttcatataaatattgcttttggatgaactttaaatatttacaagcaatatattcatatatgtatatctatattatttattttttgtatgtgatattaagggccccgtttatagtttcgccctgggccaccaaaatctcagggccggccctggcttttctacggtgccggattaagattgggcctatttaatggccgtatttattcaaaactaatggacgtgccaacgcgtgggttttactccctacttcccaaattgatcatcatataataaaattcaaaatttctcaaattgatcatcatataaccgcatggacacgtattttatcataatataattaatacagcatgggagaatgtgtgcatgctaagatgtaattggcatgttgttttaatcgatgcatgcattgtgagagaatgtgtgcatgatgtcttgattgatgtgatttaaattatccttggtcttggtgcataaatatatatgatgatcaatttggaaaggatggagtatttgctatttagtgcttcctaaatagtgaatgaatgaagactattattactactagttctaacaaaaaaaagagtaaagactatttaatggttttctaaatttaacgactagtaatagtatgatcatatagtgtcgattaactttaatgaacaaataatataatctagtcgtagagaaatcttttgagtattgtttattatttaatttcgtatgaaaagctaggagaaagactgattatgcatttgttttatttttcttattattcgtatttaattgacggtgatggcggcggtgggttccggctgccgacctctccctcgagctccccgtaccgacgcacgtcgcgaagctctcgccgtgtccccacatgtctcgttcttcgaccagacacatatagagtacggagagatgggaaagaaaggggagagatggggagaggtagaaccgtggaagcccacttacttgtgaatctttttattttattgactaggatgctatgttagctaaaatagacatcgatactattttaggacctgactcactgttttgaaatgatcaatcgatttccggtattgtggtttagcgacatcaattaaactcgatgtaaagacgagggacataagtgggccttattccaaacgaaaagtattggaaaagcacggccgctaggcctccagttcatgcacggcccaactcttggcccatcatccatgcttatgagcccataccagcccacccacgtttggcccatccgtataagcccaggcaaagtagcaaccgcctcctctctccttcacctcaactcgctccggccagcgaagccgcttcttcttcttcctccaaaaacctctcgtgatctcgtcggcgttgtcgtcgcgggcgccgcagcgtcgatgactcgtcgccgatcgcgccctcgccgattcggagccatccccgcgtattccggtgagtcccccctcgcgcgttttctcccagcaatcccccacccgctgatcgcttcggttttggtttggtcgctcctcgccggaaatgcccgatttctcgttcttgtctctcatccctaatccgcgcggtgggctagggtttattaccggattcttgcaatttttttttattttctggtggttcttcgcttgttccgtaatccccgcgcacagcatttgggggggattttattgacggattcgtgctgatttcttgtggttgtttcggttccaggcgcgatggaagaggagaagagggcaagggcggcggaaagggatagggctatcgtcaggagcccgcggaaagggaaagccccgcggatcgagccgctggatgcggatgattctggatggggcggcgatgcctcgctggaggtgtacagggaggccgcggcggtggcaaccagaggcggcgccggcggcggcggcgagcggtgcgagcacatgacctgcagcgagcatgacgttgcggaaatcgtgtccaagattgcgtcctggggcgacccggtgtgccaggatgaaacctgtatgtgcaccgagaggcacctcatgatggtgtgcgtggaatgcgatatgcatttctgcattggaaggtttgccaagaagtctaagccgcgaggacacatcgaggagcatgcgttcgacgatgggcattcggttgcgctgtggtacgaagatccgtatactggttactgctttgagtgtgaggatcccttgaccattggtggtgaggagggtgataagggaatgaaggtcaaagggcgaggaaggctgtcgcgcatctgggtctgatagtgggcatggctgtgtcatcggcgcatctgggtctggtagtgggcatggctgtgccatcagagggataccgaattttggaaacacttgctacttgaatgcggtgttgcagtgcctccttgtgcttggaaagctgcgggcaaggatgtctggaccggacgctccgcctccatcggggatgcttggtataatactgcatgatctctttgttgctacagaaagtgtgagctatacacgagacctgctggacccagtgatgctcttgggttgtgtgcgccactataaatcagagttccaaggcaatactatgcaagacagccatgaattgctttgctgtttgcgtgatagtttgattgaggaggaaagtaaaacgaggcctgataacatgcaacaggatgctcctagtgctgtggttcctacagttattgattccatatttcgtggtcagctgtttgttaccactctgtgcaaatattgctcatttgagtcagtttcacagggttcacaggatgcattctatgatctctgtgtggcattaccactacagaatgaaagatgcatatctcaacagaagattgccatcgaacaatttccaacaattgacaagactaacaccgaaaagattcatgcaatttctggaggcagtgatcctcaggttcccgcttcagaattgggagatatggtcatggtgaaaacatcagagcctttggtagttggtaagtttatgtgttcctgtacctaactaaataaaggaaaatgatgttgaacaggcctgaaaacgtgcgtgtgaattggaagacggaacattttgttgatggttgcggcaaactgtgatactaccactattgtttgttattttgttgctcaacatgagaaaaaggatattttaggagcagcactcttttggtagctaaatagagaaaattgcttaaggtatgattcatgcatggactgcagaaataccagaaccttcagaatgtcagcattatacaaacaggatgttccagcagtttcagcatggcaaacagtttgctacagtgtttcatcaatagctcagggtgttgaatccttgtcatataattaattttactccgaattgttggttagcttaagtacatgcagagatccttgaagaaaatagtctttcaaataatcaaatgtaggggataaagattctcaaaccatgtagagaacaatggttgctggtttcatgaagttattgatgaggagaatacctaaaacttatatgcttgattctgcagattctaacccattggaccagatcgcacaaagcaaggatgatgtacattgtcctttgcagagtccaataaggaaggagaatgtgctgataacatcagaccgtgaattagagagaactaagagtgctattcttgatagcatcaagccagaagatagtatagaagccaagatggacactttgtcaggagaagttactacagaagacaaggggaaagatcgaaattgtgatgtagtttatgatgaggcagatgatatcaactctcttgcgtcaattgaggagttattgggattgcatttcaaagagatggtagaaaagaggtgtgagaactgttccaatgtcgctcagaaggcaagccctataagtggtaaagatggtgaacagacggtggcatgtaccaatgtgaataggacagttgatggagaccaggctgaacagtcagagaggaaaacatgccaaagtgagcaatctagcgatttggtcagattggatggggaatgcagttcttcaagtagacacccgcatgttgctgatgcacagcatcaagttatgccaacagagg

SEQ ID NO: 15317 - DNA, 20239 bp, Oryza sativa
cccaagaagatgtacctgactgccatctaggtgagaagccagtcaacctgtcgagtggccagtgccaaaatgccaacactgaagatcagggaaggaggaagcaagtaaatctacaccaagtggaagaaaaccaatatgatcagcaagataggaacgaaggtgcgattaagacatctcttattagcaagctgccacctgtgttagtcatccagctcaagagaaatacggggcctattaaagtgaggcgacacgtgagcttcaaggagatccttgatgtgggactgttcctgcaccccaggtactgagtaatttagtctgtccttttttgttgcactcttgttatgagcatgtgggctaccgtatactgtgtgcgcatttgtttttgtttatcgaattgaaccagaaaagcaaaacaagcatgcagccatcgatatgtaaaaatgaatttacctggcatggtgacttggtgagctagttttgtttagtatagaaacaggttacgacttaggatagcattgctttagtttctttctggcaggctaaaggaacaaaaacaaaagaaaccttatcattgaaacatttttttggaggagctccgtaatgtgtgttggctgttgaggcaagttaactgtaatagtgtgtgaacagacattctaaagctgccgcagatgaaactgcatcccctccaacatgggccttgtgtatattatgctctttctaaccctttagaatcaggctacatccatagagtaactctagagtaacccttgtggttatcctcctttttattttattttctttttttttatgaaaatgacatcccgttaaaaatatccgagttagtatgtatgattgctttttgcttttctatttgtaggtgatgtgtaccttgaaatgcctaacctgccaaccttttttatttcttaaaatatgacttgtttgatatatttgtgtttttttaatatttttagtacatgttgggtatgtataaatagttttcagatgattttttttattttttaaaactttacattgttattcgcttaggatgatttatactactccctccattccaaattgatctacatatagttttttttgaggttattcctaaatgatttacatatttgtgtttatttattaagtctattcggtatttgtgcattggagtaaatagacattgatgcatgcatccatgcacacaagtatttataacccacatgtaatatcttgatttgctattggctaggaaatattgggaatggtgcatgcatagagtttgttgctagaataaatatagtatgagagagttattagcttttcttggtcttggtgtacctatgaaatatgtagatcaatttggaattgagggagtagtattttacttaaactgatatattttttgtgagatgagatagatatttcttgttaacaatatcctgttcataagatatgtattaaataatatcaagaaattcatgatgttgtttacatagagctataatgagttacagccttacatctgctttggtccttttttgtttcctctaatcttcagttctgaggacaaagataattccagctatcgtctagttggtgttgttgagcacctgggccatagcatgtattcagggcattatgttgcttatgtgagaccaagtcctccgcagcagactaatggctcttcctcatggttttgggcaagtgacaccgacatcagagaagtctctttagaagaagtactaaagtgcgaggcttacattcttttctatgagcggatggaaggctaagatgcctggaattcagctaatccgaatagcaatcacaaaggaagcagatatgtcagattgtcaagcattctttagacggccaacgatccaatttaatcagtgtagtatgtagataccaacgtaggctcgtgatctagttgaattttgttgctttggcctttggctgagtcagtgcaggacttcaattcgaccggaacatgtacataccaattgagaaatttcggttattcttgaccaactgatcgtattcattttttttggtccatgaggaatggataattaggaattcatttagaaaaaaaaaacagcatagtaggacatgtgccattaaaaaattgaccgaggtgattggataggcattggcacagttcagttactgaacatctgttggatggactccctcctctaaatgtttgacgccgttgacttttttaaacatgtttgaccgttcgtcttattcaaaaacttttgtgaaatgtataaaactatatgtataattaaaagtatatttaacaataaatcaaatgataggaaaagaattaataattacttaaattttttgaataagacgaaccgtcaaacatttttaaaaaagtcaacggcgttaaacattttgggatggggggagtactattttgaaattgctttacagtaccatggaaatttttcgaacataatgtttgaaactttcagctttgcctgtatatttttctggtggcaagatgattgagatatacaccttgaagtatcaatctaaagagctttttttctgtcaaaaaattctaaagagcttttttctttctttcttccattgctttcctgtatggaccgtgttataacatgcaatgagatcctacttctttgagcctcttgctttcaatgttctgcatggatgatgataagtgtataaattgcttgcaattatccacatgtgtttttgttggcaacatttttctccgggacctgccaatttccagcgagcaagtttgcctacatatgatgggtaaagaaataaaaatcatcaaaaaagcgaaaaactagaacaagttgatctaggaagaacacaagaacgaaaatagctttctgagaagaacggccactgcccggtaggactcttgtttatttacggcccatttaccagtcggccaccctcatgggcccattacggcccatccaaacagggccgggttaagtagcaaagcacgcgcaccatctcagcctctctctcttcgcacgcgcgcttcttccccaacctctctctctctctctctctctctcctcccacccacctcggcggttcggcctcggcgtcgcgggacgccgcggctcgcggggcgatcgattcggggtcctcctcgcgtttcccggtgagttctcccctccatttcttccccaaatcccgctgttcttcgccgccgcggggttgatcgctcggtttggtggtgggtggtggtggtgtgggagggtgggggtggggggttttgcttggtgccggaatccgcggcggcgccgccgcgttcgtggttcgtcgccgggaatgttgtgatctctctgggtttgcctggccccgcttgttgagcctggctaactagagttcgtggcgtggttttgtggttgggttggattggtcgtcgcgcctaacggccaacctgtttgatgatttgcttgccttgtttagcccttctcggttcatcccttgttcgtactgttcttcgtctagcttgtttgatttgatgggaatttatggattcactcgatcggttggtggttttgcggtacccgtatccgcggcggccgctgttcgtggtcctcgccggaatttggtcggtttcgccttgtcctattagtagagatctcttggttttccgcttcgtttagctttcatggttcaccgccatagtccgtacaattcatggaaccctcgcctttcggtcaatttcaccgccatagtccgctgtcttcttaaggctccttggatggttcatccctggtagcagcagcagcagcagcagtagtagcagttcgtattcttcttcgtatatcttgtttgattctttggggatttatggattcgcatgtttcaggtcttgcgccccaggcgtgatggaagaggagaagagcgcgatggagacaggaaaggggatgagcccgcagtatgcggtggcgcccgaatctggatgcggcgacactgcgccgccggatgaggtgagcagcccggaacagaaggcggcggcggcgtcgaccagcaacaccgaggggagggtatgcccccacttcgaccctttccaggacggcgtgctcaagttcatctcggagctcaggtcctactcctacgattgcgccccgaggtgtgaccattacctgtgcgagaacaaggtggaaaagagcagtatcctggtttgcatcgactgcgacttgcatttctgcattggggacgggaccatgaacaagccgcagggacatgcccggtggcatgccgatctggaggagcattgtgttggtgctttgctcggtgagccggaaactctgtacttcttcatctgtgaacgtcttctggacttggatgtcagcaacatgcagcgtggagacttctcatgtggcaaggaagaaattgataggatcgagtcagatgtcagctcctccaagaatgctgtcgtgtgccatcatcattcgtttgacacggagaacattgttatcatcaaggatttcgttgaatctgaaaagggtgacccaatgtgtgataatgaaacgtgcctaaccaccggggagcaccacatgatggtgtgctcagaatgcaaagggtatttctgcattgagccagccaccaaggctaagccgcaagggcacatccgggagcatgcattgcttcaggagcattgggttgcagtgtggcacaatgatctgtatgttggttactgctttgaatgtgaagattccttggtcataggtggtgaggagggcaaggagggattggcagtcaacgcagaggcaggttctcatgcatctgggtcttctgacgggcatggctgtgttatcagagggatatcgaatcaaggaaacacttgcttgaatgcattgttgcggtgcctccttgttcttggaaagctgcgggcaaggatgtttggaccgaatgctccattggggatccttggtacaatactgcgtggtctctttgttgatgcaaacagcgtgaggcatgcaccaggcccgctgaaccgggcgttgctcttggcttgtgtacgaaggttcgactcatggttgataggcacttcaattcatgacagccatgaattactttgctgtttgcgcaatagattgaatgaggaggataagataataaggcctccaaacaagcaacagggtgctcctagttctgtggctcctaccgtcattgattccatatttggtagtgagctgtctgttaccacctcttgcaaacgttgctcgtttaagtcttattcctgtgatgtattctatgatctctcagtgccattgccaccaaagggtgctccatccaatagtgttgcatcaccaccacagaatgaaagacctatatctcaatgtaagatttgtgtactttctgaaggcggtgattctcagattcctgcttcagaattggaagatacagtcatggtgaaaacatcagatcctttggaagttggtaagtttatgtgcttgtgtgcctaactaaaggaaatgaaagtgatttaagcagggctccaaacttgcatggtgtatcagaaaatggaacttttcgtgaatgaatcaaactgtgatagcagcactattatctgttattgttttgctcagcattggaaaatggtaactatcagagcagggtcttgtactagctaaatagagaaaatgtctaaggatttgattcatatattaattgcagaaacaacaaaaccttcaggatatctacacaaacgtattaaacaaacatgatagttcagcagatttaacttggcaaagctctgtagcagttactattgccactggaagatatctcagagtgttgagtcctccttgtcctcatctaataaaattttctccatattgttggttaacttaagtacatgctgaggtccttgaagaaaagaagctcctaattatcaaatgtagcggatacatattctgaaaccatgtagagaatgatgagtactggtttcgtgaagttgctgatgaggacataactaaaaattatatgctttattttgcagattctaataaattggaacagatcgtgcaaagcaaggacgctgtacattgtcctttgcagtccccaacaatgaaagagaatacatggatagcatcagtcagtgatgtagagaaaactgacactgctgttcttgataatgcgttcagtgggctaaaagttagtacagaagccaagatggtcatttcctcagcagaaattaattcagaaaacaaggggaaagctcgaagtcttgatattatttatgatgaggcagaggatatcaactctcttgtgtcaattgaggagtgcttgaagttgcatattgaatcagagatgatagagtggacctgtgagaactgttccaaggttgcccagaaggcaagcactataagtggtaaagacggtgaacagatgatggcaagtaccaatgtgaataggacggtttatggagaccaggctgaacagtcagacaggaaaacatgccaaagggagctatctagcgatttgatcagactttctgtagaatgcagttcttcaagtagccagccacatggttctggtgtacaaaatcatgatatgcctgcagtggacataaaaacttgtggagagacttcagggatgagctctgttgaaaaagactcgtcctcttgcagcatagccaataaaaaacctgaatgccttggaggtgctcaagaagatgcatctagctgccgtctgactgagaagcaggccaacctgttgagtgtccagtgtcaaaatatcagcatagaagatcaggaaagggggaatcaagtaaatctgggtcataatgcacaccaactggaagaaaaccaatatgatcagcaagataggaatgaaggtgcgattctaacatgtcttattagcaagctgccacccgtattagtcattcaactcaacagatctttggggcctcttaaagtgagtggacatgtgagctttaaggagatccttgatgtgaagccattcatggaccccaggtactgagtaattttgtctgtttatttttttttctgtgacctttttaagagtttgtggatcactgtatactgtatgtacttttatttattgtttttccaattgaaccggtaaggcaaaataagcatgcttcctgtagccatgttaaaatgatttttcctggcactgtgagctagttttcttaggtgtagaaacaggttgcgacttaggatagcactggccttgtttctttcttgcagactagcatgatttaggttacagaattagaaactaacagaactcattttccagtcatcatggagccatttgttttagagagctttgtaattagttttgatgcaagtggactgaattgcttggctttatagtgagtgaataggcattctaaagatgctacagatgaaactgcatcccctcgggccttgtgtgttatgctttttctaaccctttagagtcaggttacatctttagagtaactcttggtttgtttatatgaaatcacccatcatggctgccaaactcaattcgttgtagcagtttataattgaccactgtggcataccattagaaataatctgaactagtatatgattgctttctgcttttctattttaggtgatgcgtaccttgaatccaacttgtttgatatattttcatggtttttaagtgcaagtgctatgatggatatttttttagataaaggaagcttttaactaccatggatatatgtgaatctatatccaatgttctgtttaaatagctggtcgatgtttaaacacattacatggttattcattcaacatgatctataccagtctttcactcatatctaatagaggtgtattttttagataaggtatagatttctttttaacaatattcagttcctaagatataagatcaacaaagacaagttgttgacatcaacctatgatgagttagttccttgtatctggtttgatagtatttttttaactttctctaatcttcagttctgaggacaaattcagttcccgctatcgtttagttggtgtcattgagaaccgtggcctcagcattcatattgggcagtgcgttgcttatgtgagagcaaacaatcagcagcagggcagtggctcttcctcatggtattgtgcaaccgatgacgacatcaaagaaatctctttagaagaagttctcaagtgcgaggcttaccttcttttctatgagagaatgggctgctaagactgtaagacatgtcttgaattctatacacaccaaagaatccgaagagcaatcacaaatgaagcagatatttgagagtatcaaggtttatttggatggacagtgacccaatcattgtatatactgacgtgggttcgtgatcaggtccagttttgtcgttgtggctgaatgatatttagtccttgcagggctttgccaacatgtacgtacctagttggggatattagctggtgttcttgatcatttgatctggttacagtcattcacattcttttttttcctttgtccatgaggaatatattagggtttttttgaacgaaaaagaaaaacttaaaaacaaagcaggagtaatgaagtgagaaagttgtgtatatcatatcagcattggtacggttctgtgagattgtacttctaagtgcgcacactctgtgagatcgtacttgattcgatgagctttactccagatttttttcttctgtgatggacaatctataccactgttatatgctgcaacatgattcagaatttcagatactgcattgccaacctactgccttttgactctctgggtaaagatcatggcttgctaaagtggtgtcggatgatggatgaaactgagttcttgataataattgaggacatggacggttaaattaaccgttaaaacttaaaagttgaaaaagtcgatttaaataatattctaaaaaatgttgatagagaaagttattacaaaaaaatgcaccatcgttgattgaaaagaacaataccttgtgcattattttttccagtgctcaacagctctgtattttgatctgtgtggtcgatgttgaacggttgatggatttgctcctgtaaacaagaaaggcaggaggcttgcctcagctctcatataattataaaattataaggagcagtatagtagtaataaaagcaggagcaaactttattggcaaaaagttagaaagaagaggagaaggttgatttattcagagagcacattggagggttgacgcctactgggccgggccttgatttcctttcccctgggccctggctattcacgccccatcaaggcagaaagatgcattcacacgacacgcccgcttacgcgttccgcctcccaactccaaagcccatcaccacgccaagtaaccgccaacgccaccctctccaccaaaccagctctccctccctccctccctcggtccctccccttctcctctccaactcctcctcgacctcgtcgtcgcgagacgcccgcggctcgcgcgcccgatcgattcggcgccctcctcgcgtcttcccggtgagatttcccctccatttctccccccaaatccccctgttcgtcgccgacgcggggttgatcgctctgttttttgttgttgttggttgtggttggggtggtggtggtggtggtggtggtagtgggggtaggggttggggttggggttttgcttggtgctggaatccgccgcgttcgtggttcctcgccggaatttccgtggtttccccgcttgtggagctctcgtggtttgccctagcctgagtacgggttcgtgcgtggcgtggtttgttgttggagttggattttggtcgtccctcgcctaacggcggccaacctgtttgatgatttgcttgttccgtttagccttgttgtttcatgcttggtttgtgctgtttttttcgtatggctttgtttgattcgatggggattttatggattaactcgattctttcttgttgttcttgcgtccccaggcgtgatggacgacgacaaggcgagcaaggggaggccgctcaaatccccccgcaaggacctggacccgctggctgcggccacgcccgatcccggatgcggcgagacggctccgccggaggtgagcaagcctaaggagaaggcggcggcgccgaccagcaacaccgaggaagggttatgcccccacttagaacgtttcgaggaagacatggcaatgttcgtatcaaggctcatggcctccaagttcaccccgagttgtcagcgtctcatgtgcgatagcaagggggacaagagcagtatcatggtgtgcatcgactgcagcttgcctttctgcattggggacgggaccatgaacaagccgcagggacacgcccaggaacacgcccaattctacgctcatctggagaagcattgtgttgctgcgttgttcagtaaaccggatactctgtactgcttcatttgtgaacgttgtctgaacttggagatgagtgacatggaggcagaaagtgacagcagcagcgaccaagtgggatgcgaacactttgtattggatgaggaagaaatcactctgatcgtgtcagagatcttcgcctccaagaacgttccggcgtgccaacatcccgggtgtacgatcactgggaatacccatatcatggtttgcacaggatgcaacaagcatttctgcactagagctgaggccatgaaaaaaccgtatggacatgcccgtctgcatgcccagaagtgtgaacaccattgggttggtttgtggtacagtaatccatatatggggtactgcttcaaatgtgaattcgaatggatcctaggtgcaccgaatgctgagagggggatggtgtttggcaaggaggcatttgatcaagaatctggattagcaaagaggcatggctgtgttatcagagggattccgaatcttgggaacacttgctacgtgaatgcgttattgcagtgcctctttgtgcttgaaaaactgcgggcaaggatgttagcatcagatgctccttctgggttcgtgggtagcgcactaaaagagctctttcaggaggtaaacagtgtgaataatgcacaacgcccactgaacccgacgaagttcttggatcgtgttcgtatgttgaatgcacaatttgcaggcagtgatatggaagatagctatgaattgctttgctttgtacagaatcaattggaaaaggaggagaagtcaatgattcctgcagtgtctactacagttgttgattccatttttcgtgttcagctatctgctaccatatcccccaggcgttgctcatataattcagtttctcatgaagtaatgtatgatctatcagttccactgccatcaaggaacataagttgcatgtctcgagagaagattggtatcaaactattcccaaaggttgacatgagtaacaccgaaattgttcatgcaattgctgaaggacgtgattctcatatcactggtttagatctgggagatgtggacaaagaaaaaccatctgagcctttggaagttggtaagttcatgcatcctgtttctaaataaaagaagagagaacatttttaaacagatatgcaggtatagaggattgtgcagaccatatacatcttttgaggattgaatgcaagaaactaaggaatattgtaatcacaccaccattatttttctcatcataaagagaaaacatacattttttttggaatggatccccaattctagttagacagaaaaagttgtgagggcttgctaaacacatggagtgaagaaatatatggaaaaccttcaggatggctacataaaagaagcatgacgtttgagcagtgttagcatggaagagttgtttgtcgtagtgtagcaattaagagcttggagtggaagattgtttatttgttgagtccttgtcttcatacacaaaattttgctctagaaggttggtttacttaatcaagtacggagattctcgaagaaatgcagcttcagatcgtagagaatgaaggttgatggttgtatgttgttgctgatgcagataaattatagccttatatatgcttgattctgcagattctgttgaagtggaacagcactcgcaaagcaaggatggtgtacatgttccttcccaaattcagaaggatgaggtcccaggggagattattcaggcgccaactaaggctgatgatttagggaaaaattacaatgctggtcttgagtatacgcccagtgagccagaagttagtatagaagccaagaaaaacgtttgctctgtagaaggttctgcagaagacaaggggaaagctcagtttagcaatatggcttatggcaaggcgaaggataacaactctcttgcatcgattgaggagtgcctagaactgcattttgaagctgagatggtggaatggaaatgtgagaactgttctgaaattgctcgccgtaggagcaccactagtggtaaagatagtgaacagatgatggcaagcaccagtgagaataaaatagttgatggagatcaaactgagcagtcggacaagatagcatgccaaagcgagcaatctagcaatttggacagtggtgaacaagacttggcctctgataacacagccaacaaaaaaaatgaatgccatgaaggtgttcaagaagttgtacctagctgccttgcagctgaggaactggccaaccagttgagtggccagggtcaaaatgccagctctctagatcaagtaaagctagatcatagtgcagaccaagtgggtccaaaccaaaaggagcgggaggataggtatcaaggtgggattcaaactcgttttattaacaagctgccacctgtgtttgccattcatctgaaaagatcccagctgactggtaaagttagaggacacgtgagctttgaggagatccttgatgtaggacagttcatggaccccaggtattgactattggcatttatgcatgacaatatctatataagcatgtgccagttccaataaatttatgattcacagtaagcaagtagtttttttcttgtttgtatattttgactagctttactaatacattttgttagaaaatcagaattttattatgctttagatatcactgccattatgtttgtaggtggttaagtgcctccaaatgaatttgttgaaatatattggtttggctttttctgattttagtacttttgttattataagggttataatcatataaagcttttagatactgaataaatatcccagcctttgcactggcaaatgcatataatcgtatagataatccttacatctttcagtggtatgttgaaattcattgaagggccttcattcgttaaatgttttatccttgcactattatgcagttttgattaatcgtatttgtttatatctgagagtattgtttgattgcttttgttttctgtaaccttcagttctgaggacaaagacaattccagctatcaccttgtaggtgtcattgaacacattggccccagcaccagatcagggcacatggttgcttacgtgagaccgaatcaagagcaacctcacggtggcccttctccatggtattgtgcaagtgatacaaacatcagacaagtatctctagaagaagttctcaagtgcgaggcctcccttttcttctacgagaggattggaggctaacgtccaaggaagtaaattggttagattagcaaacattctttggatggacaaagatccattcagtagacgtcatgatcaagtccaattttgttgctttggctgagtcattgtaggactgcaaatagatcgcattcataatctcctttttgttcatgaggaacgtacttcttttcctggaataagaatgaaggaataggacatgtgccatttgtaaatgagcaggactgtactaatgattgataatgctttacaataggtctaaaatacagaacgatattacttgatatatcttgagctttagtcccccaatttttttggatgtgcaagctaagcgacatggtttcaggcatataatttcctagatggaccatgtgcagcatgctttgagtacttgcttgcttgctgctttggaagtcccctacagtttctggtgttctgatggatcaaacaagaaaggatgactggaatctctggtgaacaaatcctctccagtctggacggtgttctggacggtggatacttgtaatgtgtttatttgcatctccactttgggacctccagcctctggcctctccgatttgggctagattccgcagaaaccgggccagatcccacaatgtgagctatccagcgattttgaacagaaacccgcagtggacacagataccaaaggatacactttagggatgagttgtggtaggagtaccttgcagcatagccaatataaaacctgaatgcattgagcatgtgaattattgcatactgtgtgcacatttgtttttgtttgtcgaaataaaccagtaaatcaaagtaaccatgcttccacagtggtgcacaaatgaattttcctggcatggtttgcttgttttctttagcatagaaacatgttttcgacttatgatagcgctgtcctgccctttgctctccttttcttttcttcttttttctttttttgccgggtcggtcaaagttgtcagcagtgaggcaccgatctttcagcgcaatccacatgaagaagcggacgcacgagggggccctggagcgccatagcagctcgccgtagggacaattctctgttgccatgaagaactgccctttgcttctttctggcagaatagcatggtttaggttaatgaaatagaaacaaaaaaaaaccccatgttctatctatgatcaaaacatttgtttggaggagctgcataattagccttgaggcaagtgtgactgtaatatcatgggcagtaaagtgaataggcattctaaagctgcagtagataaactgcatccctccaacttgggccttgtgtatgttatgctcttcttaacccgttatagcttagagtcagtctacatcagtagagcaactcttggttcgtttttatatgatatcacccatcacgattcacggttgccagactcaattcattgaagtttatatataactgaccacagtggatattgagctctccgttgcttgtgtgagagcaaaccatcagcagcaggatagtggctatttctcttttttttttttttgtggagaagagtattttttatccggcctctatatccatttaaatatatagtcttaaatcgggaacttagcccatcaaacaacctaatgaatcttttaaattaggaacttagcctcttataaataatctaatttgaaattcacttctaaacttagaacttaaggtcgtgttactcaggaccttggtttggatcagcccagcctgttagagggttgacacctactgggccgggccttgatttcccctcctggctatttaagccaaatggatcagaagcattcacacgcccaaaagcccaccaccacccaacccgcccaacgccacgtcaccgtctccctcccaactcctcggcctcgtcgtcgtcgtcgtcgtcgcaggacgccgcggctcgcgcgccggccgattccgtgcccctcctcgcatcctccggtgagttttcccctccatttcttcccccccaaatccctctgttcgtcgccgacgcggggccgatcgctcggttgttgttgttggtgatggtggtagttgtggcggtggcggtgggggttggggtgggggttttacttggtgccggaatccgcggcggcgcggcgttcgtggttcctcgccggaatgttcttcgtggttttcccgcttgttgagctctcgtagttcaccatagtatgactacggttcgtggcgtcgaggttgttgaaattggattggtcgtcctcgcctaacggccaacctgtttgatgatttgcctgtatcgttaagccttcatgtttcatgctaatcttcgtatggcttgtgttgattcgttgtggattttatggatggataaactcgattctttcgtgtgggtcttgcctcccctaggcgggatggacgaggagaaggcgagcaaggggaggccgctcaatgccccctgcctggatttggacctgaacctggatctgtttgctgcggccgtgcccgatcccggatgcggcgacacggcttcgccggaggcgagcaagccggaagagaaggcgagcaaggggaggccgctcaaagccccccgcctggacctggacctgaacctgcttgctccggccgtacccgatcccggatgcggcgacctggctttgccgggggcgagcaagccgggagagaaggcggcggcgacgaccagcaacaccgatgaggagttatgtgcccacttcgtacgttttgaggaagacatggtacagttcatatcaaagctcaggtcctccaagttcgccgcgaggtgtgagcattacctgtgtgagaacaaggtggaaaagagcagtatcttggtgtgcatcgattgcagcttgcctttctgcattggggacgggaccatggacaagccgcagggacacgcccggtggcacgccgatctggagcagcattgtgtcgctgcattgttcagtaaaccggacactctgtactgcttcatttgtgaacgttgtctgaatatggaggtcgatgacacggaatcagaaagcgacagaacggaatgcagacacttattggacgaggaagacgttactctgattgtgtcagaggtcaccacctccaagaacattccggcgtgccaacatcccgggtgtaagatcaatgggaggacccgtatcatggtgtgcacgggatgcaacaagcatttctgcactagagctgaggccaagaaaaaaccgcatggacatgcccggctgcatgcgcggaagtttgaacaccattgggttggtttgtggtacagtgatccatataaggggtactgcttcaaatgtgaatttgacttgaccctcagtgcaccgactgttgagcaggggatggtgtttggcaaggaattatttggtcaagaatctggattagtgaaggggcatggctgtgttatcagagggatgccgaatcttggaaacacttgctacatcaatgcgttgttgcagtgcctatttgtgcttggcaagctgcgggcaaggatgttagcaccagatgctccttcgtatatccttggttatgaactgaaagagctctttcaggaggtaaacaacgttgataacgcacaactccaactgaaccccacgaagttctttgcttgtattcgtgttttggatgcacggttcataagcagtgatatgcaagatagccatgaattgctttgctttttactcaatgaattggataaggaggagaagtcaatggtgcctccagtatctcctacagttgttgattccatttttcgtgttcaactgtctgctaccatttcctgcagccattgctcatataattcagtttcccatgaagtaatgtatgagctctcagttccactgccatcagagaggcctccgccaaaaagtattgcatcgccaccaagggacataagttgcatgtctcgagagaagactggtatcaaactattcccagaggttgacacgagtaacaccgaaattgtcaaagcaattgctgaaggcagtgtttctcatatcgctagtttagaactgggagatgtggacaaagagaaaacatctgagcctttggatggtggtaagtttatgcattgtgtttctaaataaaaggagagagaacatttttgaacagatatgcaggtatagagggtttcccagaccatgtacatcttttgaggaataaatgaaagaaacagaggagtattgtagtcacaccaccattgtttttctcatcataacgagaaaacgggcacttttttcggaatggagctccaattctagtcaaacagagaaaaatttgtaaggacttactaacacatggactgaagaaatatctagtaaaccttcaggatggctacataaaagaagtatgatatttgagcactgttagcatggcagagttgtttgtcgtagtctagcagttaagaccttagagtggaagactgtttatttgttaagtccttgtcttcatacataaattttgctctagagggttggtttacttaatcaagtatggtgattctcgaagaaaggcagcttcagatcgtagagaatgaaggttgatggttgtgtgttgttgctgatgcagataaattatagccttatatatgcttgattctgcagattctgttgaagtggaacagcgctcgccaagtaaggctgatgatttagggcaaaatgacaatgctggttttgagaatacgtccggtgagccccaagttagtataaaagccaagaaaaatgcttgctctgtagaaggtgcttcagaagacaaggggaaagctcagtttagcaatatggcttatggcaaggcaaaggataacgactctcttgcatcgattgaagagtgcctagcactattttttaaagaagagctgctggaatggagatgtgataactgttctggagtttctcaccatctgagcaccactggtagtaaagatggtgaacagataatggcaagcaccaacgaaaacacaataattgacagagatcagactgtgcagttggacaaggtagcacgccagagcgagcaatctaaaaatttggaaagtttggcactagaatgcacttcaagtaagcaaccacatggttctgattcagaacgtaaagctatgctcgcaatggacagcattactgaaggaatcaacacactacctcctgtcaagcacacatactcattgcgcagccgaggtcgaccaccaagccataacaaaatcacttctgggatgatccatggtgaacaagacttggcctctgataacatagccaacaaaaaaactgattgccatgaacgtgttcaagaagctgtatctagttgccttccagctgaggaacgggcgacctgttgagtggccaggaaaataccagcagtctagatcagggtaagtggaaacaagtaaaggtggatcatagtgcagaccaagtggatgcaaaacaaaaagagcgggaaaataggaatcaaggtgggattcaaactcgtgttattaacaagctgccacctgtattggccattcatctgaagagatccaaggagactggtaaagttagaggacacgtgaactttgaggagatccttgatgtaggacagttcatggaccccaggtattgcatattagcatttctgcatggcaatatctatataagcatgtggcagttccaataaatttatgattcacagtaagcaatttttcttgtttgtatattttgactagctttactgatacatctcattagaaaatcagaattattatgttttagagatgactgcctttttgtttgtaggtgattaggtgcctccaaatgcattttttcaaaaatattagtttggccttattctggttttagtatttggcattagaagggtataattatatagattttttaggtactgaaataaatatcccagccttcgcaccaacatgttttaatggcatgttgaaattcattaaagggcctttattcgttaaatgtttgaggatatgagattcttgttagcaatatgcagcattgaggatatgagatcaaaataaccatgcctaacatctagtttgattgcttttgtttttctgtaaccttcagttctgaggacaaagacaattccagctatcacctagtcggtgtcattgaacacattggccccagcaccagttcagggcacatggttgcttacgtgagaccaaatcaagagcagcctgacggtggcacttccccttggtatcgtgcaagtgataccgacatcagacaagtatctctagaagaagttctcaagtgcgaggcctctcttttcttctatgagagaattggaggctaacgtcgaaggaagtaaatttgttagattagcaagcattctttggatggacaaggatccattcagtagacgtcgtgatcaagtccaattttgtttgctttggctgagtcattgtaggacctgcaaattgactgtaatacgttcctgcccagctgaatagatggtggccggtgttcttaatcagctagtctgatcacattcgtaatctcctttttttttctcatgaggaacgtgttcttcttccctggaaaagaatgaagaagaacacaggactgtactaatgcttggtaatgctttacactaggtagaaaat

SEQ ID NO: 15318 - DNA, 8747 bp, Oryza sativa
ttaaaaattagtaaaacttttgactactggagtacagattagtagtaattgtaaatctggcagagttttttttttttcagttcttgtccaggctccagctacgcaatgtttgaagatctatagtaagagcaggtttacaaaacctcacggttatctcgggcggtaacttttcgcatggttaaaccacgatgtgactcgcggtaatacgtgtttttcgtgatatccgataaccgttaaactgtgaggtgacgagaaccacatccaaaacggtttggtaaataatacagtttttgaaaccatgatatgcctcgcgataacatcgtgtttggtatccgataaccagtcaaactgaggtgacgggaaccatatccaaaacggtttggtaaatccttgagtaatagtagaaataaatcaatatactggctgcagtgctagtgcgttaaataactccaaatttattgctccaaagcttccaattatcaacctcacttcattgtgcattcctatggtatgaactcatttacttccacggagggagcgccatttcaaatgctgattaccctctgatgtcacatgatttggcgaaatttatgaccagaagtcgaaatctcataaatttgcgcgacaccgacgcaggagtacaattagtagcagtatagcactaatactctaatagcatactagtataatctcattctaggggtcctactcatcggcctaatgatgttgacctgataaaaagaattcctttgcactaatcctccctttctttttcttcataataatggactaatgtggcaaagcagacgccaaaaggtttggtcgagagcatccaaatgtcaatgctggggccgtgacagcctgacaggtggtcatatgtatgtgacagagttaagcctgatagagcactgtcgcgatgtgcctatatccatccatctcaatgtagcataattggataattaggttcgattttgggggtattatcttttgaaaaagggtgtgagcagattgccacctccatccattttggtacgaggttgcgtaagaaatgtttatttagatgcaccaaatgaccaaattttgctcgcaaatgtcaaccaatcgtgatcggtttttggccaacaacaagagcaaccagtcctacaatcccacaattttctaaaggctgatttggtacaagaatttgctctctcgaaaataaattatttttcatatacgaatctgaatacccctcccccctcccctcataatataagaaattttgactttttaattgcactgtttgatcattcgtcttattaaaaatttttgaaattattatttattttatttgtgatttactttattatccaaaatactttaagcacaactttttattttttatatttgcataaattttttgaataagacgggtggtcaaacagtgcaagtaaaaagtcaaaaattcttatattatagaacgaagggagtataatttatgttcagatttcttctataaaaattgatttattatgcaacgaagtgtatgctatatattgctcatgaggatcttcctttttttggctgagaagtactccctacgtcctagagaaggtaatccaatactagatgtgatatactatagcacaacgaatctaaatacaagattatgtctaatgtattattatgttctagtgcaaggttgggtatttttgggacggaagaagtagggttgttctgatctggttagttaagtaaagttccagcatcaggaacaaagtacgtaatattccgtggatttggacgcttgcccgtttactggtcaagatgcaatcatacgctccggcatttttatgcatgtgtgtgtgcatccgccaatgattctgtcgtcgcggcgcgggcgggcggcaacacaaccccaacaccgcgtcgcgcacgccgagcggaggaaaccgtggagcgcgacagcaaaaaacggtggccgcggccggcacgccacgcctccccgcgcgcgcgcgcgtggccgccgcgcggggttttgcgagggtgagatcccggtgccaaaaaaaaaaaattgggatggatcgcgtcgcggggtgcgtgtgccggtggaagacggtgaattggtggtggatcgagaccgcgggattcctggcgtgcggtcgcaagccggacgccacgccacgcgcggctgcgcgcatgtggattgtggagaggagatgggtttgatccgcgcaatttttcttttttttctttctttaacgaaaataaaagaacaccgcacttgctgactgactcaggatgtgttctttcctacgtgttctcaactttatctcactcatttttcacacgttttttcatactgttaaacggtactacctctatccccaaatataagaatctaggacaagttaaaacgtttcttagtataacgtatctagacggactccctgtccaaatactatgtacttgaaaacgtctcatccaatactagattcttatattttgggatggaggaagtatgggtctgttcaatatagctaaactgcagctgtacagcagcaaccgctacagtgcatggtaaagaaaatatatacaccggctatacaacgcacctggttacagctgcagagtattgttgccgaacagagcttatgttctttgcaaaaatttctatagaaaagttgattttaaaattacattaatttatttctaaaaaagttaattaattatgtactaataagtcgttccgttttacgtatgtggaagatgcaggaatggcaacgggtcgggtcgggcacgggtagagcaaaaccatgcctgaccccatgctcgtcgtcgctcacccaaaccctacccactagggttagcgggcaaaactctatacccgtacccatgcccgacgggcacgggtatacccggtgggtacccaatggatcacacatgaataataactcgaaagatatataatttaacaaagagaaataaaatcaacaatttactaaattatcagttatcgacaataatttgaattacatcacaacttattactaattagtatcacaaatgaaccatgagaaaggagtataagaattaagagataagtcaaaattagctaatacatatgtatcgggtcgggcatgggttacccacaggtaaaaaatgaaacccagttgttgcccacgatatctacgggtctcgggcgggcgtgcccacgggtaaaatatcacacctacgcccgtgcccattgggtcgggtatcgcggatacccggacccatgggcaaaattgcaatccctaggaagatgagctcctagctctttaagaagaacaaaggcacaaagccactgtgctggaagttttccttttttccctctggtccattttttactttgcaaggtgtgtgatctttctcgagtgcaatctgacgtaaccaaggtttttattttatggatgagagtatgaggctgtgtatagtgcagatggcgagagtagccgtcgtgctgctagacggtccgtgttggatcgttcccgatgtgttcaacttgtttcttgatattgatacgcgatgctacgtttctctttagtattctatgtttagggttcacagtcccgatactgaatcaaaatttgcttgcaagctgtatcattggatttcgcataatccattaataaatcgacaaaaaccaataaattctgaataaattttgttaaaaattaaaatttcagtttgatttttttaaaaaaatgacgaaaaattaagtggtttgtgttttttgatccggtccaaaaattcgaaccggattacactttatttgtgagccctcagtttgtttaaccttggtatgtgtataattaggcgattttgacaattggagagttcatgttcagggtaatattgatctttttctgcttaagtaatcaaggtggtaggtaagcttaagtatatactgacaataatgacataacatcaacatcacagaaaccccatctaaggccaaaatctgtataacatggtccaaccttgttagcattattgcatcctgtttaaggatcaaacaaagaaggagtataaaaatgtttaattagatggtccaaaaccaaaagcatactactacttcagctgacaccctgctaccaaccctatcaacctagtaggagtagaactgtacaagtagataaaaaatcatcaatctcgcaggaagaaagctgcccaaaatccggctgtttgacgctttcccttggaattctgcgaacaaccaaacaacagatgacacaaacacaatggtaaaaacaaccctggcagcgacaagtactactagctgcattattcttctccccatgcatgcttcatcagagcaatcggacccatcgagtgcagaatttgcaggccaagtgttgtagtactgtttccttttcgggcgaataaggttgtggctaggtggtgtttggatccagggacttaactttaatctctatatttagacactaatttagaatattaaatatagactaattataaaactaattacataaataaaagctaatttgcgagataaattttttaagcctaattaatttataattagagaatgtttactgtagcatcacataggctaatcatggattaattagactcaatagattcgtctcgcgaattagtctaagattatggatgggttttattaatagtctacgtttaatatttataattagtgtccaaacatccgatgtgataggtacttaaaagttttagtcctatctaaacaaggtctttggatctaaactagtccttttccatcatatcaacctgtcatacacacacaactttttagtcacatcatctccaatttcaaccaaaatccaaactttagatccaactaaacacagcttaaagatttggttaaagtccaatttacagtacgcaacttttacaaaagcctaatttaccctgtacttccataaccttcacccttaatttcttttacactggacaaattacccccaaagtactgtgcagtatggttttggtcccatctattcgcaatccagctagcaactgtggtttaccccacgtgtcaatctcttatccatcttcttattatcaactccctcttctttctcaggactggatgtgacgcattctagtacaacgaatatagacatgcctctgtccagattcgtagtaataggatgtgtcacattcagtattagattggttttttatgggacggaagaagtatatgttgtatatagatgctctcggatggcttggaaaatgactatagtaacttacaagtgtaccactagaagtggctctagagcttaaatgagacccatagctgaagatagctttagagcttgaaggaagtcgacaataaaatgaatcttggtttggatccctgtgatggtggcggcctcagatcttacgcttagagccatgactaggcagcggctagcgcaaatctgatgacaaattgacaacaagctcataatagctagatcaagatcaagttgccacctccaccacatactccctccgatgatgggcttgttcactttgctatcatttttagccttaccaagttttggcattgccaaattttagtaaggttactaaaattttgacaaggttatcaaattttgacaacattttatatgtacatactaaaatttggcaacaaactaaatatagccacttttttttaactttaccaaaaaaaaagtaaggttaaaaatggtagcaaagtgaacaagcccgatgacacattttcacataaaaaaatgatgactcaatcttagcctccatatccatttgatacgaggacctccatccaatcaacaacttaagtactctctccgttttatagtggacttacattgtgaaacggaagaagtaaggctgaacaaatagtgatggcttaagaaacaggactatgtgcaagctgtagatggcaacctacaaagacaactagagcttgagctagcctgtacaataggagaaaaaggatgggcaatggtgtggatttaagcagagagatgatataatgtctatttctaccaagctgattatgacgacacatgtcaaatgtgtcctgtgcatcacataggattagaatcgcttcgaatttggatgggaggagaggataattcgtatggtattaaagagttgagaggtaaattatttttttcccgcaaaggtaacggtgtaaattggactttattcataaaaaaaatactatatctcgtttatacctccggccaaaactatactgttaaccattgagggcttatttggaatggaggagaaacacaagaaaaatgaaggtttttggttcctatggattactttactgtggcgtcattcggatcacaggaaaacatccgtaggaaatacatagggaaaattcctgcgctagccatatcactggaagatcacatgaaaaaaacatccacgctgacctcttttttctctccctctgcgtgggaacgaggcaaatcatgccatcaaccaactaaagcatattattaggttgattaatgttgtttaattcactagtagcatgtgataattttgtaatagtgcacctattttcttaaagattcctatgtttttcctttactccatccaaacacctactcacatgaaattcctatgttttcaaattctctgttttacacttacatttctatcatatttctatgtttttcttattcctatattttttcaatcctacatcccgaatgagtcctgaaattgtaatggatctctctacctatgttactccgtctagacggtggtgacgtttcacatggatcgagatgcatcgcaccaacatctcgacacacatttgctttacccttgttgtccacatacttatgcatgtttgcttgatgcatgtatctcctatatatgaatgtgcagcatgtgctaataataatgcctttgaacgttcaatgcaaccccattcccattgaagagcaaccacaaccatgtgttccaacaacaataagcagctgacacgtaaccagaacacacatcgggtgtgtttagttcacgttaaaattggaagttcggttgaaattgaaacgatgtgatggaaaagttagaagtttgtgtgtaggaaagttttgatgtgatggaaaagttgaaagtttgaagaaaaagtttataactgtacaactcgataactttttaaatataaatatttttcctttaaaaaaactccctctatctcaaatataagcatttctagctataaatctagataaacaattgtttaactttatagctagaaatgtttatattttaggacgaatatagtaacattttaaatatgaatatatttagctatgcattagtacattcagatgaatagctagaattgattttattttggattaggaaggagtatgaagttgagcggttggcttgaccgatgagtcggcgtgtgcaccgactggccgggccatcttattcgtggctgcatttttgccgtgttgctgcacaagaaagatcgaaagaaagagggctagctagctggctgggtggctggatggctgtctgtccgttcggccggttggatcggacaggtcgagtgagtgacagacgtacttaaaaaaaaaaaagacaaacctttatttccgtgtccaatgtttgactctccgtcttatttaaaaaaattataaaaaaaattaaaaagataagtcacgtataaagtattcatcatgttttatcatctaacaacaataaaaatactaattataaaaaaaaattatataagacggacaatcaaacattggtacgtaaacctgcggtttatctttttttgaacggagggagtaactagctaccggtggttgttgaggtgcgctaatcagtcacttgatcaacagcttagctagagaaatgaatcgtctagcggataaaggatgtgagaatgcggcagtattgtttaagataatggatgaaagttcggtcattatttataaccacaaatgaatacacacaatcaaaagttacattaataattatattctagttttaagagaaaacggaaatactaggcttcaatcttatgctgcatgatgagacctactacatcaaaaatcgcaaggaatcgatcattacagtctcattcatttctccaacgagagttagataaagataaaaatttccgtgacatgttttttaaactactaaacgatgtgtgttttgtgcgaaaacttttaatatgaaatttactctaaaatatcagattaatctatttttcaagtttgtaataactaaaacttaaccaaccatatgttaataccaccttgttttacgtaaaacacttaatctccatcttcatttttatttacaggagaaaagaacaccacatatatgtctaagctcctgcacctctccacatttcatccacctttggctggctccttttcctttgccatcatgtctctaccttctagtgcctttgcttggcgatgctatccaatgaatgcagagaagaagaagccactccaatgcagcttgccgaggcacgatagattcggacaccaatggccgccttccatctaccccgaatgccattggaatcattgtccacctacaatatcattgctgttgacgttagtcgatcggccaccgccaccattgttgaatactgacacatccatcacggcctcgccctatcaccatagccaagacactcctgggtcgctctgtgggagctacacaagagcccatgcgtcgatttgagtccttataaa

SEQ ID NO: 15319 - DNA, 4151 bp, Oryza sativa
  unsure (1)..(4151): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccaagacactcctgggtcgctctgtgggagctacacaagagcccatgcgtcgatttgagtccttataaaaatgcaggagttgaatcctttagcttatgatcgtcaaaacatcttgcagctttgtcaatcctattatgaatgtcaaaacatctcgcatcttgtcaatcctagcaaccctttttatgctactagcaacctcatcgtttcccctatataaaatcaacagctagcaaaatttaaaatttaaaacgtaactttggagtttattttagttttcaacatagttttcgttctcaatattggattttaagtctcaaaggaaacgtataaaaaattttagtcataaattactttttttatcgttgataagctattttggctgaaaattaactcatggccaactaattagagctagatctttgagaagtcatttcagtgcaatgaattgcatttcaaatcatgtactactatatttctaaaatggaaataaaattgatgagttaaaaaaactagcatgcatattacatactgtactatactcctactagtatcatcctagcacattagggatcgatccgtggcagggttcaccaaatcgtaaaaaaagggggtcaacggttttcaccaaaaaggggttcatgaaaaccgtttgaaaagcattgaaaaaaatcaggtcggattttgtcaaaaaatattaaaattaagtttgaaattttttacttgataaacaaactgagcggttgtaatctccaactagtccgggaaatagaggaggagctacattaggttaggacagtgcccaatatataacctgacttaatttcttttctatagtttgtctatttttaccatatatgcatcctttcagttcaaattcagacactcgcatcagtgtgaactcgatataaatagagtagagtaaagcaagcgagttgtacctcccgccattccgttctagcaccccaatccccgcggcgggaaatctggttttgtgaaatctaactggttttcatcggtctggtaaaccctaataagtggatcaatggaaggagaaggaacggatccagccaagtccagtccaggggttctggaacggatcaatcatgcatcaacggaggcattcaagaagctggaggatagccatggccatgtcccctcctgcttcacgtacgctcgcattcactactgcccggccctaattcttcttcgatctcgatcgctggcgaggaacagcaagcaatgcagccgacgacgacattggattctatgcatctgcacgcgtgcgcccatccccagtttatagtatcaatcatccatcgatcgccatggctagctagcttagctagctatatgtgtcaaatcgctgcctgcttgcctttgtcggagcctaatctgatttccgtgtattattgctgcctgcaggcttttttttttttttaaggaagggcgaaagctttaccacttttatattgatagagaaggaaaaaaacactaacaaagtatttacatggtccgtaaaataaaaaccgaaaggcgctactctcctaaagggattaattctgtgatttttgcctgtgatccaggtccgtgccttcgatgatggatggatctatcgattcaagcagcatttgtaattagttcgtggagtacagtatcagcaggtgtagtatggtactgaaatttatctcgatgatatgatatgatcatacattatgatgatatagggtccgtttagtttctcaaaattttttcccaaaaacatcacatcgaatttttggagacatgcatgaagcattaaatatagataaaaagaaaaactaattgcacagttatggaggaaatcgcgagacgaatcttttaagcctaattagtccgtgattagccataagtgctacagtaacccacatgtgctaatgacgacttaattagtctcaaaagattcgtctcgcggcttccagacgagttctgaaattagttttttcattcgtgtccgaaaactccttccgacatccggtcaaacgttcgatgtgacacccaaaaatttcctgttccccaactaaacacacccatagtattcaagtcgagaagatcggatgggttgtgcaggctgcagacagatcaagggcttttaacaagtcacagtactatacactgctggtgcttgcagtactgctccatgccttcatggaccatagatccaagaacagaacctcccaaattaatactccctccggtttaaaataaaccatttctagattatttagcaatgattaagattgatgggaaatttctctttcaatcgtattattggttgaattttgaattgcttagatttcctttttaagcttctgacgagttgaaaatgtttggatttttatacataggaatcagtgtcctggaatcgcttatatcgttacataaattttaaatcctaaaaatgcttatattttaaaactggtaggtgatagcaggctggtacagtgattttgccacggttctcagacatgtaatagggctccttgatgacttgaagattgatgattgatctgcccatgtgtacgtacgttccattcatcagcatgcctgcctgcctacctgcaatgttttttgtactcttgcctgcaaagttttttggattcttgccacactacttccaagttccaaccctgaacattcctagctaaccttgctcaaagacaaaaaacttgcacaacccaactcacatgtatacacttctcatttcaagatcctactaatggccagatgattagaaccaactcatcattatcagtatcagcagcagcagaagcagcttgtcaacaagacaagaagcaatctcccaattctcttcagacttcagagtaagctggtcccctgcctccacactatccttctcttcactcttctcttccaggagactagtagagaggagggaccagcaaggaaggaagtgagatgagatgacggctcctctcacatctcaattctcatctgccagaattgaagcccaccaagtacagtagagacagtacagttgagccaagcatgtcatgtgccggcaagcagcaatgcagctgacctagcacacctctccctttctttctttcatctttcattcctatctcccttgaggacagatgccaattaatgtttctctccacaagcaacagtgacatactccctcagttgcaaaaaaaaataaatgttcgatttttagagttcaaaatttatccttaaaatgagttgtttctattcttttatctaccacctgtccacaaatcgagaaattttatccattcgataccatttatctaccactgacaatactagttttctattaacaatgggtatttgatctttttccctctctattgatttctttgagatggctataaattttgagacaaagctacctgtccatttatatggatggatggccctgatctgcttgtcattcagtcagtaacgagagaaaccaatgcaacttactgtagttaccataacagcattgcaggtgatgtatatatttttcattttttattcctcctggatgaacatacacatgacacatcgtatgcgttacaacttgagaagcaccagtgttttttacccaggtgttagatctgtcgttagttccaaattaaccgagagatatcgtacacgaatgttggcgacaggaaacagattctagcagctgtgatggacccattgtagtggcggccattcactgatcactagtaggaggattgtacgatgtagggaagcagcagcaccagctgcctcctcatgatgaagtagccgaaaggatcttccattcacttggagagtaggccaaagtaggggttttccattgcagatgctacctcaactccagcagcattgagaagtgccaagt

SEQ ID NO: 15320 - DNA, 45669 bp, Oryza sativa
  unsure (1)..(45669): unsure at all n locations
nnnnnnnnnnnnnnnnnnnnnnnnnnnnnnnnntaggggttttccattgcagatgctacctcaactccagcagcattgagaagtgccaagttgatattatccctcggcattaccaggtagccgctgatcgcgagcttcatgaatccgcacagctccaggaattctacgcctccttgcaaattgcccactctttcctgtttaagaggagaatggtggattcaggataagagaaatgaatgaaaaagtttttatgaaataattaaggaattctatgcctccttgcacatcgcttttcatagttaccttgaaaacaggattgtttagtcgaatcctcctgaacttctcctcttctgggttcttcactatgttggcaattatcttcagcagtatttggaatgctcttgtgactttagtagtgtcatcctacaaataaagttgatatgtatgtaactcatgaaacggtatctgaaacatgacacaagagttttgctgcctaacgcaatgctattttgcatttatgaggcacaaattgttggattctacgagggtgagcttttgagaacatatcaacattttctctgaacgatgatgtggaagaacatatatacgataaactacaattgtgtttacgaagcatcatatcaacagtgtccagtaacagtcaatagctcaatgcttcggtgtcaaaatgatcgcaggcataattcgtatctgcaatcagaatactgttttaccttgtaattctttttcagatttcgtaggcagtctctcagttgttctggtgacacagcaggttcaacaggttttatctgaggagctaaaaaggtgagaaatgttgtttcaaggtcgcatgaaaaatagaggtgctctggaaattttagaccttcgttggagttaaggttgggactgaagctactgggttttccattggcaaaccaagccttcgctttctttctgcctgcataggagataaggatttaaggctctttggtacttcaacaagtaacatagcatgtcactgattgaagcgtactaaaatcatgtcactctggtcatggagtaatagtgtaatcacactatggcaataagcaatgtcatcattgaactagctggttgtttggaggtcatgcaatgaactgcaattgtaaaatgtaggctgtactaatgcatatgactgtggtctgaggtgatatacatggcaataacatagtcaatgtggaaatccaataacaataaaaagacaattacaatgatcaatgaatttacggtttcagatagccatactttaaatgaacaattgtgagggcaccaggagattgaactatcctagaaaacaattggattgaactgaaaaaaaaactgatgaagggaaattttgaagttaaaaaaaaaagttaaaaccattggatcagggggaccttatcatcttcaatacgcttccggattctctctcttgttcttttctcctcctcttgatctgcttttcgactctccatcacactgcactaaaaaaaccgtgtcttaagtaagcacccttaagttggaatatcacatacaagttgcatatgaaacaaaccgttttctttgattttcctcaagagtcctctttgcttccataagatctttagcagctcgaatcctctccctcttcacaatgtatgacaaaagtaagttttgcatgacaagaaatgctgaaggatgtgatgcagtccaacaatctctctcagaaaaaaaatgatgtcagcacaggggcactacacattgtagaccacagtatatgttattatcggttgtatcatgtagactatatggttcacttgttagttagcatactatatgattcagttgttagttagcataatatatacgtttatcacaatagatttccattcttgcaatcaaataaaaaatttcaaagagacaatgtcttgttgtttcttaacaaatagtattccagtcatgtcgtactatagccttcaattatggtgcttcaacaaccatccagtaacaaatagggatgaggaatatgctgtaaaaaaacatcttgttgtttcttaacaaatagtattccagtcatgtcgtactatagccttcaattatgatgcttcaacaaccatccagtaacaattagggatgaggaatatgctgtaaaaaaacatgatagggaacatatgaatagttcccatttaatttgcctaacactttttggtagctttctgcttcaagggcttaaggcagcatatcacatgcatatggcatcccaaagggggacagtgcaggccagcatggatttattgcgtggttaccaaaatgaagtgagatgaaaaataagacccaaaaaagtgtattttgttttatcagaccttatcctcttgtaattgattccggattctacctctttctctttcttgaccatcctgttttgacttgaacaattctatgatcctgaaacggcacgcacgctagacttaccagaacgataaacaatatcatcaaagacatgatatctgtccaaagcaaattacatacctccttctgacttcgtcctcgttttgatctgcattaagttctctttctacctgtgatgtttcctgatacaggaagttcaggtgtgaggtgtgacaacagtttatgaaagtataaagcactggctgcagaatccagatcaattaatcaggtagaaaaacaaactgctagaaagtgaaatgggttccatattggcatccttcacattaggcagtaacaacgaaagtaaagtagcccactaattgaccaatatctttggtcaatcatataaatttgcaaattatactgaaatattccttaattttctgtctaactatgctgtaagcagatctaacaatgacccaaattgtctaatgtaataacactagactactaaacaggatatgcaaatcaagtacaattttgagacaaggataagggaatatatttgctattgccccttgtatgttcttatgcacaacttctagtccagtgtactattagaatctgaggatgtgttctgacaaaattggaaaagaaactgatgcaaattgccaccttgtttaacctttcctataagagttgcctcaacatgatgcactttgcaggttttactccttcaagtataacaataaagggtttgtccataacacactgatgtaatggaaaatggttaaggtgtcaaaattaggaagttctctgagtaaaccttctgtcttccagctgctgttgactcttctggtttactctcctgggcatcagccctacaaaacaaccatgcctattacacattttacagtgcagcacatatcgaagaaaagaatgcgatcatacattctttgagttacttgagtatacaagtttcacaaatctatatggattaacagatggtgccttttgtctccacttgtttgtattttgtaacataaagtatttgacaatggcatatggcatgataaaaatgcatggtgaaatcaacacatacagtgtacttgtaccagttaggagaactaatggataacatcagaactgttcggatttatcaaatgcacaggctaaaggacaggtccatatagcaatcattttacaattataatagcagtaccaaaggtcaaatgtgcaattgctcttgtaaggcatccccaataagacacttgtttcttgaggtatatcagattctgaacctacagcattactaggacatatctggctgttgccatatgaaaaatacagtggatatgtagagtgcagatttcttgattgattacgtagctatgtaacagggaaggaaaaaaatgccttttccctgaaataatactctgatattttatcagctctcatctgaaaccatttaagaaataagagctgacctcattccttgaatgtcatttctcgcttcatttggtgtatcaccacattcaatgttgatttctcttggaatctagaaaatgaaagcaagtactcagaacaaaaggtgaaaattaacaaaagcactattttacatgacaatgtgcaatactatgtaagtatgtaactgatatagagggaagctctcttttaaaatgcttgaagtgaaaaacttctgataggtttcccgattgataattattccaccaattacagaacaatgcatatttcaatgaactcatgttgaacagttatttttttataaataacataccagtggtagctgatcaatgtctggatcattttcatgttccagaagccagtttattgcagattcaagactggaattacctgataaagaccgattgttttaaccaaaccgattcggatatgtgttgaagaaattcacaaacaggattacagccatgcaaccatagacgaaattaaatatcctttactgttctaattgaatactatgccattcagcctaccataaaatagtttattacaatatgtctaccttgtattccttttgaaatagacataccagaaaaatggagtgccctaattgaacgagcagtagggaatcccataagttcaagttcgctaagaattctcttgtccaattgtggggtagccatcctagaagatacatatatgaataagaataagagcattctactgaccataaatgcaaaattagaacaaaataggaatgaaatgttatcctcatgagaaaagttggtacacttgaagctagatctcccataaaaattaaagatctaaattgcgaactagcctttttaaggacaaagaattagcaaatgttaccagtaaagtgaagttgagatatctttggagtgatctatatgcaaatacttctaactcatgtttagtaaagttacaacattctgaagtttaatgtctacaatctgtccacgcactgatctcattccatagcctatttgtgtaattatcattcttggttgaataggagaacggaaaactgcctggtaagcatagtctagaattacaggctattatggcacagttagggaactgaagaaggctgagacatttgcataatttggcatcacacctgtgcatacttacaggatggtaatatggtagaaacagcaaaacataggattcaagtagttgggcgaaataatcaaagcattttccaggttatcttgacagaacatcaaaggaaaatgttgaaagttttcgactgcatgaacaagatgaatggtgaacagaatttcttaccttttcaaaatttcttttcactttcaaactttggacccaggtggctgtacgaatcctctataagtagtgcagaaagcaatgcattactccaaatgcagaaggaagtaagaaaattatttgaggaggatcagagcttttgcttcttctgcacttcattcttatcttttcttcccagatggttctttggacctcaggagactctagtgacatcttccttcctgcggttacttatacctttcttcctacttaagtttcctcttgaatcaacaccatgcttacagctggatcagtaacctcttctggggtgaaaagctcataataaatcactaggaagaccaataaggcaacaactcagcaggaaatgggactaatgaggagtaaatttcaatttgcaattttgtagcagtgcttcaaaagatgggacataggttagctttgtttccttgagcacggccatgccattgcagctgctgccccatgcttgatgaatcaccgactgttgtccatactaactgttgcaccagtgcagccacattatgctgttcatggatcccaaaactgtccaaaaacacataagaaagcaatttaaagtgtatgtaagacttccaagagcaaaaccataattccctttagaatgaccaatcttatattgcacatatcgccaaagcctatcgtgccatcaccaattcaccatctcaagaactagtgctttcgtcaaggaagctgcattgcattgtcttataggagtatattataattagcagcgaaaaccctttaacttgcaggcacaaacatttggaattaaaatccccattcctatgtgaccactacttcgacccataaacaaaggcaacaagaactatacggcgagcatgagcggcggacaacctcgtcgccggctgaacgcttgcaatctccgccgccaagcagagatgccgatcgttgccccacccccgactctgctagcatggcggcgaggaagagggggcatggatggcgagcagagaggcggaaggggggggggggcttcactagttgggggaaggcggcagcggcgccgagccgtagaccttgaggagaacgtggtggtggtggcggtgacgatggggaggcggcggctcgccggctccggtgggggaggcggcggcggcgggggaatggcttgtactggagatctaaccgttggtgatagatccaatggccaggattccttccctcctgcatttttcaaaaaggaacccttattaccgctaccattgctaacggtccatattttttttacaaatacccctgcattttgttttcaaaaaggccctctttcgcaccttatagaaggcagatatttctcatatttctgttgtttttcgctgaagcttattcatttctacttatgttgtgcctggacgaaactgatagacagatgagagatgtttgtctgattagtttgaatgcaatttaacaaatagatgcctgcgtcagtagttagtgttactgttactctctctgtttcatattataagtattttgacttttttaattaaaattctttacgtttgataacatctgcaatactatattagtttaattaaatttaacattgaatatattttaataatatgtttgttttgtattgaaaatgtttctacattttcctacaagcttaaataattttgactaagaaaaaaatcaaacaacttataatatgaaatgaagggagtatttgttattgactgttccatttgtttcatttttatttgctttttcctaatccctatcctccttccagtattttcactgtttgggctcggggaggagcagcctattggcagagatccattcactccgttgctgacggaagacaaatcgacaagacgtggcagaggacgaagtgaagaggcgcgttggacgacagatggacgaggcagccgatggttgcaactagaggaggtgattgatgctgctgctgctgctgctttgacacaagagaatgaatacaaataatggcaaaaactgctacaactgacgacgactgatgactggatgacgagaaaatggctcgcggctcggcggcggatcttttgttacgataccatgtcacaatttggggaatgaatgaacagttttaattggagttagcctaataggcacatatatagtagattacaagactagaggaaaagaccaaaatgcccttcacatctatacccttaatgaatttaaggctctatttgggggagcttttagctgttgcaacttctcccataatcagaagctcccccaaacagtccatcttttggtccagattttgagaagctgtagttataaaatccagaaaatgaactaaaagctagaagttaggaaacccagcttttccagattcttagaagctagctaacaaccagccgcttctcatatctcagaatcttaagctccccctaaaggcctaagcctttagtggcctagcttttggaaccacattttgggtagaggcattagttgaaatatccaatatgcctgatagaaatagctccactctttttttgaatgtttggttttgtgaaaaacgctttcttggctatatcataacatgtttgcagagccaaagcttcctttcggaatttcttcatttgtattttacctgtgttgaagttttaggtcatttatgacaacaaatcgatagagctaattgtgagagactcttttcttgacacaattgttgtttatgtaggcggtttcttactatgatttgggctcagatgaagagtccaatcaataatccatagatattggctcttctcaacaataatgtggtaaatgcggtcaaggtcttgaggtcgttactactaaacattgctggataattgaatgagagtttctgtatttatgtattatttgctagtctgttgaatgttctaatttcctcggttacaaagtttttccattcatagggttcaacatgtcttcgttatttgaagcacccacctttacatgtctcacctgtactagccacgtagtcgcactttgcacgactttcaatcccgtttaaaaacttatgtataaacttatcttttaagaaggtggttttaataagttttttatttataaaatattgatggcccaacctactacagatttagctaagttatactacatatttataaaatgaatcattggaaccctctaggtatttttcttccttcattgtctttgcgttctctctatttgtatcatgtgtttaataggagcactagagaactctagaaattcccacatacatacatacatatatatatatatatatatatatatatatatatatatatatatatcaattcatttgtgttttttttattattgcatgtatcattttgatccgatggtcattgtttatctaaactctttatccaatggccaatatattttttatgatgtggcacatccttatacaagaaagtttgttgctttcattatataagatatactatgggcctggtgatagttcttctttttggatgtttttaaaattttactcactgctgaagcagagttgtaagctcaactgctgatagttgttttgaatcattttctttacaatatgcttcacagttggttttcatctgtgtctatgtttatacctctgctaagggtgtgttcggcatcccttttctcaacccctctctctcgttttctgcgcgcacatttttcaaactgctaaatggttcgttttctgtaaaaagtttatatacgaaagttgcttaaaaaatcaaattaatccattctttgaaaaaaaagctaataattaattaattaatcacgcgctaatcgattgctccgttttccgtgagagagggattattctcatcccctgaaaccgaacacagcctaaggagttttacattccttgctcatccaagcgctgactttttgaggaattacgggatgaatatgacagttcaaaattaaatccaatacttgcagctaaggttccaccaactcaagccgtaaaaatggagtgaaggcctactaaccatgcttggaatcttttgagtgctaacggagatgtagaaaaacaatcagagtagtggcatagcctctttgccttttagcttatgttttactaatttcttcggtagctagatgatttgttggaacagctagtcaactgttctcgttcatttacagtacgttgcatgtcagtactctgtacatactaccagcgcagaacgtttgtactgaactcagagaaacgtcatgtacctggggaagctgtgttgttctacagttgtaattcctccgtcccataatacttggctctttggcatttaaaatttgtcctaaaatagttatcacttgcaagtagtatttgtcacatcaactacttcaaattcaaatatctccccatcatacccccaaccaacattccacatttaactatataatattttattaagggtattatagtctttttcttctaatcttagcacatgctaaacaatttagaatgacaagtattttaggacggaggtagtagtaatttgtaatgttgctttgaaagtacttgtcctcatcaatggagatcattcaaagtcagaccaaaagttgtaagttctctttacacattacattagagaaaaatcgtttcacagtgtatccatccagaaaacgagaggaatgaaaaaatgtggttcttaatcatcttgcatacattgtacatttgccaccagaaagaaaaaagaggcaaagctcaatgtttcaaacaatatgttccagatatttccacagtgctgtaaaaagcaattgcaaaataacagtaccatccgaccaagctgtaccagcggctatacaatcatctttctcagtttctatacttgcacatgtcctactatactaattgcatgtctatccaacaaacaggggaagaaagaaaattaaacgcattatcaagaacaacatcgttacttctctctaaaggatatctccagaagtcaacttctatcaacacagaactacattcctctgcttcggaggataataatatctcctaatctctctaccaacagcccatccaacaatgtttctcttcaatgtggagaaataactggaagcgtaagcaaagatactatgctctttcttcttcttctttctccgtagttcatgaggctctataggatttttttatcagtggaacgtagaagctatcgaacacatcaaataatacccatctgataggtccatcatctgcacaattgtccataattctaacgtagagctcatttgtcctgctgtcaacccggtatgcaaaacagacaacgcaatgatggtcccccgaatctggatccttttgtagccctctgtagacacggtctccaaacgtttgtgcataaccatcatctgtccaaagggtgctgagaagaggaccataggcatacagcaggcgcataaactcaagttttccaaaagctacatttctctctagccaaaaaaatccatcaattgcaagctggatgttattcggtactcgttgcgtgaggataccgcctttctccattatcattaaaagaacgtcgggagtccaggccccttcctcgctgctccaaatcccttgacggtagcaggccttcttcagttctttaggcactttagctttgcatgggaaagaaccttttccgtacagccgttcaaaggccaacctgtgttgggcctctatgcacactgtggcagctgcgatggtgcagcttcctaaaataaaaacaattcattcaattaatgatccatataaagataggaataactgaaaatgaaagcattgatagcaacacttaccatcagtgttaataacgggatcacccataacagagatccagctaaattcaggctcaggggcttgtggccctcctcttctccaaaagaagccgcacgggagccagctgagaactgaatcatataaggatagaaaaaccagctgcccaatccttattgtggcaagtagtgcagataagaaagatttgattcggacatcaggtggttcaatagaacttgctgcttttactcgatgacctctctgaaactgagtgtaattaacaaacaaatcagttattcagtctaataaatagaaacatccatcattgtaatattcagttgaaaggcatcaaaatttgttaaagaggaacatggacagaaaataaaaggtgaaggtgtgaacttactttgtagctcctagaaaattcagaggtccccttaggccctggtgctcaacaacaccaactggactatgcgaattatctttgtcgccagagctgaagattagagagaaaaatgatcaaagcagacataagacttcagctcatatagctcgatgtaaacaatagcacatctttcttggctaaatatcagagtgaaggttttttttaaggagattgtgattcttcaccaaaaagagaggtagccaaagaatagtgaatgatactatgctacagtgaattgactttggccagaacgatggatattatcaacaaaccaataattgttctaaggatgtataatctgactctaaaaggtaggaaagagcaagagtagagtagaatcaaatcaggttcttaacatcacacaaattcaaattattctaaaatccaaatcacaaccaattccccaaatacagttaaaacattcagattgtcgccttgtttaattgtttccatttcacaaaataacagaaccaccattcaaaattactagcattagatgaggcatctagatgacaccttcgcacatttagtggttagcattagatgaggcatctagatgacaccttgacacacacagtacaataattcatatacccatagcaagaagatgtgaaaaatggacatacaaagattgaccatcaagcatcaatgcttgtgtcatctgaaagtagcctgttgcagagagatgtcttctaaagcaaaaggaacaaattaggaaaaataatatttattagcttactgcaaataagaaacttgattaatttgctgtatataaatgccaattgttatatgttttcgaaaagaaaaaaaaaacagatgcagttgtcattacctggggtccatgaacagtcccatatcaaggattttctcaaagctcacatgtcctataaccttacgagaccccaaagatctcttcagatcatctgtttcctctatggccacatgggtcacatcttccagttctaaaccagtgatatgagaatcacggccttcaactattgcttgaacaatatctgtgttacatgtgccaacctctgggaatagtttcttctcataagattgctcactttggcatattatcttctctgaatgttcactctggtttccatctgtagtgtcccccttggtacttgacatgatgggctccctgtattcaactagaatgatggagcagttctcattggcccattctatcatctttgcttcaaaatgcagttccaagcactcaatcgatgcaagagattcgatatcctgtgccttgtcataaacaacatcgctaatctgagttttccccttgtcttctgtagtaacttttactgaggaagtggttctcttagcttctgtactaacttctggctgaacagcactgtcatttttctcatcatcactgcctgatgctagtgcattctcttcccttagtggagaaacaaatgattgtgaagcaggatcttctggaatgagggaatctgctggtgccacatttattctgtcaactttgacatcatacaacactttttggggaaagacatcaacagcctttccttggaccttatccttctgagtcttcaaaggaccatgaacagcatccttgttttgtgtgatctgttccattttagtagaatctgcagaatcaagcatatacgtttttagttttgcgcacatcagctatttcatgcaaccagtaaccttcattctctacatggtctgaacctttatccactacatttgattatttgaagcttcttttcttcaataatctccacaatttgtagaaaaagtattatacgaaaacaaggacgactcaaaaccctgagttatctcccctgtggcaataatgacagctacacttgtaacaaaaggctataccatgtcaaaactgctgaaacgtccttctaatgtaaacatgatgaactgcaatccaagtaagaatcaagtccttaaacatttttcttcatgtagctagtaaaagagtgtcgttccgaaaaatgcccttgtttcttatcttgagcaaaaattaacacaacaatagtggtactatcacaattcgctgtgctcattcatgaaaagttctattttctgacttctgacacacgatgcacgtctgtaggcctgttaagcattgttttctcttcctttagttcagcacatgagtgcataacttaccaactttcaaaggctctgatgttttcaccgtgaccacatcttccaattctgaagcaagactatgagaatcacctctttcagcaatttgttggctgtcttgcatagaatagccttcaaactctgagtcctgtatgaactgccccacatcaaggatttccttaaagctcacatgtcctatcaccttcttaaaatcctccaaatatctcatcagatgaatggttaatacaggtggcaacttgcgaataagacgtgtttgaatgggacattcattcttatctttctgctcattttggttttcttccacttggtatgcactcttctctgactgttcactctggtctccagctgttgtgtcctccttggtacttgacatgatgcctggcttctcaacaactttggagcagttctcacaggcccattctctctcctctgtttcaagatacaattccaagcatttctcaatcgatgcaagagagttgatatcatgtgccttgtcataaacaacatcgctaatctgagttttccccttgtcttttgtagtaacttttgctgaggaggcggtcatcttggcttctgtactaacttctggttgaacagcactgtcatttatctttacatcactgcctgatgctatcagtgcattctcttcgcttagtggagaaacaaatgatggtgaagcacgatcttctggaatgcgggaatctgctgttgctgcatccattccatcaactttggcatcacacaacactttctgaggaagagcatcaacaacctttccttggaccttatcctttctagtctgcaaaggaccacctatagcatccttgctatgagatatctgttccactttggtagaatctgcagaatcaagcatataaatttttagttttgtcctcaacagctacttcatgaaaccagcaatcttcattctctacaaggtttgagaacctttatcctctacatttgattattcgaagcttcttttcttcaaagatctccacatgtacttaagttaaccaacaatttggagaaaaaaattattatacgaaaacaaggactcaaaaccctgagctattttcccttagtgataattattgccacacttgtaacaaaaagctatgccatgttaaaactgccgaaacatcctgctaatgtaaacatcctgttgtgcagtccatgtatgaatcaagtctttaaacatttttcttcatgaagctagcacgacagcgccgttccagaaaatgccctttttcttatcttgagcaaaaactaacaaacaatactggtactatcaaaggttgctgtgctcattcatgaaaagttctatgttctgacttctgagacagcatgcacattgtaggactgttgagcattgttttcccttcctttaattaagcacatgagcatataagcttaccaacttttaaaggctttgatgttttcaccaagaacacatcttccaattctgaagcaggactctgagaatcacctctttcagaaattttatgagtcttttcattgtctgtgttttttcaatgccacagttgtgtcatgccacactttcctacccttaggtcccacatgtcatactcagataactagagctaacattgccacacttgtggctaactatttcttagccatacttttgccacatgatacaacttgcctaagcttagttatggtaagcttaggcatcaaccaaataaccccttaatgaaatctcgtctaggctttcagaaaatgaaaaaaaaaaacttagactaacataacatccataagcgatgggggatattcatcgatcccgtggcgattgttgtttatcgatccggtagcgaggatgccggtaattgcagcgatgcgactgagcaatccgggcggccaactcggcgtcggtctggggacgatcttgccgccgctcgcccatgagccacgcccaccaccccaccggccgctcctcctcctcctcctcttcctcctcgcggtggcggcgaccccggtgattgcagcgattcgactgttcaataatccaagcaatccgggcggcgaactcggcgtcagtcttgggacgctctcgccgccgctcgcccatgggccacgcccaccaccccaccttctcaatgcgggcgtccacgaacgagcgcagcgcggcgtaggcggaggacaccacggatcccatcgcttctcgctgagattcaaccgagcgtccaaagaagaagaacaagagattaattgattgattgattgatcgatctggtagttgtagggggaaggggacggagaggccgtatcggaatccagactctgatcctaatccccgtctcggtttgagaattgagatgggccgaaacccactccttttttcctttggaataagtccacttaggctccctagagttataggtagaatttaattcatatccctcaaccagaattgtactctctccgtttctaaatatttaacaccgttgactttttagcatatgcttgactgttcgccttattcaaaaacttttgtgaaatatataaaactatatgtatacataaaagtatatttaacaataaatcgaatgataggaaaagaattaataattacttaatttttttaataagacgaacggtcaaacatgttttaaaaaagttaacgatgtcaaatatttagaaacggagggagtagtataccagatatcttgacaataccagtacgatttgacttcatcggtggttttgtaggtggctttaactgatttggcgtcgacaccctcaaatataggtcgaatatgattcaatatctcttaaccagaatatcaaatattctcgttaagcgatataaattatattcaacctatactttttgagggagccaacatgtacttatcctttttttgttttctcctcctgtgccgagacaaacggagcccaccaaatcccaccctttgtctcaccgacagtgggccccacctacagaaaccgcgtcagggcaagttttatagtacaggtagttgtcacatctaattttatccatgtaagataagaggtgatatatataagggaaaataatacaccacatctacaccacctctatcattataacccaaataattttattttatttgtttgtccaatcccctttttcgttcatttcctttttcttcgggtttatatggaggttgccccttgcatgagaggtggcgcaccttctcttttctcaattattactgccacctcatcatccaatcctacatgccatttttaggggcaacacattaagcatcatgttacttgccctcatcgtcatcaacagcaatagcatgacctatatttgaggtcatggagaatgcaacttggcaagtaccttctctcccccagtgtcttgaaggcttgaagctacggagaaatatatcgtgtacatgtatttcaacttcgactaaattttctagtgaaaccttaacctgtttgaatcttcattgtaaattcgagccaaaacgttggaaggtcatggcagaacagcagttttgaatctccagagatcatgaaatctgcattgctacaagtgttcggaatcatcgctatattcagattactccaaacattcacgcatcggtcggagtaaagcttttccatcttccaatttggaagcaggcatccaaaatacagaaagcagacgacaagcatgcaccagtttgctaaccaaaagaaatgagtgagacatctcattcaacctcacagctccacggctccacctgagcacattagctgactatgaataaagcgaaaagataaatgacaagttaaggaaaagatgcacaaacccacggaaacccccaaaagccgatacaaataaaatctccttatctccctagctgtgcacgctaataatgggctgggtttacatgatacgggaaaataattccgatgcatcatatgttggcatctaaatatccgcataatatcagaacataactcctattgacaagctgttaattgcctcacaacagcactgctagatcacagttctctatttgtacatcatctcgatggaaatcttatacaagaaatggggttacttgggttgatcctggcagtgcacacatccaaatcaacatgtcatctagctactacgtttaaagatgcatcaactattcaactggtaggtaatgattttgataatttcttcttcttggaagccaatgctgacaatatctttttccgaggcccctgaaaacaaatcaagatatctaataaatatggacacaaaatcaaggcatataatgctgcaaaactcaatgatatcgctactcataaaggctgacaaacttgaaaaataaatatatgtaagtagattgcaatcggaaggatagttgtacactagtacacaatggacactctagcaattgttcagtttcgttacggcatgcacgcataccatagacaagaaagatcaccgacatgcatctaccaagggcacaccggaattgctaaattttagagcttataggcagttagcaaagccaacatttatgaagtttttacgaaataataaaaaaccaaagtgaaggaatacttagctatatatacaaaagaaaacagggggaaataacacacaggagataaccacttgtacttgctttgtctgcaaccagacgcatgtcatctatgaaatatcattagtggaacactaaaccctaggataaaatctgaaagatgcaaaaggtacacaaaggcacatatgacagtacttataccacttcattcattttagagaatcatcatttaactctattaaaagctactagaaatttggattagtaaccgatctagattatactatctaacaagatgtcaaaagagagacaggtagcttataaagaatgcatcataattctaaataatttgaaacatcttagtaataattctgcaagacaacccctagccccaccccagctcacccaaacacacaggagaataggggattaaatcaagttaatcctcactcttcagggaagttatataacttaaacctgctctaccaacttgcatatttaaaattatgacagtaggaaaggtggcaatacagaggcatctagacactcatttgaaaaaaaaataataataaagaatggactagctcctgcatgtaaaacaaagttccaatccaaattcgtacagtaccattggaattcctaaagacttcatgtcttcctcattcatgtgaagcagagccttcatatcaacctgaaaaatgattaagcattaacaaaatgtagtaggctagtaacacatgaaaaacttgaatacccaaataagtcaaacatgcctcttcagcctgaaaatttattgagtacttctctacatcaagagacttcagtaatctatcaagagaggaatcagtctgcacattttaaacaaacacattattaaaatgttcaactgataatatttaatgatgaaacccaaagtaatcataaaagcatctggacagataattacattggtacaatactatgcagatgaagtttgtattttttaacaagcagtcaagcagattaaacatagataagattatatacaaaaagacaataattcagaataaaggttggagaaacattaaatgctcaagaacaccaccatcacatcattacacacgcgaaatacataaaagggatgtagcataatgatacattattgtcccattagtctagaacaaatatgaaagcatattagttgatcaggacgagagtttgtgagaagataatatgacagtgtcaccaccttttcctggcattgctttggtgcagatggttcgttcactttcttagtagcaggaagggccgcattaacagggggttccctcttttggacaggttccctcttttgaacaggtttagcgctcgttgatatctccggtacagactttgggatctgtacagtactattcaactgaggccgctgaactccagacaatttttcacgaagatctggaactgatgatttcctcataacctgagtgttttgctgcaaatgtggtttctggtttccttggatatttctggaaggaactccagcttcaccgtgcaaaacgaaagtaatacagtaatggtaaatcatcatgcaggaagcaaaaatgaattgtatgtttagaaaatatactatgaatgtcccttacatgaactttgaactcccacagagtccatataaagttcacgtctccaagtcccatctgcctgacgaaacctgtccaaaccacaaagtagaagatataagcaataggattgtgtttgcttctgtgctcacaattaatctgggaacatataaaccaaccgatcataccaaccatttgtgaatcttacacatcaggtggaaacactgcagtgatgcagcaatttaaacatgacttaatgatgcgataactaaagacaacacaagaaaagtgacaatactatagtaactataccaaggcgtgcatgcatatagactggcagatagtgataaaggttagctgcagcaacaacagacgacacggctgtccaaaatgctacactctccacagtttcaaaacgaatttaaagcaaatgcagtattctaaccaggtcactggctatcacatttgcagtaagacaaaaataaacacattttcctctcagtctgactaatcaatccgctggtcgcaaccacatgtctcccctctaagtgggtcaacctggaatcaacatgcaaaatgctcatttaagtgcgccctaaagctacaatcaccacgcacgaagccacgaactccctaatttccacgccctaagcggcatttcccaaacccacctcgatccccatacgatccaaccacgagtcgcaagcccgtaacatctagcagcgcatgtacagagacaaaaagcaagcgacgatttgagcctatagcgagctcgaagtcgcacctcttcacggagtcaggccgcgggcgagagcctccgccgcctccaccgccaccgccaccgccaccgccaccgccaccgccgcccgatccgaggcggtccatgacggagcgcttccgcccggagacactatcggagtacatcgcggcggcggcggaggcgatgccgctagggttttcgtcggcggcgaggggggcagcggtggagaggccggaggaggcggaatgggaaaagggggcgacgtggaggtgttcctcggaaattttccttcaaagggaaaaaaaacattaattttccattttttttagaggggaaataatataatgggcttgggcctaactgggctggactttgaaaattaaagcccatcaagtaaaatagctgaaacttatattctggcccaaaattagcccagctcaattggctccacaaatctaagcgcttgtttggtttgaacccaaattttgccataccaaaatattgggagtcaaactgctactcccttcatttcaggttacaagacattttgactttgtcaaagtcaaactgttttaagtttaatcaagtttgtagaaaaaagtggtaacattttcagcccaagacaaatttattatgaaaatatattcaattattaatttgatgaaactaatttagtattataaatattaatatatttatctataaacttagtcaaacttaaaacagtttgactttgactaaagtcaaaatattttataacctgaaacggagagagtacaatacaatttatactagtatggcgaacatttgatatcaaaccaaacatccataaagtacggttgaaactaccaaaaatttggtaagacataaattagcctaaatccaaacaagccctaggaaccaaattcaaacaatgcataaagttaaatcccttgaatttgacagtgagcaagaaaccaaactacataaatgaaatgggggtcaatgcacagtttgactatgcaaggtagaggtggtcaatggagaggagaggaggagaccattcaactcaaggcacttgttgtaccaaccaaccgtgcagtccacttgtatctacacttacgcgggagcattgacttgccatccatccatgcgtctcctcgtcgtcgtcgtcgtcgcagcaagaggacggccggtgcaacgaccggttgatcaatcgatcgattgatcgccggtaatctcaccgttgaatcagggaggaaagagtcgccggatgggaccagatgatggttaaattaacttgttaattaattacgaataggttgcagcagtgtacgtatgcatatagaacaggacagaattaatcgtgtggttagttcgagtaaacaaagaaaaaaaatgagaatgagatggaggtgtttagcttggaagcatcgaacaatccatccgtcgattgggaagctagaggaagaagacagcgatggagttggcgagccggcgaatggtcaaagatggccaactttggtttaaggtgttaattgttaaatcgttcgagctatagtgtgctagtcaactgctccatctgaccaatattttttcactaagaccccttatattttgactattttcgtgaaatgaacttggctctatgataaggatctatatgcagacgcggccttataattgctacctactggcgataagcagtgaactattgaagtactccctccgttacatatacaagtttataaaaacaatataatagtattttcaacacaaacaatcatattataaaaatatatccaatgttatatttaactaaactaaactaatttgatattacatatgttactatttttttaaaacgtaaagaagtttgattagaaaaaaacgacttaaaatatgaaatggaggaagtagtagtttttcttccggtttcgatgtgttaaacaaaattaaggttaaatatttataactttaagtatcaatagttttaagtttatttattttaaatacactagaataacatatatagatttaatttacaaagtattataataaaacaaaaacttgtgatacatatattataatagaaggacatggttaaagatatatatcagagaccgtatcattatttaaaacttgtcaattatataaccagagggagtaggtgttgccatcttccataaccactgaaaaattgcaacgattaaatattaatcatcatcaagagagactagggaagacttgaagtgacattaattacgaggactattaagcaaaatcagagaaatgagagggtacatagcaaagaagcgacttggctgggccttctgggtccctttcgtggagtttataatcccaggctgcagctgcaagccagccggcctgagagagaggagaggagaaggactccattggcgacaagctaagcttagctatagctatagctagctagcttagcccctgccttccaaggaggaagaaacgaggcatacatacccatcccctcctcctcgacggctagctgctacctcgtctgatcgatcgatcgatctcctcgtcggccatggcggtaagctttctttgctctttcttcttgctcttctgttcttgggcatgggcataccttgcaattgcatgcgaccatgttcttccatcgctctttctgccacagtttaccgttaggcgtaggctaagtttgatctgtccatggttttctggttcaatatctgaacctgaaatttctgaaggaacagttctcactttcttaataacttcagagtaactcgtttttatctgtccatggtttttggatgcgaaatctgagcctggattttctgaaagaaccgtaacaggatcaccacgattttgtttcttgtcatccagtgttagctagttaattagttggaacaccggtttcatcgcttggaaaacaaagtcctctgttgttgtgctcttgttctgcttgaatccacctagtttgctcaacttgaatggtatgaataacttattgcttgtgtgaacgaaggaatatccttgacgtgttcatctgcaagaagtctttcttgatggttgagatgtatctttccatcacattaagttgtttttttttctttgtgaataaacatttaagttgtagtattgtctccatagtattcataccacaattaatcaaactgccatagaagatagatgttgtctgcttaactcactggaatacgacgtcctggataatcaattgttctcccttaatcgattacattattcaaaatctgttctaacctgaagattgaatttgtatataaccaaaactgaagagataagggatgcatcatgcatgatgcatctgtgtctctttgacttgaaatttctcccactttttgtaatcttaatcaaacgtagggtgtcagcaaggtagacctaccttgcgctgtcatttctccagaagctttgacaaattggcacacaaaagagattaattgtcagacctgaacacccaaccgccgcattagcccggtcctgtctggccagcctgattaatcagtccaagtggtgaagccacagcatgtgaacgattgattaattccgattagaaaatcagcacgttccatttgattagtccggccatatacatcaaatgtatgcagtgtgtgtgcaattgaccagttcctggtctccatttttcttttgctaattttttgctggtcagactgctcatttacaaccacttgtagtaggcagtagtacatgattcagcaagtcagctctgtcaagttggcatgttcaataatgtttacttcagcaatgtccttatgagtatgacttttgaaaacaaaatcaaaatctcgatatgtttgatgaattcgcacagctgtttttttgtagttgtatatggcttcttgtagaagttgatctgacatgcaaaagaaaatgttcttttttaggttaaaattgtggcagtggtcatgtcagcgatttttataattcttaagaagacatcgtgatataccatattttatagtctaatttttgttttaccatctagtatactaaaactgtatagtagttactgggattcaggatccactatctcagtatacctaaatttcggatcggaaaaaaaataaacattaaacaaattctgatcgaatttaaatacattttgccacatacgcattttttttttgaatttttcgtgcgaaatagtttcatgcccgggccaaaaaatccccaaaattgtgagaaggggaagaaaatgcatggcggcaatggctgatcatatatagctttgcatttatgcagcagcagcagaagaagaacgcgcacgtgccgaaattcggcaactgggacaatggcggcaacgtgccgtacaccgtctacttcgagaacgcgcgcaagggcaaggtcgccgccgccggcaagatgttcaaccccaacgaccccgtcgacaacccggaggccttcttctcctccatcgccgcgccatcgccgagccgagccccttcttctccgccgtcccaccacgagcgcgccccgagcgacgcgccgccgccgtcgtcgtcggccccctacgccggcggttcgccgtaccaccgtcacgccgctggtggtggcgagacgccgccggcaagaagaggaggcgggcggacaagcggcggcggcgggtcgtcgtacagcgttgagcactcgccgtcgccgtcgccgctgcacccctactccgacagcgggagcggcagctacggtggcggcctcgtcgccaactcccgcgccaagggcggcggcggcggcgccccgcgcggcaacgagacagtaagctagctttcctccgctccgctcgacctctccgccattgatgacgcttttgcaagcttcgtgaccttgttgttgtgatcgccaatggcagccgacgagggggtcggcggtgccgcggttcggcgactgggactcgaacccggcgtcggcggacggctacacgcacattttcaacaaggtgagggaggagaagcagaccggccaggccgccgggaagccggcggcggggctcggcaagggcggcgccgccgccgccggccacggcaacgccgccaagcgataccacgacgacgacttcgcctccacggtgagccactccaccaaccaaccattgcacataggggcctcatttttagttgcttatatttatcagccaaaatttaaattttcaaccttaaatttagctgattttaaggttttttatcaaaatttattttttagcctttgcttttaaatcgctagaacacgtatataaaagttttattaacaaattattttttgtttgtaaatatagtgtttcacttattccgcgaataagcgaaacgatggctccgctaggttcttgatttcttttacatttctgatctcatttgagctctacatttttttttaatttgcagaagtgctcctgctttggatggtgcaaatagagatggattttgaggctgttatcaatgtacttgtaaattgcagagaatgggattttcgtttccccagtgcgattcatcagcttcgaaactgcatttggtcatagattatttatttggaagtggggaaatatacattacagtatagttcatgcctgctgtaatggtagattacgtattggattgtttggttccttctgtactggatttacatgcttgtaatggcaggttaaagcttgggctgtttcttgttcttatcgtcatttaatttgtcccttgtcaacacagaaagtccattatgcacgtattaatctatgaaactagatttctggtagatttggagttttttgttttttggatagctttttattgctgaagctggcagtctgctgcagagctcccttaatctgaagactgatgaacggtcgcatcacatgcactctgatcctcaaaagttctagaagcaatctgttctttttccttctgaatttacttaaacaaaacagtgtaaattgaattgcttgaaactattatcatacaaaaaagaaatgcacatacggtgcgtactggatcaagaacactcaaaacccaggggctattcagattgtagccaaaataaaccttaccaaattttggcaagttgacaatattcctaaaattttagtagaatttcttatatatttaccaaagtttggcaacaaactaaatatagacacttttttggtaattttatctaaaaaaaatatagtatgattgaaaatggtatcaatctaaacagcccccaatcggatggcctagtgagcgtagctagtccatctggattcaaatctagttttacagttttatccggcccatctacgtgtgtgggccgtgattgaggcccatcaaaacgagtccgagacgaggagtggtcagcaccggggcccacctatcagaagcccagcgcgggaggagaggaagaggagggcgccaaagtccacagcgactcccctttccttccgatccgtcccgaactcgaagcgaaaccctagcgagtttgcgccgcggttcgttttggttgttcgttcgagaccgattcgggtaaggtttccccctcgccaattcaccccttccgtttattaactgctctgatgatttgcctcatctgattcatctgttctttgctctgggattccgccgcggaagcaagctcgtccggtttccatcgtcgtctgggatcgggctcgctaagacttttcttgatttagtaagctgatccccctcagttcgttgtgaattgtgacggattcgggaaaaattcaggcactcttgatcagggtttggggtttagcagtctcggtgagcatttgtttccccccaaatctttctttctttattgttgttgcgcatctgtgtgttgtgataagttctgcgaaatgtgatataaagttatgtgtgtatagatcgtagagagctgagattagaggatatcattgtaattgatatttgacaacacctaaaaaagaagttttttaagtcggcaggagcatgagaattgcctgattagatgatctttacaggttctttatataccacatacttgaaatttcccagtgcttgcaggcatttctcatctcgactcttgttttgccaaagtattgttgaattgttcccttccttccaaatttccagggttctcagttttgtttttttccccctcttttgctcttctggcgtgcccaggatcgcaatctgcgttttttttggtgcctatctatctttaatgcaatgatacgcaaatcttgtgcatgttgccaaaaaatgggcatttcttgtagaaactgttaagggaattagggtacttaagctgaagattcagcaataagtaattgtggctcactgatttccaggttattccaaatatcataagaatcatgagtactgcaagtactgcacgctctaggaagcgagcccatgatggatccagacaaaaagttgatgttataaacttggaaacaactgctccagtggtgaacactgggagccagcatgaggctctgatccttaggggtacacggacctcacccatcgatgttgaagctctagatgataaagtaagcttttgctttcttctgtctccaattaagcgaatgaataactgaaacctttacaagaagctgaagctgatgtttctttttgatagaggaggagcagaaaaattatgaggcgctctgtggctgtagtggatccggagaaggatactggtccgggaggtaagtacattacttatgtttgaactccacatagcttagtctaaaagaactatttggaagtcttgtgttactcagaaacatttggatacttccaagtgacataagaaatgtgcaccattaattctaacccatagttctgtactgtaggtgaaactgaaacttgatagtacatcggtgtactgtcttatagattattattacaagacactacaacatatacaataattatgattcatacctcacaaatgttcatcatgattccctgttttccctgttccccaaggttatggcgttgctggagctatattttcccggggcagaaattttcagggtgctgtacatgttatatgcctttctccagatagggaagaagggaccagcaaggttgttaatctttttaagttgatcttctttgtactgtgatgataattgcaattccgcattggctggtgtatgtatattgttttcttaatgcttagtattgtactcctacatgcaactcataatatgctctcacctttgcagccgaaaaatgtggcccaaaccagtacgacgcatgccaaggttgctccaaaggaaccaacctttacctgtcctgtgtgtctgaacaaactggacaagccatccacgacaaattgcggtcatatcttctgcgagaaatgcatccaggcatggctcaaggctcagaagaaatgccctacttgtaggaagagtctagggatcaagagcttccatcgtgtttacctccctactcctgctgattatgattaattagtttctgctggcctgaacctcactagtccactcctgcacattcatcttgtgtgcaaaagaacttgagcagtagttagagttagacatttagtctttgtttgttagccctgtaggctaacaatgtggtaagaagtgcacaacacgattcttagctcattgactacatctgatctgatttgtatgtaatggcgtgcatttttctcctgtgggttctgaaaaagggaaaatatctagttttccatgacggcatgacccatgaggttcactataacaatgggctttctttacaagtgttacaaaccgctgttctgactcgatcgtgaattgattcatgatttaactactgtacagccactcaatgtgatgtgagatgctaaattctactgtaatctatcggcacaaacttgttgctcgctttcaccatcttcattctacctctaatcgatgccaacctgaactgaaaacaacctgatattcaatgtttgagtctttatataaaaacaaaaagaattgtgggttttatgatgaactcatgaactcatctgagttcacggagcagatagccggaagaggcgccggggagggtcagagatttaggggcgtttggttcactccctcactttgccaaactttgccacactttttaggatatttgtgtatgccaaagtttttcgattcaaaggcccacatgtcatacactcatcttttagccaaaccttgtctaaggtgtggccatcaatttataagccacacatttggctagttttggcatggaggtttggcaatgttcggaagtgaaccaaacaaggtccacaggaaccgtgttggatcgagaatgtacggtccagatgcaagaggggtaaaaaaagccgctgatgctggttcacgggagccattggatcgcaggaatcgtccgatcgagaatgtgcggtcaaaaatcatgcggataaagtgcggcgatgcctccgaaccccttgagtccatgaaatccgttggattgtgatgatgcggtgaacaatcaggcacacagtgtccgtatatttcttgacttcttgagtactgataacttaagcttgataactatactttgggggtttgatgatcttctgattccacagctaattagggattaaatcgccgtgacctgcatggaattaatgcagttcagtcaatgcgagatatctcaagctcattgtggatccaaaccgtcggctctcttttatctgcttctaggctccaagctccagcttccctgaaatgatgtgagagtaggacgtgctcagtacttaatccaagaaaatgacattggtgaaggatcattcattggtgtcatttctgtccatgcaccatgcatgtcggtgaacacaaatcaatatctcctctttgtattatcttcttcttttcgagcagattaacaggttcaggagaagttgcatgatccataccttttcttttccattttgtaattttcttcatctttttttttactgtatcttcttattttcctttgagtattggcatcaagaaagaagagcaaaagactagccggatgcagcataatttcacatgacaatatgcccttcctctgcaaaaagtgtcaggaaatactagtccatttcaatcagcaacagagctaagtacaaggacaaccctgtccggaccagatactgcattggatttgattgggcttgtctggatttggacagccatgtgttggccggagaaaccaaacaagatcaagagcaaaatgaaattaatcattgagtatacactccttggatggatctttcactcatcatgattcatgcatccttgctcatgttcaccaatgcaaaatgcatgggcctgaacctgaagcttcttccacaacatgccatgagaataatagaggtgggatcaatggcaccttaagatcaacattccatcatggtctaaagaacagaaccttccatcatcaacccatgaacccccaaagctgtgggccccggccatgtgtgagcctagccagtgggccacccccctgactggtgacctattgctcctctcatcaggcgtcactacacactacaacaagtgaaaaaagtgaaaaaaaattctacttttaatctttgcatatggcatcaacattagcaaaagtggacatgttgccaggatcatccacgagtcttgtacatcggccaatatattcagaactttcatccacgttaatctggcagatgagctttgtcaaatgcagttctaacactagagttcagctccattcatggagtgagacaggagcggccaccgacagactgacagaatcgctcgtagagaaagagtgcagttcagatgattaatgttccatctgcatacagaattccaaatactagattatggcctagtttaaaatagattattgactaatttattatagtagattatatgatataccacacctgttaaaatatagcaacttttagctatgaatttagacgcataattgtctaaattcatagctagaaatgcttgtattttgagacggggtagtaagttaaatgttttgataaataacttaacaaacgacttagaacaaatgcattagaacaagaaatgcatacaatgcattaggaattttttttaagaaacatttttagagacgtggatcaaatttttctctcaataataatcatgtgagtattccctccgtctcaatatatagtaacttagaatcgaatttgatatattgtagaattataaatttggacaaaactatatctaaattcatagtcccatgctaagcttactatacagtagaacaaatggagacattgagtagttgaaaagaaatagaatggagatcgggtccacagcacatcactagcagctgatccagaaaatatagcaacttttagctataaatttagacgcataattgtccaaattcatagctagaaatgcttgtattttgggacggggtagtaagctaaatgttttgataaataacttaacaaacgacttagaacaaatgcattagaacaagaaatgcatacaatgcattaggaaattttttttaagaaacatttttagagatgtggatcaaataattctctcgataataatcatgtgagtacttcctccgtctcaatatatagtaacctagaatcgaatttgacatattgtagaattataaatttggacaaaactatatctaaattcgtagtcccatgctaagcttactattcattagaacgaatggagacattgagtagttgaaaagaaatagaatggagatcgggtccacagcaaatcactagcagctgatccagaaaaacgttttgtgcacattttcatatctttggcagcgatcacaatgcccaataatatcgttttcaccgaacatagtataaacagtaatactatcaacattttcttttttactcgagagagcctaaaaaattactggagtacagtaatacaagtacacctttagcaatcgaggcaaaccttggacctaaactggagttaagtagatctcctagaccgccgtgttttcacagtaacacgctcttggtatgccctgtgggacagagtcttcatcatcaatcatgtcattaccacccacaagcgagatttttgaagtgcgggaagattttcatgatcgagtgatagaggtatgggataagccggtgaaagggcaaaacactgtccaaagatggaacaataagatgaatgccttatggcgccatctaaaaggctgggcaactaacactagtggcttttatcatatagagaaaggacaattgcaacacaccattgatactcttgatatcaccgcagaaagtcatgtcctagctaatatggaaacagacactttcaatccagagatcggttggcacacctacttgggggagaagaaactaaatggtatcaaagggctaaatctaccgatgttcttcttggtgataataatactaaatattatcactagattgctaatagcaaacatagaaagaaacagattattagcctagaccgggatgaagaaaaaattgaggggaacgatgcttcaaaaaaattacatcacaaaattctataaaaagttttttagaccaccggaagtaagttccctttccctagatgattccaaattagatgacatcccccaagtgtcggaggcagaaaatgatcatcttattgcccctctctccgaggaggaagtaagagatgcggtttttgggatggaaacaaatagggcgccagatccagatggctttcccgctgaattttagcgaaaattttgggatgttctcaagcatgatttattgcttatgttcaatgaattttatgctagagagttcccaatttttagccttaattttagggtaatcaccttgatacccaaagtaaaagaggctaaccgaatacatatacagaccgatatagtcttttaaatgctagctttcaaatcttcatcaaggttgccactaatagaatcaattcagtggctgatcgtatatatagtgagaccaactcagacagctttcatgcgagggaacatctatctcagacagctttcatgcgagggaacaacatctaactgaaacaatgaaatactagtgctcgataggagcaaattatatggttaaccatgtcattataacggaaaagaagcatttcatagttaaccgtatcattagaacgaacaaggaaagaggttatcgactgttcgagtcccacgaacgtccgcgaactagacccaccccgattacgtggtgtcaaagacgttaaaatcagccctgttatgtcatttggccttgattcgcacgcagtacacaagttcgtgcatcagtctgtgcactattgcatataccttgcgtcttcatgtactgctaacttcatttactcaataagcatgggccagtcagacattcatcatgatatgacgacagtttagttcatgtacaatataaactttccaaagtgtttatacagtatatatagtcatagctatttcttaaacttttaataaatgcaaatatatacaatatttaaagaggcagactaaggagtataaaaaaggatgcttcacaacacgattgtcacaagatgaaaagttcatcttgctctccatggtagatacaaggaattgctttggtgcagctcctgtcctgctaatgtaaattggtgtttttcatattattaagagaaaataaggaaaatgccatcgaaaagatacaagctgcaagatatcatcgcctatgagaatggcatgtggggaatgtcaataacatatatgttggcattttccaactccgttattttttagatgccaccaagcaagctgtcattaattaccacgttcacattcaatatgtttcctaactacacactagcacaagtgttgcaaattttattttccctaggtatacataacaaaattgaaaaaattacagggtagacatattctattcaagcaaaatttatatatgagaatcatttcatttgctagattttattaaacaaatactcagaaaatagaggaaaagtccattgtcaagtagtatgtatttttttatctgtccaattaagtttgaatttggactagaaattttgtctgtcctagcttggtaatttctagaccgagttgaaatgaaatttgcaaaaagtgtaccatttccacatgatgcttccccacttaattctttaaattgttgattcagctactcttctccagaaattttacatttgtaaaaactattggatgatcttcagccttcacattatcaacagttcaaatgcttaaaagtatccagaaatatgcagtttatagacatgtcattagggtaatgactcaccgaagtgatcttcaatcaagcctcagctgtttctgggagtgtaatcaatcgggatgcagaatcgtataccaatgaactgctacaactgataaacatacaaagtaaccacattagttaaaatataagatagaatgcatcagaaaccgaggactagatttcaaatccatactttgcacatttcacactgtttcttgcaccaccgctaggcacagacagtatagtcccaaagaaggaaagattttcattgccacagttcgggcacggtccctagttatcaaaaaatttgtcattttgtaccatacttaacatgcccacgatgtatgataagacaatgaaaataccttcaaaattaaaaagtccttcactatggcactcgtaattgcctgtgctacccaaaatattagaggcagtgcggcaaaccatgtgaagatgaaactgaaaggctctggcaactgcatcattcatgaatgtaatcagtaaataacaatgtttattatctaaaaaaatcagtaaataacaaagtttgttttatggcatcagatccactgtaaggtctgatgtagaattagacagtttgttccaaaagtgacgtatgatatagaattacaggagtctaccatgctcagtattcaaaaacaacattgtaggttactattagatggttatcgtggcactgctataatatttattttctggaaaaatccatacatggcatggaaagcatatatcaggtatggcatcatcaattgaagcccaacagttaaaacaatggcgttatttgaacaagccaaactccaattacaaggaagatgtttcgtgaacatatttcttatagcttgttggaaaatatggaagaagcataatgacattagcaggttggcaaagaacagttaaagatatttactctgcttatgtagagggtaaatgatgttcatgaaaaaaagaccaacacaatttctgctatattataaaccatttattttttatttttacttttctacctcccataggtgcctcactatattcccatactttccatattacccttactggtgatgatgcacgttctactgtatgagggcccacattgcatggatgctttcaaacagtgccataccactgtcagatactacatcggatatgaatacagtgaactctaattagcatcagatatgaatattacatcggatgcggatacgccatcaattattcttggtcactaataagaggtagcgaacataatgttcgatgcagcatgcctacatctatgtcccaactggttgtgaaccgtgaccttgtgttgttggactaatatgttatatcaaggcccatgtattgtaggaccatataatctatgaacacttcatatattctatcaactatcatccctaaggggcaatcatctcctcaaacctctgatgtaagtgacaataatttgtgatttctgctctacttctactcatttatgaaattgtgtactgttgaaataaagttagatgaggccaccgaccataactttgatgtcaaaaatgcttgtgcttggtcaccctgatggactctctctctccctgtgcagtgtgcacagcctgcaccgacctctctttgtacatgcatgaagctccctttgcaaccttcaaatatttttttctcctaaattactaataatctaatctacaatccaattagaccgttgtattcatcgcaattaaatcacgacaacaagaccgtacatgattgtattatgatgaaaaaaatatatgtatgtttcaaccattgtaatttgatgtttcatgtacaagtgaatgtttcaatttgaattcaactgtattgcacattttaagtctttatgttgcaacgaatctgttttatgttgcacatgatgttatttggatgtttcaatgagtattttctaatgtttcactagttcatttgtaaatgttgcacatggtgttttttggatgtttcagtaaatattttgtgatgtttcaacaattacaactcgatgtttcatatattatataaaaatatttcaataaggaatataatattttctattttttcatcaaaaattaaatcatatgtgagatcttgttgtaaaaatttaattacaacaaatataactatgtaaattggaccgtagattgcataagtaatttaggagaaaaaaacatttaaaatttgctaatgaagtggttagaggaggggtaagtgggagagaggatggagtatgcatgcaatatgcagaggggcagaggcagcaaagcatgcggtgcatgtggtagtggttagagggtgctcaatctttcccaaaattcaggtgcttgagtgagacgatgaaattgaaaaccatgtatccaccacccattacttctatggaaagatgggcccaaacaagcctgccctcagccctcccctcctgtctcctatgcaaattacaaattctgacccctcactccctccatcatatcactcctaactctcacttcctagctggaattaccccccccccccccatcatgcacatgtcttagtgcgcacttaggtccatgcagcaaaccaagccgggcagccaaatcgtcgtctttaactgccacctggcccattgattacggtaaaatagaggtataaaggtcgcacctaattctgacttttcaaaatctattcaagtgagtgaacaaattataggactataatgtatgtttaattctttacatgtataaaatcctgaggatgtcatatatataacatcctcagaattttatacatgtaaagaactaaagaaacattatatattggtgacttagctactccctccatcctaaaataagttcattttttacccatcccacacatacaaatacaaaaccaaaaaagattataatactctcactttaccaaatcccagtgcaattataccctactttcacaaattacgatacaatgattgcttaaaagtgaacttattttaggacaaatgggaggcaaaaatgaacttattatgggaaggaagaagtattattatgagagagggccccacagaccctcgggcccacatgtcagtgagcagtactgtatggatctcaattggtatattatcttgaatttgttagaactaacctcaagaagatatgtgatctcaaaacctgtcaaatcatccaggaagaagaatctgtgaagacgaaatctagattagatataaacacagtatttagtacacataaacaaaactgccaaaaacaataatgattcttcatcgaagtgaaaaatgaccataaatctagtcaagaaaaaatatattaaacatggcgtaatgcaaaaaaaaaatgtatctctgacatcatgtcatatgattctcacagtgtcagagctaaaactgctgctggaacatttagcaggaacatcttgaagtaatcgacagtcaagtcactgtagacctgcgaaaataacaaatttgttactccaggatagattaactaaacagcatcacattagcacccaaaatagtgatgatgtgaataaggtcatgtctctacaaaatagttctctaagctaaactattcttgttttaattttgacatgacatggtttttgacactagatcatagcatgttgctggaaatattcttatagatatctacacaggggaagctccccatgtagggagatgtgaccatggttactattaatacaaccgtcgctcacatcaagatcaagttgaccaagttctggaatctaattcggccacctgctacagtgctgacttcaaactaccgccaaatgtgcatacaagctctgttttgggtccatgagtacttgatggaaagcatttggaatcctctttccaacagatccaacctcatctccaaattcctagcaagtcatcggcaaatagagaaataaggtattgcgccacttgtcatgggcctttgggcttgtaactttgtttgggaccctggcccaagtgaggcccatgtggggtggaccccaaccaggtggaacacgaccctaggggcccctaggtcgtcaacccaccgccttaaatagctaggtaccccttcagggtttatagggttttgtttatattaaagtttagtttcgctactttgctgtgtaatcccgtgatcggttaaatcgctgatttgctcattacgaaaccccaacttatcatttgtattcaattcttatttgcaatttagattgcttttagcttgttcttgcttgtttcttcgatctacttgcaggattaaggttgatctacaccagctagatcaacaacccacggagagatgtatcgatcgctaaggcgcaacacaacaatgtctcgtacggttgtagggggtcgtcaacgtttctcccaaatcgtagttatattcaactcaccgaaagatcgggtcaatcatagccatgagtgtctcgaatggagcttaggatttatcatcgggaggattggctttcgtgacctttcttggccccggtttcatatacttcttaattatactaccctggggaggtatttccctttggggccgagttcttcgaagaggcataatttaaacacaatactttttgttaaccagatgattgcagcatgcttatcaaaatggaaattgcttaccgtacttttcatgttcaacagtttttattccacaacaatggactgctatttggctaactactttttagggctgctaaactgaagctttactattgtaaattccccatatctgttatgttcaatagattagtgtaataactaaactgcagtttacaaaaaaaaatgaattagtataataaaacaaataagtcaatcccaacctttcgacttcgaagactgcatcttggaccttcttgtacgatttcacttccctctttctggccaagagaaaaaaataataacagattgacaggtaagttcagtctcggatttacattactgctacaatgtatgtcttttatatgtatggtttcatctttaaatctcatttttacactgaagctaactgacaaccaaatatcatgatagaaattactaaaatttaccgtttaactcaaaatgctgagccttataactcatgttttttataaggcaactttagcatcattaccatgctacagcactgagaagtacaattagcggagccccaaatctatcgctgatattaaataataaggtagaatagcattcattttttacagcacttaatattacacattttagcaagtataaggttactagggacaagaaagaccaacccttaatctcagctttagttcatcaaattcagcatctgtcataatggggttgccagccacataagccatggatgcttccaaaagtctttgctcatcagggcctgacgaaaaaaaatattaaataaaaagcaacgattaagcattaacatgacaacattagcatgactgaattaaaaaaaaacctctcctagtattttttttatataaattggacacaaacattcctctgtttgcagttcatccattttcctgtctctcctatcgttttaatgttattggagaaactcaaaatataaagtgtgcagtgttgataagaatgcttacaatcattttctctttttcctgaaaattagcagggatgtctcgcattcacttaatgatggatatatgttgtcttaagaattgagcttccaatgttacttgcattgggtggacataatataacggcaccaatccagcgaacgctatcacaaactcactgtcgtatatcgaacacaagacgatatgaactagtatatccagaacacaaggtatttgtgctgcgataagatggccattttatgtttctcttccattgcgatatatgcggatgggcaaatcgccacgatccacaccttagtgcaccatgatcggttctcagtgtgtgccatcccacacgccccgatcacggcgcatgacacgacatgcgcaaccagacagccagaaaatgatagcagctaaataaactagctacagggatatagataggattatctctgaatttccaacaataatctttttcttttcagcggcatgcacacttatagtgtacagtaagggccgggatctcgtacaagctagaagaaaaggaatattttataccacttacttagcatcacaacgctgcttccttcccacataagctcctccttgaggttatcgaactcctcattcgacattacggccttcttgtcgtaataaaaggcctaaagagaaggaaaaagaggaatctaatcgaattaaattgtgactcaattgacttgtaagtatagtgtatgtaaggtaggaggtagccggattcaacaagagggaagggcagggcagggcacgggcctgcagcgcctggagaaactcctgctccatctccccaatagtcttcttctccttccggttgatgctacagtaggggagcacgttgctgtcgactacaccgtcttcattttcttcttgttgttgctgctgctgcacccctccttgctgatcagcagcctgggcggcccaaacccggtgatggagtctccagccctgacagttggaccaaccgtgcgccgaagatgacgttgtgatgcggcaccggcaccggcacctcgaggacgaggatgtggacgccgcggcggcggcggcggtggggaacaccggactgggtaggagcgaggccatgaaggcacgcgacgccggccaggccagcagctagctaggcgaggcaacaggtactggtagtacaagagagcggcaacgggggaagcggccggatcactgcgcgtgtgcgggagatgcggtcgtgcgaaagggataaggtggtggtggtcttggtgaacgggggagcgatgtgtggtggtctggcgctcccctcctttatactgtgatgatcggaaaattacacgccaacgacaaaatcagacattgacgattggaagaatcgcacggacgaaacggattgacggacgagaaatcttaatcttaactaataataataataattaataataattattaaaagattgatatttttccaatcgtcacccaaaaattatcgtccgtaaatccgagtggcatcctccgtcccgcacacatgtgttcattgcgtcgccaaacaaaaaaaaaacagagacagattcaaaatccttcgcgtaaataacaaattttcccgttcgtcacacagaaattttcgtccgtcctccaaaattttgaccgattcagtgcgcatgctttctgcacgacttgtaggagtccgcatcaaatacaaataatccaaaaaaaaaacaaaattgaacaaatcgatttttaatagaggcaaacaaaaacaaaattgaacaaagacaggcagggaggataccagattcaacaggaaaggaagttggatgcggattcgatttgaactcaaaatcgaataaaattaaccccataaatacacgaaagagttactacaagcaatcgaacaagtcacggagcaattggtgatatctgacctgatttcacggaggcgggtttaattcatctccccatagatgggacaggtcgtaggcggcggttggttcgtgaggaggtggagggggttcggtgggcctccggcgaggaggcggcggcagggctccgcctccgatggggcggaggccatgaggacgtggcggccctcaacggcgagctcctggatgttggggtgtcgagggagccaggcaatgattcctggaggatggcgcattaggagcggcggctcccacatgcgaagacgtcgagaaagcaggcggcggtggcaatcgtgtgaagcggaagcaaggcggggaaaaggactgtaaagtagaaaggggatcgatctgatctaatcgaaccaaggagtggtttttcttcaccgggaaaattaaaaccgaccagttctttttttacaacagaccggttcttttcagaacatggaaaccgacccattatattcctgttctttttctattattttattatgtaggctcccacaaagtaaaaaactactgcacagaaaaaaggaagcaaatcttatcttatcgtatttttctgttcatcacgaaggcgctttcgtccgttggcggggcgtcttcgcagcctccaaatcaatagctctgagtcggatacaggaaacacatcccaaaatcgacacaaccaaaactcaaccactctttgcccaaaaaaaacaaccacaataatcaccaaatcacaaaatacgtcacaaaacttcacaaaaatatacataaaaaagaagaagccgccggatccgccaccagccatcgccacagccaccctacgccgttgccatagccgtcctcggccgtcgcaaccgccgccgacgccaccacagccgtcggagggagtcgccgttgccggatccgaccgcggccgccgccgcctttgccgtgggaggaaggcaaacgggggtggaggaagccgccgccgatccgcccgcggccaccatcaacccgccgcaaccgccgccgtatccaccgagggagaggagaagggggcgagagtggcgagacagtgtagagggagcggctgccggcgagggaggcgagacagcgtggagggagcggccgccgccgccgctcgcggggagagggggaagggcgccacagtagccgctcgtggggggagggcgccgccaacgctgctcggtgggggaggtcgccgctactacgggggtaaggccgccatcgcttttcgattcgagggagagaggggatcggggcgagtgggaaggtggggagggaaataaaatctagggttagggtttggctacagatatttatgtaggtttggatcaatctgaaccgtccattcgatcggatggttccgggttctcccgctcgggccgtcggactattgggcctccaaatagacctgcaagtttgcgcaatcagagaaggagttaaaggaggtaaattagactttatttacgggatgagacagtaaaaagactaaaaatggcccatagagaaattggggtttttatttacatttttatttaaataaatgctgaaatgatgtttgtattgtcaaaattagcaatgaagctccgaaaattccaaaaaagtttcaaagagcgttattaatcatggttaatttaataaaaattaaatccaaccatatcatattattttacgacctgcggtgggaaaaggcgcagctactgtcgcttacgttgggagagaaggggtattgtttatgtctagaactatatcttataactcccatggaactataaaataactgtaatcattatcataacagtatttttttcccattgcaacgcactattaaataataatttattatgagctactatattactctctgtcattggagacttcggttaaaaataactttggttaaaaacaaatatttttagtttttttttgaacttaaatatttttagttttaatacaccgtaccgaagcacgggcatttaactatctggtaaaattactaataatcttttaattagttaagattaagattctccgcacgaatctcaatgaacattgaacggtgtagatatgagttgggtttgcaaccggttgcacaaaacgcgcttcccaactccatccatcacggtgcgtcatctcagcctcgcgcatgtagcccgtatctaggtagtttccaaattctaaatttcccgagttaaacacgaaactgaaaggaatcaaactctaatccacccaataaaaaatcagcacaaggatacataggagaagaccatatccaaatttccatctggaaaaaagaaactaaatgactaaatgaatcggactctaatccaactaaaatcggatatgagaatttccaactccaccttgacctccttcttcaagcttgctgctggatcgatggtggctagggatcgcttgatgccgcggtcactagccgcatgcgccctcctcctccaccgctgcccatatcaagagaagatcgggtggtcgccagcctctgcccatcgccagctttgcattgctggccgccctccgtcgtgggcctccactttgcttgtgagaaacttgagaggtgaaggatgggaggaggaggaggaggcagagtgtgccggcggctgctcagatgctcgatctggggttggcaaggttggtttgggaaagatccgggtgagtgtaagcgatagggaggttgaccggtcgcttttctcgccctttatccacgcacgcggatacatcgacaggatagggggagaaaacggtacggtttcccttttctatttttcctacttagttcgcgaaatgaaaatttttatgtgtcacatcggatgtttgactgaatgtcggaagatgtttttggacacgaatgaaaaaactaatttcatagcttacctgaaaaccgcgagacgaatcttttaagcctaattaatctgtcattagcacatatagtttattgtagcacttatgtgctaatcatggactaattagactcaaaagattcatctcgcggtttccaggcgagttctgaaattagttttttcattcatgttcgaaaaccccttccgatatccggtcaaatgtttgatgtgacacccaaaaattttattttccccaacttcaacacaccctccttaagctaagcattcaatacagtcagaaactcgtcaaaaaaccttgaatacatgtggacaaaaaactgatctctgcaaagttcagaaaacgatgaacagagaaggacgcgttctctcgtacgatcctgaatagtaaacagcaagcaccataaatggactacgtgtagcttatgcaaatctttacgcattagaatgtgtttagtcacactaaaattaaaagtttagttgaaattggaataatgtgacggaaaagttggaagtttaagtgtgtgaaagtttt

SEQ ID NO: 15321 - DNA, 4367 bp, Oryza sativa
cccatttagctccccaaaaatttttcccaaaaacatgacatcgaatctttggacacatgcatgaagcattaaatatagataaaaagaaaaaactaattgcacagttatggaggaaatcgtgaggcgaatcttttaagcctaattagtccgtgattagccataagtgctacaataacccacatgtgctaatgacggcttaattagtctcaaaagattcatctcgcggtttccaggcgagttctgaaattagttttttcattcatgttcgaaaaccccttccgatatccggtcaaatgtttgatgtgacacccaaaaattttattttccccaactacaacacaccctccttaagctaagcattcaatacagtcagaaactcgtcaaaaaaccttgaatacatgtggacaaaaaactgatctctgcaaagttcagaaaacgatgaacagagaaggacgcgttctctcgtacgatcctgaatagtaaacaacaagcaccataaatggactacgtgtagcttatgcaaatctttacgcattaggatgtgtttagtcacactaaaattaaaagtttagttgaaattggaatgatgtgacggaaaagttggaagtttaagtgtgtggaaagtttgatgtgatggaaaagttggaagtttgaagaaaaactttggaactaaggctatgtttagatccaaacttccaactttttcatcacatcaacctatcatacacgtaactttttagtcacatcatatcagttttaacccaaactttcaactgtagaattaactaaacacaaacttagtttagctcgatcaacgtaccgaaaaaacctactactccctcagtcctacaatataaaggattttgagttttttattgtaacgtttgaccactcgttttattcaattttttttttgcaaatataaaaaacgaaaagttgtgcttaaaatactgtagataataaagtaagtcacaaataaaataaataataattttaaaaaattttaaataagacgagcggttaaacattataagaaaaacttaaaatcccttaatattattatgggacggagggagtattagagtttagtggtaatctcagaggtcagcgacaaacatcccgtgtagttttgctttgttgcctctgaaaagcgcgtcagtttctgaaaatctgaatctttctttttttatttcttgagctgctgtctgctgctaggtgagtcctccgagtgcattgaatcgatttcgacgcgcatctcgccttgtcgtttgcgatgtgcatgagtgatctctacgatacccgagtgatgtctgtctctgaatcttcagactttggaatgagctgtaatctgtaggtccatcacttctcagaagcccaccaccatagtagaaagagggttcagtagaatgtattctggttcgctaaaatatcactctaaaataaaaataatatgttagaatattagttatgaaggtattttgtaaatgacacgctaaaaagttgacattccgatgaaatctatgatagcataatatcgattttgtccctagctacagactttccctggatcaagaacagcaaaatgattcagaaaagtgacaagtttttgtgtgagcactggaggcagtgttcaagatggtcattgaagtgattactgatcctgacattatgaaggatttattggccaggcggagaggaggacgtatgctcagcttgacagcttgctgtagcaaaagaaggaagatgcaattggttaataatggccctgcctaactaattcagacattgcaatttgttgcatgatacgactcttatggaccatcatatatatcgctacctgttgtggtctcgccttctttttaatttggtcagtgccatggtcgatcgatcagcaatgatcatcacttcatcagcatgcatgcatgaccgtgccattataaactaaactataaattctcagaaactaaggtcactatcactgccttattataccaaggtctcatcaaccacactaatatctctctgtagttaattcagacaatcagttaccactggaagcactactactattcacctttgcactatggacgcacggtgatagagccagcgacacgccaacaccgttgaacctgaactacaaatagtgtttttcgatgatcagccattttttttcaaatatcaacgatattcgagaaaatagttggcagtgaggacgcaacgacaatactactaagtattttgtagtcacaagaaacatggtcgaatgtagtgttcctcgagtccggaataccgtcccaaaacacgggggacattttcatcccatcatgtaaaaacatctcataagtagcatatcacttttctcgatcccaccaacttaggaatttcgtgactatacacggatttcttttttttctaacagtcaaaccgttaccgacattttatatatagaagaagtgtcccattttaaggagagaacgggaccaaaccgtacaatgcaccattaattagagaaaactaggtaaaaaccacaactattacgacattccaccaactaaactaagctaccaaaaaaacgagagcaggacaaccgagctctacgtactcaacaaaagccattcatgtacaacaagctaaaagaaaacagggctcccatacactggcaaagacgcaatgttatcgtcatcacaccaatacttgggcgactccgactttatcagaaaataccagggttaggacaacaacctagtccatactgaagcgcaactcaattagggtgtgtttagttggggaaaatgaattttttgagtgtcacatcgaacgtttgaccggatgtcggaaggagttttcggacacgaataaaaaaactaatttcagaactcacctggaaaccgcgagacgaatcttttgagactaattaagccatcattagcatatatgggttactatagcacttatggctaatcacggactaattatgcttaaaaggttcgtctcgcgatttctcccataactgtgcaattaattttttttatctatatttaatgcttcatacatgtggccaaaaattcgatgcgatgtttttgggaaaaattttcggggaactaacaggcccttagactgatgtcatcgttgccacacaactcaactagaccatacactgactatagttgcgtgcagctagctgtgtgttggatgcacacggactacttcagccggcggcggccggccgccgccggtctgatatcccggcggccaaccaccgtctcccgtttccggcgtgcggccgccgcgcgcgtggggtcgcacgtggctgcacattgcgatcgatatcgatcatacggcgacgacagtaatggcgctagcttagtacgaagctagctagctattaccacgtatataccacgtaccaaccgttggatggatgaagaatgctgtagtacatgcgtgcatgtgagttgctgacctttgtcatcaaatcgatcatgaattcaggactagaataccaatttttggagtcttggaagagcaactactaattaaatcacacatcagtttgacataaagaaatgatacagaaatgcagaaagtttcttcagagtcgcattgattatactaaacaggagtgatttacaagtgagtccatcggctcaacttgccctaatttgctagcccattgccatgatgtgattaattaagcgctgtgatttattataatcacttcatgaactcaaagctttgcataggggcttaggctatatactgatactctactacttgtcctgactcctgtatggcttgtcattaggattatctaactttgtcagattggcctatgggaagacactttcccttttcgtgttgatgaagtatggaggtaaatgtaattaaattaaaaggaaaatgcattagaaaatccggccagcaaattaaaccatgttcaaaagtctccaaagcaccatcagttcatccgttcacaccctttccaaactgtcatccaactcatcagagttgaatactgggcaaagtacaacgtacatagtatgcattgcatgttaagaaagacaagtacttttctgaaagataagaaaacggcaattatttagtactagatactcccgccgtttctaagggtgtgttagttcacgccaaaattgaaagtttggttgaaattgaaacgatttgacgaaaaagttgaaagtttatgtgtgtaggaaaattttgatgtgatggaaaagttggaagtttaaaactaaacacagtgaaaatatttgacgccgttgacttttttaaatatgtttgaccgttcgtcttattcaaaaacttttgtgaaatatgtaaaactatatgtatacataaaagtatatgta

SEQ ID NO: 15322 - DNA, 514 bp, Oryza sativa
  unsure (1)..(514): unsure at all n locations
ctcggtacccatttaagtgcgccctaaagctacaatcaccacgcacgaagccacgaactcccttatttccacgccctaagcggcatttcccaaacccacctcgatccccatacgatccaaccacgagtcgcaagcccgtaacatctagcagcgcatgttcagagacaaaaagcaagcgacgatttgagcctatagcgagctcgaagtcgcacctcttcacggagtcaggccgcgggcgagagcttccgccgcctccaccgccaccgccaccgccaccgccaccgccaccgccgcccgatccgaggcggtccatgacggagcgcttccgcccggagacactatcggagtacatcgcggcggcggcggaggcgatgccgctagggttttcgtcggcggcgaggggggcagcggtggagaggccggaggaggcggaatgggaaaagggggcgacgtggaggtgttcctcggaaattnnnnnnnnnnnnnnnnnnnnnnnnnnnnnnnnnnnnnnnnn

SEQ ID NO: 15323 - DNA, 810 bp, Oryza sativa
  unsure (1)..(810): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15324 - DNA, 538 bp, Oryza sativa
  unsure (1)..(538): unsure at all n locations
atatacgacagtgagtttgtgatagcgttcgctggattggtgccgttatattatgtccacccaatgcaagtaacattggaagctcaattcttaagacaacatatatccatcattaagtgaatgcgagacatccctgctaattttcaggaaaaagagaaaatgattgtaagcattcttatcaacactgcacactttatattttgagtttctccaataacattaaaacgataggagagacaggaaaatggatgaactgcaaacagaggaatgtttgtgtccaatttatataaaaaaaatactaggagaggtttttttttaattcagtcatgctaatgttgtcatgttaatgcttaatcgttgctttttatttaatattttttttcgtcaggccctgatgagcaaagacttttggaagcatccatggcttatgtggctggcaaccccattatgacagatgctgaatttgatgaactaaagctgagattaagggttggtctttcttgtccctnnnnnnnnnnnnnnnnnnnnnnnnnnnnnn

SEQ ID NO: 15325 - DNA, 2074 bp, Oryza sativa
cgacccgtccctgaagcgggcgcggcagcgactgctggcgtcgcgcggcgtcgccgtgctcgacgccgacatcaacgacgccgcgctgctggagcggctgttcgacgcggcgcgcttcacgcacgtgctccacctcgccgcgcaggccggggtgcgctacgcgatgcgcgcgccgcagacgtacgtcgcgtccaacgtcgccggcctcgtcagcgtcttcgaggtcgccgccaagcacgccgacccgcagccggcgatcgtgtgggcgtcctcgtcgtcggtgtacgggctcaacaccgacgcgcccttctccgaggagcaccgcaccgaccggccggcgtcgctgtacgcggcgaccaagaaggccggcgaggccatcgcccacgcgtacaaccacatctacggcctctccatcaccggcctccgcttcttcaccgtgtacgggccgtggggccgccccgacatggactacttcttcttcggccgcagcatcgtcgctggcgagcccatcacgctgttccgcaccgacgacggcgccgacgcgcgccgcgacttcacctacatcgacgacgtcgtcaagggctgcctcggcgcgctcgacacggccggcgagagcaccggcaccaagtccggcaaagaagcgcgggccggcgccgctccgcgtctacaaccttggcaaacacctcgcggtgccggtcacccgcatggtccgcatcctcgagaagctcctcggcaggaaggcgaacaagcgcgtcgtcaccatgcccagcaatggcgacgtgccgttcacccacgccaacgtcagccacgccgcgcgcgacttcggctaccgcccggcgacccccctcgacgccggcctccgccgcttcgtcgactggttcgtccactactacaagctcgacacggccaagatcgccaagggcaagaggaaatccatggccatgtccgccgcgtcgtgacgtgtccacccaattgtccttggaggctagcactcgtcctgcaacttttttcagtgctaatttgtttaaaagattgctgctttgtttctccatgatggatgcaatcaaccatgctgaattttgcttatgctgcttaagcaaaatccatggctagtagagagaaaaagaaatggactggagtatagataagatgacagagcaaaaaaaggaaggagccagggcagaagaagaaagatgatgtcactggaatccttctggtttagaatattttcctctgaacttattcttttcagttaattaccatcttgttcttgttcatttggtctcatttggtgtgattcctgaatgatcatgccagcaacaagaacacaagatgctgtagtgggtgtaaatccaagcagcttcaggctgccataaaaaaatttatatatatactttaaattttggcggtggactttgctgcgatttctttctgcatttataaaacctgtccagttttgggcactgttctctgaaccagagcatcttactgcatgtggagtgtttgtgaattctgtgtgtgtgtgacttgcttctgatttctctggcactatctgtgagagattggtagtggaattggatagttggtgatggaatggaatacaatcgtttgggaatcgatgctgctgctttttagatagcatccatgaaaggttgaagggagcattgagcattttggtacagtgactgactacagtgatgcagcccccagttcatgctgttcagaaagcaactcctgatgatgtgtccatcatcaaaaatctcctaccaaatacagtaattcttgagcttcaagctgttttgtatgttcatttcggccgtgtttagttccaaagtttttcttcaaacttccaacttttccatcacatcaaaacttttctacacacataaacttccaactttttcgtcacatcgttccaatttcaaccaaacttccaattttggtgtgacttcactatctatatttaacattctgactgatgcattagtgtgaattctgaattcataagggggaagtgtgagtggaagattgctgcaacgtgtgtacacattggattcctgcttaacccaatttg

SEQ ID NO: 15326 - DNA, 456 bp, Oryza sativa
  unsure (1)..(456): unsure at all n locations
ttcgagctcggtaccccttccaaataaataatctatgaccaaatgcagtttcgaagctgatgaatcgcactggggaaacgaaaatcccattctctgcaatttacaagtacattgataacagcctcaaaatccatctctatttgcaccatccaaagcaggagcacttctgcaaattaaaaaaaaatgtagagctcaaatgagatcagaaatgtaaaagaaatcaagaacctagcggagccatcgtttcgcttattcgcggaataagtgaaacactatatttacaaacaaaaaataatttgttaataaaacttttatatacgtgttctagcgatttaaaagcaaaggctaaaaaataaattttgataaaaaaccttaaaatcagctaaatttaaggttgaaaatttaaattttgnnnnnnnnnnnnnnnnnnnnnnnnnnnnnnnnnnnnnnnnnntt

SEQ ID NO: 15327 - DNA, 653 bp, Oryza sativa
  unsure (1)..(653): unsure at all n locations
ccatccgtccagcttggcgtgcctgccgcgnaggcggaagcagtggagggagaagcggcgggcggggccagggtgttcggcgagaatcttgaaggcaagggcgacgcgcttccgttcctggccgaagagatcgtaaacatcgaggttgaggggcgcgagcgccacagggggcgccaccggcgggagacgagctgcgtgcgggcgccatacttggtggggaggagcgagatgatttcgccgaggatggcgtcggggaggccgctgatgaggtcgaggccgccgctcccgggtggctcctggctgctggaccgctcgaatctacgcttcttgcctgtgggcggcgccgccgccgccatcgccggcggcaaacgagacgagggatttgggggttttggtggaatggggaactagggtccgagaaggcgagaatgtgtagaggacggcagactggaccatgtgccgttcggtggatctgatgccgttggtgaggtatggatggctgtgattgatcttgtctttcggcgtgcttaaccagggaataataatggagggaaaaagaagcgggaataggaggcgcacgcgcgccaaattttgttttnnnnnnnnnnnnnnnnnnnnnnnnnnnnnnnnnnnnnnnnnnnnnnnnnnnnnnn

SEQ ID NO: 15328 - DNA, 673 bp, Oryza sativa
  unsure (1)..(673): unsure at all n locations
nnnnnnnnnnnnnnnnnnnnnnnnnnnnnnnnnnnnnnnnnnnnnnnnnnnnnnnnnnnnnnnnnnnnnnnntagatcctcataccagcgtaccccaataccctctatatccggtctacgggtatcccccatcgacagtggcgtgtcaggtaggggaacttggtgctcaaggttctactaatatgtcatcaagcttcgttgacaacagcgtcaaccctggcatcaaccaaggtgtttctacttcgacaatactgatgtggactcaaatcgtcttcctggtttacaccacggtgccaatcttgactggtccatcaatgaccgaaagcgagaacgctgtggttacaaccctggacggctccatgtcgaaggatcctcccgcaaaagtggagaacagaacatcgacgacatccgagcccgagaaggatcctagtgctgctaaatcttgtccttccgacgagaatcacgagccgacaaggacaacttccgaggcgacaaggtcctggtgtcctatccacaaaaccaggaaacataccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15329 - DNA, 1312 bp, Oryza sativa
ggctgagactattaacactgcttgctatatttcaaattgagttttcttgagatcaaaacttggaaaaacttcttatgaacttcgatttggacatcaacccaaagtttcacatttgcgtgtttttggttgcaagtgctttgtcttgaaatctggaaatttagataagtttgaggcacgttctaccgatggattgtttcttggttaccccacacatactcgtggctatcgtgtacttattttggagactaacaaaatcgttgagacttgcgaagtttcttttgatgaggctagtccaggtactagacccgatattgcaggtacattgtcacaggatcagggggaggatggtcgtatttttgaagacgagagcgacaacaacgacgacgacgaggtcggctcggccggtcagatcaggcgctaggccggtcagactgccggcacacctccggtcagactggcacaggaggtgcggtcagacccgccagggttgtcggctgaaggttctggtgatgctgttcgagatggtcctccagaaactacaacttcgaccaatactgatacagaacgtggatcaacttcagaagtcgcggctcctttgcacattcaacgacgacatccgccggaacaaattattggtaatataggtgagcggactacaaggtctaaggtaacgactcatgatgtttgtgcaaattctatatttgtagcttcttttgaacccaaagatgtgtcacatgcattaaactgatgaatcgtggattaacgccatgtacgaagaacttgaaaattttgatagaaacaaagtttggactttagttgaaccaccttctggacataacattattggaaccaagtgggttttcaaaaataaacaaaatgaggatggtttgattgtgagaaataaagatagacttgttgctcaaggttttacttaagttgagggtttaaattttgatgaaacttttgctactgttgctagaattgaagcaattagagttttgttggcttttgctgcttcaaaaggttttaaattgtatcaaatggatgtgaaaagtgctttctaaatggttttatacaggaggaagtttatgtcaaacaaccacctggttttgaaaatcctgattttcccaatcatgtttttaaattgtctaaagttttgtatggcttgaaacaagctcctagagcatggtatgataggcttaagaactttttgcttgcgaaaggttttacaatcggaaaggttgacaaaacgctttttattcctaagcatggtgataatcaactgttcgttcagatttacgtggatgatatc

SEQ ID NO: 15330 - DNA, 7671 bp, Oryza sativa
  unsure (1)..(7671): unsure at all n locations
nnnnnnnnnnnnnnnnnnnnnnnnnnnnnnnnnnnnnnnnnnnnnnnnnnnnnnnnnnnnnnnnnnnnnnnnnatggagaattgcaagccaatttcaacaccaattggttctacagctgtgttgaatcctgatgaagatggtcaagctgttgataaaaaggaatatagaagtatgattagatctttgttgtacctaactgcttctaggtcagacatacaatttgctgtgtgtttgtgtgcacggtttcaagcttctcctcgtgcttcacatcgtcaagcggtcaaacgaataatgaggtatttgaatcatacacttgagtttggaatttggtattctacttcatcttctatatgcttaagtggatattccgatgctgattttggtggttgtagaattgataggaaaagtactagtggaacatgtcattttcttggtacatcattgattgcatggtcttctaggaaacaatctagtgtttgctcaatcaactgctgaatctgaatatgttgctgctgctagttgttgttcacagattctttggcttttatctactttgaaatatcatggtctaacttttgagaaagtacctctcttttgtgataatagtagtgctatcaatattgctaaaaatcctgttcaacactcacgcacaaagcacattgatattcgttttcactttttgagggatcatgttgagaagggagatgttgaattgccgtttttggacacaaagttgcaacttgctgatattttcactaaacctttggattctaatcgttttgcttttcttcgtggtgaattaggaacaattcatccttttggcatggtttgagggggagtttgtatcccatggttttatcaagcaataatatgacaatgagaaaaattgagaaaagagagctttgttatacatatggtattttcttgtgcatgctagcaatactatgaaggttgatttgtctctagcatagcctgtatgtattctagtcctttcatgagatttagattttgcttttaagggagatgatgcatgacacttaaattctctacttgaattaagcaaatatgcaatgttgatgctagcatgtggtttgatttctaaatgctttatatatatgctttattgaattgttatttctcaaatagctttaattgctcattgtgaaaaagagaataaaaatatgaaaaaaaatgaataccgaatccttggaaacagtcttgacgacaaggacgtattcaatgtgagcaaaataatgggtgccgaatccttggaaacagtcttgacgacagggacgtacccgtaataaaagagaacaatatgagcaaaaaggctcaagaaaagaaaaagttgaaaagattctcttggttattttgtgctaaaggttatttgagaaagagtgataaatgcaataggtatatgtgtttagtgtttattcttcaacctatgtgtttgctaagatgttgcattataaatcgtatgaaatcatgaattttgattgttgattcaagcttaattgtaaaatctttggttcatggttatactttaatgcatgcttgttatattatagatgggttcatcttctttttattgcaacacatgacatgatatgctatatgtatgctaagctcttgaacattaaagaacataattcctatgcttgatgaaatcattgtcaaaagggggagaagagatgagtttttgagaagcaaggtgtatttttagagcatgttttttggttaaattgggaatttctttcttttaaaaagggggagaagttttcttggttcaattgggaatttctttcttttaaagtttacttttggatttttgagcacgatgtgtacgtttgtatgaagtgtgctttttaccacttttgtttttatttttccaaacaccaaaacatttttgatgggtttgccaatgtgttcatcaagggggagattgtaaaatcaaatgtgtttttgattattattctgtgatgaacaattgggaattggagattattggttttgttatttggaatttattcacgaagtgagtttggagatgattggatttacaggtgaatcgcatgttcattatttcatgtgaccggtcagaccgggcagtgtgtgccggtcagaccggcgatgatcgagcggttggaccggccagcccgcggtctgatcggctgacgttgtatcggtttcgggttgttcgtttggatatccgtgattgtttcattattatggcttctagatggatactatacgtatgtaatactattgtttgctactaatgagacaaattggagataacttggtctcggaatatggtttctttgtttatttcatgtgtaggtgactcgatgcactagagggtttcctaaggtttttaggacttctagtatgagtttggttcgttactttaggctgcctacctcgggtataaatagagggggagcgtgaggcttccggtattgctttagagagcaattgagttgagttttgagttagggttttgagtttagtcgaatttttttgtaaggagtgctgttggtgcattttgtaaacacagagagaatcaataaagtcgttatccactttaagagttcttcgatttgtgtttaccgggttttggcggtgtaaccgacgatataccggcggcatacgggcgatcagaccggcggcggcaacagtaagcggcagctgatctcggcggtcagaccggagatctaatcgcggtcagaccgatagcaaccaggcggtcagaccggcagagcaacttcggtcagactgcgatctgtcgaattcgagggtaacttttatttccgctaaaagttttcggtttttgggtatatcaaccattcacccttctctggttggcttagtttttgtaattcgatcctacataatcaagaaaaaggaaaaagttcaacaagtaatataatttagaaataactgaaattcaaaattaaaaataagaaatattataagaatagtacatataaaacccaatatgagaataattaaaatttgaaaaagaaaagaaaataaatctaaatttagaaaataaaaatgatagttgacatacgaatacaatttagatttaactgaaatttaaaattaaaaataagaaataatgaaagaagagtctatatagaacttgtcaatgttctatatatggaatactctgtactctactctatagtatgtcaatgatagagtgctggttatacacttgccaataattttcacaggatttgttatttcaacaaaccaagtaatcgacagcataaacagcatcctagtgatacaatgcctattccagtatttgttttcaagcaagacgaaaggattagggatatttcttttatggtacaattgttaaaaagcgtgggctccacgtgctcttcatgtagctggcatgcgaaaatcacttacaggtatacatgcgaaaatagatttattttttaatgcgggtgagtaaagatgtccgtctgttaaaattgattttttttatatgagtcttttaagtagccgtatataaaaatacatatcgatttttcaggcatgatcattattgttcgcttacaaattataaggggtactcgtacagaaaaatcgtgaatggcatgcggtcaggaggggaagccgagcattactggtgcctctctggacgtctctgccgttcttgtgtgggcgcccggcaatgaggcgtgcagtaaattagccaggcgagtgtggcgaactgacgatgggtatggccctgcagcaagaatggcgggactgcacgagcgcagagagtcggttcgtggagattatcacttcgttcgataattagatgaatgaacatgggatcaataaacagaagggcaataccgttaagggataatttcgttactaccccaatattgattttaccattgttttataaggtttttgtttttagccccactttttccaattgaatgaggtgtttacctatttttgaccgaagggactggagccagattgaggtaaagtaatagggaaaataatttttcaaaatattgatttacttttgtgcccatagagaatttggtactactgtgaccgtctccctccactccacaaacttccgatatttttgtcggattatccgataggccgtttgccagataatccgaaattattaatatatgtaaccactctatctattgcatataacataagttggtacatccaatagcctaattcatcaattaacatagattttttagtctaaggcttttatcgtctcatgtcacactcacgtagctatatttttatattatggacatcatgtagctatatctatactagtataaaaaggggaaattatctccttgcaatcctacaagctaaatcaacatgttgatcctaccatcatctgcatcctcatccgtatcgctctcatccctaccgtccactacgattcaccctcgcacagcaactccatcctatctccaccgtgattttcgctcccatcaccacgcgaagacttctcccgtgctactcgctattaccgctctcgaaccccttcctgccacacccccgcgccgcggaatttccctgacctgccaccatcgccgtgtcctcctcctccccacccactgccgctgcatcgcctcctcctcatcgcctacgcgtcgtcctccttcgcactcacctctgctgcatcgcctcctccacacggcctccgcgttgtcctcctcctcacccaccgccgccgcgtcctcctcctccccatcacccgccattgcctcgctgatctcctctctcagcgccaccatcaatcccgcggcggtcaccgtccccgagtcccctttgccggctcaaccgtcgtcgtcagatccaccgacggggtgaactcggcaacggtggtccagtgctcgatccctaacgcatgtcgcgccgtcttgtccaccgccgctgcgtcctcctcctccccaacacccccgtgttgctgtgcctccctgacctgccaccgctaccgccgccgcgtccgcctccccatcacccacagcgtcgtccttcgcctcgccgataacctctctccgcgctgccatcaatcccgtgatggccaccgtcgctgccgtgcagccgtcgtcgtcagatcctcctccaccgccccaacgccggttgtgtcgtcctgcccgcaacacctgcgcaccctccgccgcttgatattcctgcgagttttattaagaaaaatactttttttcctgctgttgttacacttgctgtgtggagagaaaactttgtcagaagctaaatattgttgttaatgttcttggtcaatcttttttcaggcattacagtttgcaactgagctatggcagaaattgtgatggctccatgttatttgcaccaactgattaactgaactatgctatacacatgggagactttggttaaaggattagaaatcagagtaattggaaaaagatacatgtccaatgctaatgcaaaggcttgtagaaagattatgtagagtgtttacccgaaataatctctagacactacaacacgatcatgtactctgagagccttctagctacttcagactgtgacagtgcttacctctaaggtattgtttcccttgcactctgaattaacatgacaaattctataataaattatatgcagatatcaatttgatttacctccgtacatgctgcaatagaaaagtgcaggagctgaaatatttcttcgccaggtcaagcagaataggaacctaaacggtcaggtataaccctaaggttctttattatgtttcacccgtgagtggtcatgtggtggtttgtgtgcatctaactactgcatcgactaacagttcaacatgccctattgatccggtgctaatccccaagagctacttgattaagctcactacacaaaacaccgtggatatgacttcatttggtgaatattaatgtatatacattatgtttcgtgatatgtacatatagacatatcaagtaatggttttgttgtttatttgtagttttgttccatactccacaaaagtagaaaatcaatgattaagctcaattatgatttattcctagcagcttggtttatgtgacttgggactgctaaacagtacacagcatattttgtttatagtgctctagataatatggaggctctagacaatggtgtcttggagctccttttggttaaacaacatatccacacaaacaaggtacattatgcttgctctcaggaaaaaaaaaagggttcattttattcagtgattatgcttttcctctagaaatcattagctgtagtgttagattcacaatttcattcatttgcaagatattcaatggaatttctatgtgagtaaattgttgtgcatatgaaggtgcatttgacaaaggtcaaggggaattggcgaactaatcagtacgacaactgttggtcaactaattatactgtcttgtgtttagttttaacaattccattgtttcaggctacccaaacttcagacagaggcagaggagcaggaccacatgaactccttaatatagatgatcaacatgtctccatatctatccaggatgttggtcagaggagattttgttcttttatttaccattgattggcctctagttgatgtatctaatttcatatactccgtaagcacaacatgaaggtaatatccatacgtgcaagattatttcttacttttagtttttactattttataagataacagattttctaaggtgcttgggaggcattatatccgttgatggcttctaatctgacaatctgtaacaaaaggtagatataggaaggtattacaaatgtgggccaaggtattaagtaaaaattgggtggagggttatataggtaattttgtacctgatatcacattagaaggcaacggttgtttccaactaactgctgagataaactcggtaactacacttgaaattaggtaacggggaagaactagcaatactacaaattagcgacatcaaactttttgcaatcctgcatgcaactttgtaaataaaaacatagccatataactaagcttgatcctattcaagtaaggtcgtatactgtcaaaaataaaactaagcttgatcaaacaagaaccaagtaataatgcaatttagttattggaaattgtatgagtgccgtcataaatgaaatatacatatcaaggagccgattaccatctacgccatggagaaatcaaattgcaagaaatcaaattgcaaggagtgaaggttatcgaatgataatgattaccatataaaataattaattttctgtgtttacgttaatctctattccaaagttaccctttcagaaattaatggtagattttaagtagggaggaaggtacctcccatacctctcaagcaccgtaaaagcccccgtaagataattgttcactgagtcaagcaagggcaaagacctacatttgagcagtacctattagtcactggtggagaaaccatctttgctcggtcggccaaaacccacaatagtcccggttgtaataaaaatcgggattaaagattatctttagtcccagtttaaaagtttagagctgctttttgatctttagttaccaaccggcactaaagatctatttctagtccccgaaggtaacaccaaccggggaaaaagatgcctactatctttag

SEQ ID NO: 15331 - DNA, 918 bp, Oryza sativa
ctctgaattaacatgacaaattctataataatttatatgcagatatcaatttgatttacctccgtacatgctgcaatagaaaagtgcaggagctgaaatatttcttcgccaggtcaagcagaataggaacctaaacggtcaggtataaccctaaggttctttattatgtttcacccgtgagtggtcatgtggtggtttgtgtgcatctaactactgcatcgactaacagttcaacatgccctattgatccggtgctaatccccaagagctacttgattaagctcactacacaaaacaccgtggatatgacttcatttggtgaatattaatgtatatacattatgtttcgtgatatgtacatatagacatatcaagtaatggttttgttgtttatttgtagttttgttccatactccacaaaagtagaaaatcaatgattaagctcaattatgatttattcctagcagcttggtttatgtgacttgggactgctaaacagtacacagcatattttgtttatagtgctctagataatatggaggctctagacaatggtgtcttggagctccttttggttaaacaacatatccacacaaacaaggtacattatgcttgctctcaggaaaaaaaaaagggttcattttattcagtgattatgcttttcctctagaaatcattagctgtagtgttagattcacaatttcattcatttgcaagatattcaatggaatttctatgtgagtaaattgttgtgcatatgaaggtgcatttgacaaaggtcaaggggaattggcgaactaatcagtacgacaactgttggtcaactaattatactgtcttgtgtttagttttaacaattccattgtttcaggctacccaaacttcagacagaggcagaggagcaggaccacatgaact

SEQ ID NO: 15332 - DNA, 1004 bp, Oryza sativa
gctaatactagtaatatgtatgtccagtgtaatatatgtgatatcataatattcatattttaaaagggtttcatatattgttaattttatagtcattgataatatattataaaaaaattaatggtaatatcgaagacagtgtaaaaaacataagctctttatagtttggtatgcaaggagcacctgctttaagaggaaatcgtcatatgaagatgagggacatcatcttaggaaaatcatggtgagtacagcgccgttctcacagcaaggtgagctactgaggagtttggaggaagaaacagttatacttatatttttagtcaaataaaagctcaccgttcttttaccgatgagtggtccagatttgggctaatgcagagaaggactcatctgctgtagcaagagccaatgcagaggatccgacctctcccacctctccttttgcttgtggatggctatcctcccaccggatctgaacatccctagcttggaggctcatgatctagccaccaaatcccgccaccgcaggaggccgccctagccactgccatgaagtggagcggctgcttcgaccttacccccgacaaggcgcgatggtagcggcaatagccatggagctcgaaaggtgccacctccacgctgacggaagcggctttcccttcccagtcattggagcgcaatggagctcaacatgctaaaatctcaggtatgcttcatctacaagcaagattccttcatcgcactccttggaattcttcattctttcactgatggcgcgtcaagatggccaaagccaatatgcaaccgtatgtttagctgtccaatatttatcaccataggttgtgcatgttaggtgtttgataaattgcttgaatagatatactaggcaaggttggtgatagggatataccaattgcaaaaaatcaagaattttgcctcttcgtatatatatgcagtaatgaaggttgctacttgaaaatccaaagtacattctttgctaattt

SEQ ID NO: 15333 - DNA, 709 bp, Oryza sativa
  unsure (1)..(709): unsure at all n locations
gtcaagatcatgtcaagactatcctcctagctcaacccaaacagaaggacccgctaaggtttcgccacccgctggtccccgacaaggtaaaggttgctgatcccccgggacgagataagccccctcttgcgccaggtcaaagtcagccttccctggccccaaacctatcataccgatggcctttgttttgagatgatctggacttctagtcaggctttacccattagacttgtggttgcactgttatgcttcgcaacagaggtccgaagaccggtccttacagtggccgaggtgcttctaacaaaaccatgcacctcacgccccaccaaaaataggtttagagagttttgaatgagattccatcatgtccaggctcaaccagccacctaatcatcattctcacatattttagttgttacccacaggttaatgtataaaaagagattctatgtttgatctaagcgtatataagcccaacctaaagcaactaataagtccatcatatagggagccatactagtcattttatcattttactaaggttgtcaagagcatgggtagcaattcaataacatggctatataacaaggatcatatgaatattaactattaaataaataatagtgagcgtcatataatttataaaagcgattcatannnnnnnnnnnnnnnnnnnnnnnnnnnnnnnnnnnnnnnnnnnnnnnnnnnn

SEQ ID NO: 15334 - DNA, 685 bp, Oryza sativa
  unsure (1)..(685): unsure at all n locations
nnnnnnnnnnnnnnnnnnnnnnnnnnnnnnnnnnnnnnnnnnnnnnnnnnnnnnnnnnnttacttgttgaactttttcctttttcttgattatgtaggatcgaattacaaaaactaagccaaccagagaagggtgaatggttgatatacccaaaaaccgaaaacttttagcggaaataaaagttaccctcgaattcgacagatcgcagtctgaccgaagttgctctgccggtctgaccgcctggttgctatcggtctgaccgcgattagatctccggtctgaccgccgagatcagctgccgcttactgttgccgccgccggtctgatcgcccgtatgccgccggtatatcgtcggttacaccgccaaaacccggtaaacacaaatcgaagaactcttaaagtggataacgactttattgattctctctgtgtttacaaaatgcaccaacagcactccttacaaaaaaattcgactaaactcaaaaccctaactcaaaactcaactcaattgctctctaaagcaataccggaagcctcacgctccccctctatttatacccgaggtaggcagcctaaagtaacgaaccaaactcatactagaagtcctaaaaaccttaggaaaccctctagtgcatcgagtcacctacacatgaaataaacaagaaaccatttttcgagaccaagt

SEQ ID NO: 15335 - DNA, 536 bp, Oryza sativa
  unsure (1)..(536): unsure at all n locations
nnnnnnnnnnnnnnnnnnnnnnnnnnnnnnnnnnnnnnnnnnnnnnnnnnnnnnncgtcgtctgggttaaaactatcggtgacgggctttacttagggcctgattgagatatattcattcgtgacggccgtttgcccgattgagataactcttcacatcagtaacttctagtctgtgacggacgctgtgcccgattgagatggggcttaccgcccgattgagatgagggtatccgttctagtgacttataattccttctagctcgtaaatcttggcatcaatcttgccgaaccccgagcctgtctccacggtggtggcggagggcaccacaccgcgctcgttggctgagcctggttgtagcaaaagcatccagcttatagccttgttgcgcgagctggactccccacaccaccgaggacaatcattgggcaggcccgccctctccactcgacgacatcccagcggagggcgccgcactacactcgccggcagagcccggttgccgcaaaggagtcctattcttaacattgctatgt

SEQ ID NO: 15336 - DNA, 900 bp, Oryza sativa
  unsure (1)..(900): unsure at all n locations
nnnnnnnnnnnnnnnnnnnnnnnnnnnnnnnnnnnnnnnnnnnnnnnnnnnnnncaaaaattcaaatagattactatctattaaatacattcgaggaatgatggtcaggctattctggatatgccagccaaattactttccacatgtagcataattgtgcgtgtggttttaatttagttcagttggaaaaatgtatggaacaattcaagggcagcaataatattacacatcagaaaataggactgccatagccaagggaatgtattagtggtaaaaacttactaggttgcggctttaaataaagataactcattaacttgctgacatagtacgacactaaaatccaaacaagagaaggtacaaatataacatttgaacataatacaagactgcatgtgtatcatatccgagagcagcatggtcataaagacctatcaaagggatcagatattgacaaatcatgggtgtgcttgttcatactgaaatcactcgtatgggtagttttaaatgtaaattgagcattttgagatgctttcttttctaattgaagccgcctgtgttgattggccaaccatttctgattgcaattgttaaggccagctaactccatttctcttagcgcttttgcattcagaacaaagaacttggcaaagtcgacatctgaccttcttcctccataatttcttatcaccacttttttgagatggaactgaatgcattctattggatttagcgggtcatacctccgcgtatttttaataaccttaaacggttgagactgtaaatggaaagaaccatttgaaagcagttgctaactggttagcaatgtaatacttgacaagagtataataaaaaatgggaaatacttacagcaatatacagcctctccaagcaggggaa

SEQ ID NO: 15337 - DNA, 498 bp, Oryza sativa
aatatatagtaccgaaatttctcccgtaccttaagccataggcgaaatacaactccgaacaaagatgtggcatatggactattttccgctgttgcctccattggatgatctgagacacagtgattgggtactttggttgggggtctgaagcagagtggggaaggggagtgaggagaggagcaagaagaaaataggggaacggcatggggatgggggactatactgaataagccaaaaccacatcactacctcagtttatgacggtaggatgaacggtttagaaagttacagggtgaatttctaaaccatggttaaaagcgcaaggttgtagaataaaccttttcctttaatatttgacagcttgcatatgttcaaaaatgtcatctgtttaagaatgaaggtaacatatcagagaaaaagtcatttggaaactatgttcaattgtaaagctttggctgagcttatcagcaccacgtgaaacgaggcatgccattagcg

SEQ ID NO: 15338 - DNA, 9598 bp, Oryza sativa
  unsure (1)..(9598): unsure at all n locations
ctgtcccggtgcatccgtcatcacagaaacaataggagcatgtgaagaagcaaccatcttagcatgacgacacggtgggcaaaccaaatcaagatctttcttaagtttcggcaaaccacgaacaagatccaaaccacttaacctagtgagatgatcaaaaccaacatgtccaagtctacgatgccaaacatcacatctttatcaaacttagcaaccaaacatgttatcacaggtgaaacagaattttcaaaatcagctttaaacactcttccatagcgagaaatattcaacacagaatcaccacaagaatcaaaaactttacttccagttttcttaaagtgaacctcaaaattttcatcaacaatttgtgaaaccgaaagcaaattgtactttaagtcctcaaccaaagctacattcttcaattcaaatttttcatttaccttaaccaaacctgtagcgagaatgacacttgtagaagcatcaccaaagataatcgattcagtcttggatgcctttttaagagaggagaaccaatttttatcaccggtcatgtgccgcgaacaaccggaatccacgatccacacgttctccttccttgccaccaaagcctcatgatcttcatattctatatccgattcaccacgcgccatgaagcaaacaccggagatgttctttcccttatcttcatctccagtctcaccacctacatcacttgatggttcaaatgcggcgtagacttgatcaaaagcattcctaagattctccttgaacttcctcccttgggatgtacccttttacttgttgttgttggtcttctcaccatctttgtcttctcttttgcctctcccaagcttaggacaatgcgaacgaagatgatcaattgaaccacattcaaagcaacgatttggaccacctcttttcctgttcctggcattattcatagctcgagcaattctattagcaaccaaagccaaatcctcctcctcaatctgttcgagttgatcatcggatgtggcattaaaaatagccagaaaagaagacttaaatgaagaggcatcaacattcatagaagaagatgatgaaaccaaagcactcgacttaaaatcaactttccgagaaagaacattcatctcatgtgttttcaattttgtgtacagtgaatccaaagtcaaagtagacatgttaacagactcctgaatagatgtaacttttatctcccaaatagacatgtcaagaccattcaaaaagtgacgagaaatctcagattgtggataattagcatcataagaagattcaacagatctaagatcactcaaaattttattaaacctagaaagatagtcacatctcaaatttaatgtactccttttttaaaatatcacgatgaagttctttaatgttatttgttccttaatgagagttactcaaagcattccaaatctcatgagcagttcgaaaatgcgcaacatgatcataatccgaacgagaaataccactcaaaagaatgttgcgagcttcacaattttgttcaaacgcagttttttcagcagcagtattaatagcttcaggaatcacataagaatgagaaacttttctccaaatataaaattgcatcctactacaccaatgagaaaaatccgttccatcgaaaacatgaggcttagttcaaaacctagcaggagtagccatggcaaaaactctaaatcgataaaaatccaaagcagaaaacaaggctctgataccacttgtaggatcgaatcacaataactaagccaaccagaggggggtgaatggttgatatatccaaaaaccaaaaacttttagcggaaataaaagttaccctcgaattcgacggatcgtagtttgaccgaagttgctctgccggtctgaccgcctggttgccgtcggtctgaccgcgattagatctccggtctgaccgccgagatcagttgtcgcttgctgtcgccgccgccggtctgaccgacgcttgtcgccggtctgaccgccggtatatcgccggttagaccaccgaaacccggtaaagacaaatcgaagaactcttaaagtggatgacgacttcattgattctctctgtgtttacaaagtgcaccaacagcactccttacgaaaatttcgaccatcctcaaaaccctaactcaaaacaaaactcaattgctctctaaagcgataccgggaagcctcacgctccccctctatttatacccgaggtaggcagcctaaagccacgaaccaaactcatactaggagtcctaaacaccttaggaaaccctctagtacaagaaagatactttacatatataaccaatcgtaccaaatttggactccttccaaattcgactccgcatcccatcaactccatcgtatgccatatggaatctccatcaaccacgtgcatcaactctagcctaagtatcccgcatgatctctgaccaccacggacgtcgtcttatccccaagccgactcccggtccatcatcgcaaatactctcccgaggcatcgagtcacctacacatgaaataaacaaagaaaccatattccgagaccaagttatctccaacttgactcatcagtagcaaacgacagtattacatacgtatagtatccatctagaagccataataatgaaacaatcacggatatccaaacaaacaacccaaaaccgaaaccgacacagcgtcggccagtcagaccgcgggctggccggtccaaccgctcgatcaccgccggtctaactggcacacactgcccggtttgaccggtcacatgaaataatgaacctacgattcacgtgtaaatccaatcatctccaaactcacttcgtgaataaattccaaataacaaaaccaataatctccaatgcccaattgttcatcacagaataataatcaaaaacacctttgattttacaattgtaggatcgtaaagggcctttcctaccccaaaagctagccattgaggtgaggggctcccccacttatatcttaggtcctttgcccttccacaaccaatgtgggactattcaacaatctcccctttcacacattggtgtccctcagcccttcaccgccccttcaccatatccgggcccccaccggcccacggtccatcaggtatacaggccccgcaggcatccacggtccatcaggacgacacacgtgtccatcgggccagagatgttaacctagcctagctctgataccaattgtaggatcgtaaagggcctttcctaccccaaaagctagccattgaggcgagggggtcccccacttatatcttaggtcatttgcccttccacaaccaatgtgggactattcaacagattaatgtggaaatttctagtctctatagcgaacatggtggcttcttttcgagctatattaataatacaatactccattcatttcaaaatataaagagttttgcttggatgagacaacctatccagattcgtagtactaggatgtctcatccaaccaaaactttttatatcttgggatgtaggggtgaaaacggagcggatattattcgatccgatccgctccgctccgaatccgtccgatgtgaggatatggtaaggatttttggatatccggcccgatgtggatgtggatgcgaattttatcatgcggatgcggatgcggatatggtatcaactatatccgacggatacggattatccgatattttaactggattatccgatgtactgtttagcggataatacgcaactttcaagccacacaacaactctatttagcacattttacatcgggcggcccatctagcccatctagtgtaacctaatccaatcctcccctaaatctctctctgtgactcttctctcagtcccttctcctgctcccacacgcgccgccgcatggcaccataggtgcgccgtgccaccgctgcagcctgctggcgccacctccgccgctcctccttctagtccgtcgacagtgtgctgtgtgctgtaggcagtgtgttgtatggaactagtgtgttgtgtgctgtatgtagtgtgctactgtgctgtgtggctgtgtgctgtatgcctatattgttgtatgtctcattgcctcatgcctatcgtacttatgagtgaactactgaactgaacactacatttttaaattttaagcaatgcagtgaactgctgaactgaacacttatatcatgtttttttgatggatgtgttatattaagcaaaattatattattgatgtgttttggttggtttttcctagagagctgagatcatgttcatatgttgttttgccatcgtattgcggctaattgtattgccgccctcttgttgtatggattgaatacaaacttgacatccgacaactttttgtccatttccgaaccgagtccgcaccgactccacaccgaatccgacatccgaaataatccgctccgcatccgtacgtcatccacaccctctccgcatccgcttaaaaaaatagtttaggatatggtatagctattatccgtccgaatccgctccggtttcacccctattgggatgaaaggagtacatagaaatcacaaattttgatttctgaactgccatttgtactctctagttagtaattgcttcattaggactgccacgtgattcaaggaaggattctgcaaacatgtcagcaatatatttctgcattgggtttccaattgtaatttcattgatagatacagaaactagtcggcaatattttcttgcgcatctaagttacgtagtatatatctttctcaaaacttcacatgcaattctcgaatagagtatttagacatgcagacttaaggactactgaactctctaacaaagagcgcgacgacttcgggaaaaaaaaattacagcacacatatcccttcacaatttcaaatagacaaaaagcagagaacgtgttgcagatgtaaagcatagaaacacgtaattggaggtgtataatgacagacacacagtataatatgttgtgcagaaaaggtagctgtatttagctgatattatgttatgactccactaacggatttgcaacactaaccaaaattaaaccagaagtgtatatactgctaaaacaaatatggcttaaacaaaaaggtatacaagggattatcttttatttagataggcctagtaatggatgactcaacatgctgcactgcacggttctaaataagaacataaaagatattgcttaacgtcaaactactgaaagcacacccaatgcaacagttcttcacagaagtaacaaagtcatatttcatctctgccagtcacagttaactgaatttattatttcagaacataacaattagttggtagtacagatctaatcgcatgaacgttcagtaaaaagaactgccgccttatttaactccgagcctttatgctaacattaattctcatactattccatatgactaagtcattaaatagaacaccaaacactccttgtgaaaatataatatatagtacatcataatacatattgcaggaaaataaagacagtagcgtcacgttttcctcattttacataggcttaaatgggaccaaactgcaggtttaccttctccaagcatctaaagtatatgatataaatatgttgagaaatcctgatttgaatcttgaacttcacatgcttttgtatgcacactattttaaccttgtataaacatcaaaacaatacaatataatacatcgacgtgttgattggaactcacacgcttctgtatatattaatcagttgatacataaaatccacattatgttatcaaattagaatggtataatctgtgaaaccaaaaagcatccacaaatggcatttacgcaccaaaaattcaaatagattactatctattaaatacattcgaggaatgatggtcaggctattctggatatgccagccaaattactttccacatgtagcataattgtgcgtgtggttttaatttagttcagttggaaaaatgtatggaacaattcaagggcagcaataatattacacatcagaaaataggactgccatagccaagggaatgtattagtggtaaaaacttactaggttgcggctttaaataaagataactcattaacttgctgacatagtacgacactaaaatccaaacaagagaaggtacaaatataacatttgaacataatacaagactgcatgtgtatcatatccgagagcagcatggtcataaagacctatcaaagggatcagatattgacaaatcatgggtgtgcttgttcatactgaaatcactcgtatgggtagttttaaatgtaaattgagcattttgagatgctttcttttctaattgaagccgcctgtgttgattggccaaccatttctgattgcaattgttaaggccagctaactccatttctcttagcgcttttgcattcagaacaaagaacttggcaaagtcgacatctgacctccttcctccataatttcttatcaccacttttttgagatggaactgaatgcattctattggatttagcgggtcatacctccgcgtatttttaataaccttaaacggttgagactgtaaatggaaagaaccatttgaaagcagttgctaactggttagcaatgtaatacttgacaagagtataataaaaaatgggaaatacttacagcaatatacagcctctccaagcaggggaagcaactgaggaagtcaacaactgcatccagattagggccatcagaatcaagaaccaaaaccttcacacttcgcattgaggttgtaaggctgacagcagtcatttcctgcagaaaagaacacatcatatcaagaataatagccaccatcatttagcaatgaataatcgtgatttaatgaaacctgctgctacctgaaaaatcgttgttccaaggtggagttgagatatgccatcagagagtggtcccattatctccagtttaggcgccgcgatcacccggatggccgccacgccatcattgggacaaagtggcagtaatctttcaaggcaaggggcatcctcgatgaccacctcctgcaactcggcaccagcaaatccattccaagatgcagaagagaagccccaggatttcgaatagaagccgaagctcctgagagatgcggagttgatgcgaaggcggcgaacgccgaaattcccctgcagcagcaggctctccaatgcagggcagcgtgacagcacgccatggatggcgtcctcggagatagcgacgctgcacagcgtgagctgcttgaggcgagggaaatgcagcgtcggcggcatctcgtcggggaaaccgcagctgctgaggtaaagcacgacgagggtgggcgcgaaccgcagagcggacggcggcagcgggtacgcctgcgcctgcgcctcgcgctccacctcgtagctgaaactaagctcccggagatcggcgagggcgcgggagcggagccatccgtccagcttggcgtgcctgccgcggaggcggaagcagtggagggagaagcggcgggcggggccagggtgttcggcgagaatcttggaggcaagggcgacgcgcttccgttcctggccggagagatcgtaaacatcgaggttgaggggcgcggagcgccacagggggcgccaccggcgggagacgagctgcgtgcgggcgccatacttggtggggaggagcgagatgatttcgccgaggatggcgtcggggaggccgctgatgaggtcgaggccgccgctcccgggtggctcctggctgctggaccgctcgaatctacgcttcttgcctgtgggcggcgccgccgccgccatcgccggcggcaaacgagacgagggatttgggggttttggtggaatggggaactagggtccgagaaggcgagaatgtgtagaggacggcagactggaccatgtgccgttcggtggatctgatgccgttggtgaggtatggatggctgtgattgatcttgtctttcggcgtgcttaaccagggaataataatggagggaaaaagaagcgggaataggaggcgcacgcgcgccaaattttgtttttgatggagcggtgcccgtgctcgagattttttttttctatatacatgatcagcgtgttttctatcaaatcgttactcaaatatttagaacccagtacgactcctccatccgaccggtgtaacagcttctgcctgaatttcgtcaagctaaggctgtgtttagatccaaattttggatccaaactgcagtcattttccatcacatcaatctgtcatacacacacaatctttcagtcacatcatctttaatttcaaccaaaattcaaactttgtgctgaactaaacacagcctaaatccagtgcttgctaactttgtctcaatattctgtttttgcgtatatacacacataataaaaggtatagtgacatcgaaaaccataaagtacgaagtatactgtactgtccaatcattgcataaaaataaacatgctaatgtcttgtttagttcgtcgattgaaattagacctagcacttggaaggaagcggcaacaagtttgtaggttcgtgctgcacgcctacaacccacgaagattgacgttccgccttgttggtgatatgggcccggagtatcacgtttagagggaggaggccacccccaagcccacgtggctcccctcgaggggggtcgagcccagggtggagcagcggctaccccctcccaacttggggtcgggctgccccgaccccctccacgtatcagcccacgtgtacagggttaggtggacacgcctgatgcccacctaacccatttaaagcagtccttgcagccgtgtcacgcggcatttaatgcggcatgttgcgcatctgataggtctgtgaccgatctgtgaccggtccgtgaccggtcgattgatcgatgggacagtggctgtgaacccccaccctgtcagtgtgccaggcgacgtgctgcgtgctctgtcccgtcacatcataatgagaggctttttagtctctcatcatagccggagtcgatttatccgctctggtcaaacaggagcccaaaagtcttcatcccttaaatggcgactgacaggggcacccctcgtgtcagtcgccatttaatttgacaggccccatcatcaagacgacatgcgcttggcttcccaagttaagagacaagacatgcatttaatgcaaagattgtaatatttctccactaagttaggttgttggacccatgtggtaaccccttaaggtataaaaggagatccaggcctacttagggagggggatggacggattgaggggggcagcttctgcccctcatgatcaacaccttctactccaataaggagatcttgtaatttctcccacaatcagcatagcaaaggagtagggtattacgcttctcagcggcccgaacctgtataaaccccttttgtctcatcgtcttggaggggcctaaccctctcaagatcacacagtttcgctctccaagccttcgaatctcacccactgcccccggtcaaacctaaaaagggagnnnnnnnnnnnnnnnnnnnnnnnnnnnnnnnnnnnnnnnnnnnnnnnnnnnnnnnnn

SEQ ID NO: 15339 - DNA, 1176 bp, Oryza sativa
acatagcaatgttaagaataggactcctttgcggcaaccgggctctgccggcgagtgtagtgcggcgccctccgctgggatgtcgtcgagtggagagggcgggcctgcccaatgattgtcctcggtggtgtggggagtccagctcgcgcaacaaggctataagctggatgcttttgctacaaccaggctcagccaacgagcgcggtgtggtgccctccgccaccaccgtggagacaggctcggggttcggcaagattgatgccaagatttacgagctagaaggaattataagtcactagaacggataccctcatctcaatcgggcggtaagccccatctcaatcgggcacagcgtccgtcacagactagaagttactgatgtgaagagttatctcaatcgggcaaacggccgtcacgaatgaatatatctcaatcaggccctaagtaaagcccgtcaccgatagttttaacccagacgaccagtcaaactatagcccatcacagatgacctatctctatcaggccaaacctagcgcccgtcacagatgactactaacctttatcgggcctaaactagagcccgtcacagatgatactcatctcaatcgggcctaaactatagcccgtcatagatgactgatgacctcaatcaggcctaaactagagaccgtcacagatgactgctgacctcaatcaggcctaaactagagcccgtcacagatgactagtgacctcaatcaggcctaagctagagcccgtcacagatgatctcatctcagtcgagcatttagttatggcccgtcacagatgactataatccacaaaaaaaataaattttgttttttggctagcctcaggcctttgctagccatgcctgctgcaaaaatgacagaaacaaacatagatatccaatatccccagctccccagcatcacccattcatacatatgcattcacatatacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatataaatataagcatcacagttacatcaccacagttgcataataag

SEQ ID NO: 15340 - DNA, 753 bp, Oryza sativa
  unsure (1)..(753): unsure at all n locations
ccacaatgttaaaagcaaaattggatctatagcaaagttatcttttttttgttttgtagcatcgaaagttcattgttcactttagtagaacataaattcctgccttttccctacatagcatttccatcgctccaactccctttctagttttctttgactgaaatcgacaaaaatggcaagacaattgacactatagggccaatttattcttgtccctattttgatgttcaatattaattttgcctctgctttttagggtttttgtttatgcccctggtttcttgaagcgaagccaagttttatctctactttagaaggagatgttagctgtgttaaatttttagcaaaaagacatccatacccttgcttgctactgtacattccgaactttggcagattcaaatcatcaaagaaaatctgacagattctagcgcagcaagaagtggcataagcaataaagcaagcaccagctccacatcttttcttcagctagcaagcaaccagcaactcctcacctcttcagcaagacagttgggcgttggcagcgatgccgcgaggccgtgagagacaacagcatgacgcctcaccgacgttgtgccggcaagcaggaaaggccacgccgaaaccattcacaccacgatggttggacgtaggggtgaaaatggagcgggattcgaccggatagtagtattccatattctaaaccatattntgttagcacattccgaacgggtgccgatagtgtaccgatgt

SEQ ID NO: 15341 - DNA, 634 bp, Oryza sativa
  unsure (1)..(634): unsure at all n locations
nnnnnnnnnnnnnnnnnnnnnnnnnnnnnnnnnnnnnnnnnnnnnnnnnnnnnnnnnnnnnnnnnnccatgtgtattttaggaggatagcaaatagtaaattttcctctgtgaattgggatagaggcaaggctgcactatgacaccgatttggcagtgatcttgttagcataatggcaccaactctcggaccttcatagcaaggtcaataagagagcatgttgttagttcagaaaatatctgtcatctataagaaataataaatagcgtatctaatgtcaaaagtatgaataaataatataacacaaatagtactatgaacacaaatagtaccatctcttctactcatctcttctcttcagaacgacgatgactgcacacggatgcgttggacgatggcagcgctcgcggcggctagggtggatgaggacggagctgcagcggaacagggttatggcgatggcggcgcctgatggatgagggcaacggcggcggacgcgacgtggcgagcatagtggacaagctgtagcgacgaacacgatggcggcagcggcagccttggatgaggaccgtagccgaggtggacgaggaccacggcggtggcagcagagggcatcgatgatagccgcgactaa

SEQ ID NO: 15342 - DNA, 765 bp, Oryza sativa
  unsure (1)..(765): unsure at all n locations
nnnnnnnnnnnnnnnnnnnnnnnnnnnnnnnnnnnnnnnnnnnnnnnnnnnnnnnnaactttttataaatatgaaaacggacataacgtaattagaaatttgcatttaaaattggttagaacgataaaatttcatgatttcctagctagcttgtagatatcaactcaaccaccaaactcttcagccaacaaattgcacttatatgggctactagctcattataggctggtaatgtttaggattaattggaaccatgccattataacttttatgattttgaaatattttattactattcgtctatttggagaaatgtcactataattttgctgttattcgatagatggcactacttaactcgtgactgtattttctaaaatttttagatcagattgcccatttcttcttccttcatcgatctccctctctatcacatgtagttatgttcatcctctcttcgctcatccaactcgaaatcaaacactcaagaacaagttcttcatccattcaatgaagaaagggagagctagagatggatatatagaggggtgctctgctcacttggatagatacggacctggtcgaattggatatattcgaattgggatcgaacagagatcaatacgagccagtaaataaaatcaaacataatcgaattgggaatcagaagaggagatagcacgaagatctcacggtgctgctgttggtatttcttaacgacattactagaaatataattcccagcaatggcgcagaaacacttct

SEQ ID NO: 15343 - DNA, 8700 bp, Oryza sativa
ttcctggttttgtggataggacaccaggaccttgtcgcctcgaaagttgtccttgtcggctcgtgattctcgtcggaaggacaagatttaacaacactatgatccttctcgggctcggatgtcgtccatgttctgttctccacttttgcgggaggatccttcgacatggaaccgtccagggttgtaaccacagcgttctcgctttcggtcattgatggaccagtcaagattggcaccgtggtgtaaaccaggaagacgatttgagtccacatcagtattgtcgaagtagaaacaccttggttgatgccagggttgacgctgttgtcaacgaagcttgatgacatattagtagaaccttgagcaccaagttcccctacctgacacgccactgtcgatgggggatacccgtagaccggatatagagggtattggggtacgctggtatgaggatctacatagtacgacatcaagcaaacaaaagacaggaattatactggttcaggccccttaataggtaatagccctaatccagtttatatgggattatatgacggaaatcacagattacaaagggaatagtggaactctatgataccgacgagatcgtagtcgagttggttcaactagatcacccggcgacttggctcctgtaggctctggcttcataggctgtggtggatgtgttcgcggtaagattcgattccttaggtcctcccgggggtcccttttataccacaggttagttggtctccaagtataactcagagacatcggaccctacacgatacagtgacaacccagttctatccgagtaggaatccttccatctgtggactccgtgatgaatttccttaacgtgtacagagaacgtccgtatacgcacagatataccatatcgatatatgacgtatatccaagggtagagggtataccttatccgtaaccctgacagccgctgctttgaaagatgaccttgcaagacttgaatgtgaaaagaaatctaacagtgaaaatcagattattactaagaatcttgcttcacctagtaaaatagaaccaagtgcctcaaagaatgaaattaagttgaagggtgttttgctagcttctaaatataatattttcgctctagatgagccagattcttgttactatgctcttttttgcaaagatcatatacccacattggttactactcctagtactttatattctttgctacccgctattactaactttttgcaggaatatgagggtgtttttcacgatgagatacctccaaggatgacccctggacgacagagtgaacacggtcaagaagatgggattgagttgaggacgactccaattcaagaaggggaggatgatgaggacatcatttcatcggatacgcacataacttcacactttccaattataattccaagtccaagtccagttcggcctccggagacaacactgacttcaaacggacctagtgccttcatgccaactccgatttgggtgatcttggacttcatggaaagcttatctcgctacctttcaaatgcatctggtctgatgtccaaattcatctcgagtcaacaagaatcaccaaaacaaaacagtgttgttgctgaaaccgaacttgggccttggaccttgtaatagactaggcccatctcggaagtttctccctccacctccacgaattagtacttaaccctagctttatttttctctataaatagctttgtacatcctgaaaaacaatggggttttgtttagttgaattttgctaagtgctattcaccttgtctctagtcctcgctctactagtcggcgactatagattcagagcccccaatattcggtgtgttgatttgacgggtcgattggatctaccacttcaatcgcaaccatttctttgtgcttaattacctattcgcaatatttagattgcatcttatcttgttcttgcagtgttctctcatttgcattgcagggatcatcaaccgcgcgccacggttggtacaacatcgtttgtggtttagcgattgcacggcattctggacatgttctaattggtagccacgtcacaaacgtcgcactcgatcaaagcgagagttatcccctcaccagaagatcgggccacgagagagagcgtcatcagaggcccctttgatgccaccctttaagaattgtgttcttcgtgacccaatccttaacaaaaaatatttagggtgaatctcaagaaaagcatgattatcttcagctagacgagaagcataaataagattcattttggcttgggtaacatgaagaatatttttaagatgtaatgtacgatcaggggtatgaatcaaagcgtgaccaatataatatgttcaattcccatacctatgccatttgcagcatgtttttgatcaagtcaccaaaagaatttttctgatagtaattactactagtataaaataaaaaggtatggaaaagtgtagcaaagttataatattttgaaaccatttttggaagagaaatctattcatacaattttaaaaaagttgaattcaaaatattcaaagtgatattatattaattgtcaaagtttaaacatggtactgcacacatcccaaaaagacagttaactttagggagagcaagtatacaattaagaacactgctacacatactataacaattttcttgtccttagatggtgaatttgtcttaattaagaatttcaaattcttgatacactaaggccgtgttcgggcatccaggttcccaacacctctccttccttttccgcgtgcacgcttttcgaactgctaaacggtgtgtttcttgtaaaaagttctatacgaaaattgcatattgatccatttttttaaaaaaataactaatatttaattaaccacgtgcaaatggatcgctctgttttttatgcgcactgttccagttgggaacttagccagccgaacacagcctaaatatctaaaagaagtataaaacgtcttagtcaaaagtagattcataaccaaccaataattttgagaaatatgaactttttataaatatgaaaacggacataacgtaattagaaatttgcatttaaaattggttagaacgataaaatttcatgatttcctagctagcttgtagatatcaactcaaccaccaaactcttcagccaacaaattgcacttatatgggctactagctcattataggctggtaatgtttaggattaattggaaccatgccattataacttttatgattttgaaatattttattactattcgtctatttggagaaatgtcactataattttgctgttattcgatagatggcactacttaactcgtgactgtattttctaaaatttttagatcagattgcccatttcttcttccttcatcgatctccctctctatcacatgtagttatgttcatcctctcttcgctcatccaactcgaaatcaaacactcaagaacaagttcttcatccattcaatgaagaaagggagagctagagatggatatatagaggggtgctctgctcacttggatagatacggacctggtcgaattggatatattcgaattgggatcgaacagagatcaatacgagccagtaaataaaatcaaacataatcgaattgggaatcagaagaggagatagcacgaagatctcacggtgctgctgttggtatttcttaacgacattactagaaatataattcccagcaatggcgcagaaacacttctggtatattatggttacagagttcattcgcaagcgcatggatataccattgtagcatttcacccgagagtattccaagggtatcgtatttattttatctcgtgaaaagatcatgtagagagaactcaactaataatttatatatttcttgtgataatcatattctaagcaggggttaagataatccaagggtagagtgacacacaagcattactactcatcctcataataaataatctaagttaggtggaaagaaaagaaaaagagaatctattcctatacttctaatatacatagtatacatacattctagttaactgatatactagctaataccctctttccgatgccctcctggtatttcgagaagccacccctgactgccgagttccttacgacaacccgtcatgaccatccaaccggggctaaatacggaggaataccctccccagaaaattaacttaggattatatataggcgcggaggaatacccatactgacctgtcactatcagcggcccacctctcatccgcaatatataaccccaaataatgatatcccgtaatctagacaccacgtctaaactaccagatactactctaatatcatgtcatgatatagagtaattgcataagcaaacactatacgcgcaccaaagcatctcccagataagctagtagtatattcagtataacatgaacataatgcaaagttggtactcgtatacttggaaagtatttcaataccagaaatgtatttagaagagtattctaataaaagtacaaagcttacaaaagaggaaagaaaagctactagagccatacccgaactcttccgaaggcttccggactcctgattcctattctaattctattccaccagctagatactactaaactaaacttgagaggaatgagagagctcttccttgaggtgtgtgagtgaagtgagaagatgaggggtttatatagcctcctaatgacggttgtgacggttggaatagttagaaataccctccaaccgtcattgggagctaatccacaccgttcagaagaaaccctgcatccagcggcgatgaggggggttcggccgaaccaccaggttcggtcgaacctagggccggcccaaccagcccatggtttggctggcggcctcctctgttgttcttctccgcagacttgtgaattttggcccagtttgtcgtgtcaattctgagttcttggcccattcatacacaagtctggttctcgacatcgtccgattgatttatcgtttgtgttgatgtcgattctcctccactttattgtcattctctgcaaaaggttagtagacctaatactagtggaatattattattctaacaaacatatgcattgcaagcaccactagttctcctctattttggtaatattgacggttgaaactgatcgataacgaccgtcaacagccgccaagtcgccactgtctcctcttcgctgctgctctcatccgggaggaacgtgagcggcgtgtcgaggctgatggcaacttcatagcccaaatctgagtgaggcactttagccgtaggggcttctccaccgccgccggaggtgtcgttctcgatcggctgatggatccccacgagagtatctcctcgggtcgatggcagcagcggcggcgcgggctacacgctcgaacaaggtcatccaagtccgtggacgagcggtgcccaccctcattgaccaccgtggaggcaggcggggaggacgtggtggcggcggaactctaggtcgaggtcgcgctccatgtcctcgttccttggctcgaagatggtgatgttcccgttgccgacagtgtcgttaagcgccttctatgccagcgctttcacccatgcttgtactgctgccattggtgctgagaagatgaacaggagggaggagggaatgaatgaagaagaaagggtaacttggtaaaaaagaaagaaatagagtgaagggtaagtagtagtatatatcaaattatgatggcataccttcagatagaaggacagtaacgcaattgctatctcgcgcagatgcgccagattcttatctctcacgcatgcagcaaaccaactgcacatgcatgcatgtacctcggtctccacccgtgcagatgcattacacacacatgcatgcaccttggtcccacacatgcatgcatgcatgcatctatacgatccttctttttttttatgttttcaacataattaatttaggatgtagtgaaagttatcaaaatttctattataagatatttttaataaaaaatattttttataattcaaatttaaaaactcgagttgaaagttttcaaatcagagttgaaagttttcaaatctcgagttgaaaggtttcaaatctcgagttgaaagtttttaaatctgagttgaaagttttcaaaatttatcttgcaaatttaaatttccagttgaaattttttaaagtttgagttgaaagatttcaaattttgacttcaaaatcatcattagtgctaatcacatgttaacgatgggccagcgttaggaatccccggacagtaatggtatatatcaaaattgtgaaagttacaatggcatggatgcaattaagatttgctaacaatacttaccaataccacataaatattgtcaaaatgttggcattgacataaacttacccatattgcaaatatttttccatggttacaaaccaaataagctcatcgttgcggcatcggtgcaccactctccctgccttttgaaaccaaactcgacaaagaaaaaccattttatgggaaaaaacaacagaagggaaaaatctataattgaagaaaaaaggaaaaacaaagatagaaaatttctaaataagtagaattcggaagaaaaaaaacttttaaactgaaactcaaaaggaaaatattagtatagaaaagataaatgatgaacaattgaaaactcctgaaaaaatcaaaaaggataaatgaatgatgaattacattatgcaatgttctacagtaacagatgttccaaagaactccaagtctacaaacattcagttgatactaattaaagttggatcattttaattattttccttgaatgtggaaattatcagctaccttttatttgttttcacccaaggaacttagtacattaccatttgaaatactcccacagcttccaacactaggagatagacctgtcaatatctcttttcggtggattcatcggccacgcgacacacagcagccacctccgatgggaatggtaaaggccattcccttagcaacgatctgcaacacagcatgcagggcaactgttacaagatctcacatattttcagctcgcagttctattatgaagggccgaactgttatgaaaataaatgtacaacggagataaattttacgtgaaaaacccttgagggaaaaaactatagacgccgaccggcaatgatcactatagaggagttagatacaaacgcaggggatacattgagctgtcgcaccctccctgtacggcttacaagggatatatatataggagaaatctaggagtcctaataggtaaagactcaaagtcctaataggaaactaatcctataatgcagtcctattagataactaatccaaatatattgttggtccaaaattcggatcacatatttaacacaaacaactgcaaataattaatttgggatgtttatgagacatcccattatgaataaatgagactgattgtcattgtcatgtcttagggccagtttgccatgagccacgttttctgaaccactaatttcgtgcaaaaactttatatattttattaaaaatcaaataaattcacttctgtaatttataatagtccatacttaacgatgcgctaatggcatgcctcgtttcacgtggtgctgataagctcagccaaagctttacaattgaacatagtttccaaatgactttttctctgatatgttaccttcattcttaaacagatgacatttttgaacatatgcaagctgtcaaatattaaaggaaaaggtttattctacaaccttgcgcttttaaccatggtttagaaattcaccctgtaactttctaaaccgttcatcctaccgtcataaactgaggtagtgatgtggttttggcttattcagtatagtcccccatccccatgccgttcccctattttcttcttgctcctctcctcactccccttccccactctgcttcagacccccaaccaaagtacccaatcactgtgtctcagatcatccaatggaggcaacagcggaaaatagtccatatgccacatctttgttcggagttgtatttcgcctatggcttaaggtacgggagaaatttcggtactatatatttaagaaggttgggtaagttttggtgaaatggtggtgaagaagttgtggcattatccaattattggttatgagtaaacctccttttgtatattattttagtgctcttggttgataatatagtttattatgccttgtgcaccaataaccctctatgtagcttggttatcgacggttggataaatggttcttcagtttatttgtagaattttagctccttggataaaattgatgggggccaagatctaaactcaaaatagagctatccaccaatcacaggcagtctagaaactttatggagctcaagggaaatataatactcccttcagacgaaaatataagaattctagtaattctatgacaaattaagcatcaggataaaaatctagaaaacctctcattaaatagggtaatcacttctgattcattaattatcggctggttttgagtgacccttgcgaattatgaggaatgagtggcttcaaagagtgcaccagataagatgaaaatccaagatatactccatctgtcccaaaatatagtaatatagtactccctccatcccaaaatgtttgacgccgttgc

SEQ ID NO: 15344 - DNA, 14464 bp, Oryza sativa
ccgttcgtcttattcaaaaaatttaagtaattatcaagcttgctttcctatcatttgatttattgttaaatatacttttatatatacatatagttttacacatttcacaaaagtttttgaataagacgaacggtcaaacatgtttaaaaaagtcaacggcgtccaacatttagggaaggagggagtattagattagacacaatctagttttacaaatctagacaacatgtcctgattcctgattcataatactggtcctatctagtagtagattgatatatgttagaactatcagagtattaattactgctccagtcgtccttatattttggaaaaattttaaaactcctatagtccttatattttagggcggaggagtatatctcaaatgtgtgtaacagttagcatccgactaattgctaattcatttcctctgtttacctcaaagtatggctaatccatgtttttagcaataatcacattacttgatgtggtacagagttttttttggcaattattgataacaaaaaataatcatcaatgagaaatcattctgctaaactattacatttcaaacatcaccatttttagggctgtgctttgttaagatatacttcattggccaatatttcccaatctttttatactatttcagggctcagccgttttattgccaaaattaatattagcctttgttgtttatcttgtcattcattcttgtatatctcaccatttattgtttccatatcaaacaagaactcaaacatatctgccaagataatatctattaatagcctaaaaaaattttctatttcccttggctttatcctcatcgtttcctccacctacatgtacatctcaccatattctccccaatttccacaaaacaatttagagagaaaaatacagatcagaagaatgcttcaggttcaaggctctcttcgtgtccacactttctcctctgctgccatcgtccatgccgttgaaacctctgatgaagattctgatccatcccacttctgcgccgtgccgcagaacggtaagaaggcatcgaggaaggagatcaagaggaggataaagaagcttctgtcatcgctggggcagaaacaccacatctctaaggtgttcttcagatcacgttctgaagctgccaatagcaatgctgtcattgacaacagaggtggtggtcagagtgacatggagacttttgtgtccgcgaagagctccgagttgtgttcattccgtaccgatgatgacgactccgagtcacgatcgtttcgtctcagcccgttgccaatcttcccaaccggaggtattgaattccagccacccgcctctccagtgaagataatcaagaagctcccatttgggtatatcatcggccgtcagctcgacggcgcccccgcagcagcggcgccatcaacgaagctctcattgagcttcaaaaagttgatgcataggttggttgataagtcaaagtcgaagatgatcaagaagaaagtgttacgtgctctcaagggaagatttggaggcggcgagcgacgaggcagggatggacatgtaagggaaggtaaggagagcagcgactatggtgacggtgatggtgatggagacgatgaagatgtattttggaggaaggatgtgagggggctgcgctgcaggcgggtggaggacaacgatcttccatactgaaggagcaggccagtgtatatggtgggttttctgtcatgcttttgattttagaatgaagtattgactttcactggtaaaacatctaaacatttggactataagtttgtgttctatgctttttgttgtggtggaaccggatatcagaagtttgggagtgaaatcggcttgaaccttttggaccaccttgtgcctgtatttagttaaaacttttcacttctgaataatatattttgttatatatctagatctgtcttacaaatgccactgcagatatggtttatatttattacttttattgcattactattagcaaaattgtgtgtgcggataggattgatttgaattattatatgttttgcgatgagtgctagcaattacattgatttgaaaatatactacatccattttacttccttactctgctgaacctaaaacttatcatagtatattaatgtatggaaaatatatcgagtcaatttgcatatttttttaatctaaatatacttggagcttttcttggaacatatcttagaatatagggatgcacatagtttgttcatagtagtaaatcaacaatatatgctttttttttactactaatactacctaaaatgtttttctaaaaaaactactacctaaatgttaatttctactctctcttaaaaaacatttgatgctaggaaaactaagttatgctcataaatgtacttatatagtgggtgtaaatgggtataacaacttacaaattactcggtcaatatattttttttttgaaacgaaaagtggcaaaagacttgttgaatatattagaaaaagtaaacaaacatgcaaaacagtttagagagaaacaatcttgggggggggggggggggcggtgatgggacaactggaaaaagagtacatattctccaaacttgggagaacaactaggaagacccacagtcccttaaaaggatactcgttcagtataataacttgctaatccgtgtaaaccagtgctgaaacaagccgtacaagaaagttgctacacaggaaaattgatctgaatctacagcaagcttgacgatatgtacgcaccaaaacaggatcgaattagttctgatttaagaaaactaattaattcttaacggaaactatttagatcatgaaaaaccgagctgccaattaaacatgtttttgtaacaatcagaaatcacaatgaatcagtgcagtcaatcatgatatggaagaaaataatctcattgtaaaccagagcctgtgcacctaacaagaagtatagtagtaggcgatataagatccacttggcaattttttgatgagcaatctaagagaggggacgagagagacgagaagcgggtgactaattagttgctagcctccacgctcatccactgcactcttcgcatccgtccaccgccgtcatcctcatttatcatttagtcgcggctatcatcgatgccctctgctgccaccgccgtggtcctcgtccacctcggctacggtcctcatccaaggctgccgctgccgccatcgtgttcgtcgctacagcttgtccactatgctcgccacgtcgcgtccgccgccgttgccctcatccatcaggcgccgccatcgccataaccctgttccgctgcagctccgtcctcatccaccctagccgccgcgagcgctgccatcgtccaacgcatccgtgtgcagtcatcgtcgttctgaagagaagagatgagtagaagagatggtactatttgtgttcatagtactatttgtgttatattatttattcatacttttgacattagatacgctatttattatttcttatagatgacagatattttctgaactaacaacatgctctcttattgaccttgctatgaaggtccgagagttggtgccattatgctaacaagatcactgccaaatcggtgtcatagtgcagccttgcctctatcccaattcacagaggaaaatttactatttgctatcctcctaaaatacacatggccaaatatcactctcctaaatttttattcccaaatacacgtgtactagcttcgatggagtacaagagcccgtacatattcaatgaagcgccaggggaaacaataggagatggtgtcatgcagtcttagacggatattgttacatatactccctccgtctcataatataagggattttgggttgatatgacacattctagtataacgaatctagacagacggtttatctagattcgttgtattagaatatgtcacatccatccaaaatcccttatattatagaacggagggagtactatttgtttaatcaagtactcttacagtcttattgtttggcttatgcttatccatataagccaaatttaaataagtgaaaggtgaaacccaaaatgcaaaactactgtgccacgtcatcaagaaaagatgcaccgtacgattttagcttcagaagttacgagccatcggattccctgattggcgaaatctcttctcgatccttcagcaaacttcttttgcgcgtaggtccttccacttccctggctcaaaaaaaacaaaacaaaacgaaaactgcgttccccatctgttcccttcgccgatcgccaattatctctcgctggactgcccgtccgccgcggggactgctaatcggcgactgatcgcgcgcgcctgcggccgcgcggtcagttatagccttcccctatatacacctttactactgtactatgtttatatatttatacatacatatatatacttttgaatatatacataccaaatcatttttgatgtataaaaaatatatacacatatacaaactttacatacatcgtatacaaagtttatatttgtatatgacgtatacaaactttgtatacaacatatacaaagtgtatatacgtatgtatacaaatgtatacgtacctataaaaacatgtatagaaactttgtaacgtattaaaaaacaaggaaagaaaaccagagaaaatatcaactttgtattgtatatatacaaagtttgtatacatatgcataaaaaaatatacgtatataaagtttgtatacgtgtatataaagtttgcatacgtgtatataaaatttgtatgcgtgtttacaaagtttgtatatatgtatgtaaactttataaacacatacacagagtttatatatgtgtatacagtttgtatacacatgtaaactttgtaatgtaaaaaaaagaaaaagaaaaacaaataaaaaagagaaacagaacgaaaaaaggaaaagagaaacggagcgaaaaaacaaaccaaaaaaaaagaaacgcgcggcgtccgccacccccctctccgcgcacgacacgtgtccagtcgtgcgcaggggggcgcgcgcgactatccgcgaattagctctttcggtccgacgctgcctccctcctccccagtccccaccggaaacagattccctgactttgtgcagtctgcagttgtgccactgatatgtggaccctagtttggtatgacccacatatcagtggcacaactgtaaactgcacaaagttaggggagtctcatccgtccccaccacctacgcaaccgccctctgcactgtggactcagatcgtctgcattggctcttgtaatgcagagaagttctctgcattagcccagatctaccgttcatccaaaatccaacagatatgctcgtttggtgtctcttcgtataaaatcagcaaaagctcctgagtttatacagtgagtgagctaaaaaatacaaatttaataagatacaaaatggattccagataatatatttagcacgtaaatattgttgtttgctctcaccttcctccttgctacacttgaaaaaaggatacacttcctccgttacagaatataaagcatccataattttacaaaaaagtcaataatagtaacttttgattaatgttcaggctaatactagtaatatgtatgttcagtgttatatatgtgatatcattatattcatattttaaaatggtttcatatattgttaattttatagtcattgataatatattataaaaaaattaatggtaatatcgaagacagtgtaaaaaacataagctctttatagtttgggatggaaggagcaactgctttaagaggaaatcgtcatatgaagatgagggacatcatcttaggaaaatcatggtgagtacagcgccgttctcacagcaaggtgagctactgaggagtttggaggaagaaacagttatacttatatttttagtcaaataaaagctcaccgttcttttaccgatgagtggtccagatttgggctaatgcagagaaggactcatctgctgtagcaagagccaatgcagaggatccgacctctcccacctctcctcttgcttgtggatggctatcctcccaccggatctgaacatccctagcttggaggctcatgatctagccaccaaatcccgccaccgcaggaggccgccctagccactgccatgaagtggagcggctgcttcgaccttacccccgacaaggcgcgatggtagcggcaatagccatggagctcgaaaggtgccacctccacgctgacggaagcggctttcccttcccagtcattggagcgcaatggagctcaacatgctaaaatctcaggtatgcttcatctacaagcaagattccttcatcgcactccttggaattcttcattctttcactgatggcgcgtcaagatggccaaagccaatatgcaaccgtatgtttagctgtccaatatttatcaccataggttgtgcatgttaggtgtttgataaattgcttgaatagatatactaggcaaggttggtgatagggatataccaattgcaaaaaatcaagaattttgcctcttcgtatatatatgcagtaatgaaggttgctacttgaaaatccaaagtacattctttgctaattttctgttattgaagctacccaatagcctaattagaaaaaaaaatggataatgacatgtatctgctatctgctattctgctattctgcattccggtagtatgtacaacagtcaacagatactatctgcaaaaaagatccatggccttctgaggcagataagactaaagccaatggctttcaattgatattatttagaaatttatgtttggttgatgtaacttatggtctgatggatttaactagatacaaaacttaaaactgatgtccctcaagtcaacttctcagctcagaatctttgcatttatttcttaatactaaattcatggattaagagcaaatccatcaaaaaaattccaacaattccttaggagggattggccggttaggctaggcggctagcattgtttgatgtgtagatcagagtggcccatgttatgccttataattaccataactttgcacgaatgaccttaggagcaagtcttgatgtgcatatttttttgttataacttacatgctctgttcatacaatgaattaaagcttaactttttctatgcatcaattgattgattacttaatgttcaattaatggagtgctaccatcatttcagaattgcagaatggatcgtttatatatcttattttcctctttccaaaagacaataattaagttgtgagggtgacattgctttgaacataatccatggcaaaatatatctcatactgcaaatgattttataaggaaatgtcatggcattctcaaattggttttaaagttagttgccctcatgcatagtttgtttctcaaattattgaagagccacaaacattttgatttgtcgactgatttatatgtttataccaggacgcctttgggactatgctctgtcatttatgattcaaggtgaaaccgggtgattctccgaggacaagattgctgattttagtgaaatattcaaggcaatagaatgcaaaaatatcaaggaatgccgatctccctccccactcgtttcctccacaaattgaatgcaaaaataggttcctatcctcctcctcatcaattcccccacgttttgccctcttaattcgtcctttaatcatcaaatttagtctccgatgaaccgccgccattaatggcaggacgtcatactctccggccgttctcatcctctccccggccagccgcctcgttcaccgcggcctataaaaaggagtaccgacccccccctctctccccacactgcagccctccccctcctctctccctagctgccgcgttgccttcttctcgtgtcgtcgctgctgtgcaactccggccgcccctcgccgacagttgggacctcctcggagcccagcatcgccaccatccgcttcgcagcaacctcctcttccccagcctcgcctccgtttctcctggagaccgccggaagctcgtcctcgctggtgagcagtggtgacgtcgccttcatcctcgtcctccggcagccctccctcctcgctggaggattgcctcactgcgctgtcaatgctgttggcgtcatctcgttgtcttcatcatcggtcgtgcctcctcgctgcccaaagactcccgtagcgccgccccgttgctattgcctccctcctgtcgtcgttcccgtcaagacgaagtgccgcctgtcgtcggtgtcaagtccgcagcgccaagcccgtcgttgtccgccttttcaccaagctcgaggattgctggagccgtcccctcgtcgttgacccgttcctctctgtcgcccttcgtcgccgcgccaaggttttcgccggtcgccaccgttgttcccttgccgcgttgtgtccatggtgagaacctcttccgtcgctaccctatcctcgtcctccccgtgtggtcgccgcgtggattgcccacgtgtgcagctcacgtggtagtcccggctgccaatcgctcgatcctttctttcttcgagcgatatttcattgcacataatttaatagtataataataataataattaaacaactcgaaaatatccactttaattgcacttaaaattcggatggtcgtttctcggccatacgagctcctaattgacccgtcgaaattgtttaatttttgttatagcttgaagaacccgtgtttgttatttttatatgttgttatcgtttctttcttagatttgtagccctgttttgttgatcgtgtagctgtcgtcatttcggaagtttctgaagtgcagatcaagtcatctaaagaccttctctttgagcaaggcaagtcatgccatattccttgaacatagtgaatcccattattgcaaaaactacgttgtttcacttctatatgaatcgcttttataaattatatgacgctcactattatttatttaatagttaatattcatatgatccttgttatatagccatgttattgaattgctacccatgctcttgacaaccttagtaaaatgataaaatgactagtatggctccctatatgatggacttattagttgctttaggttgggcttatatacgcttagatcaaacatagaatctctttttatacattaacctgtgggtaacaactaaaatatgtgagaatgatgattaggtggctggttgagcctggacatgatggaatctcattcaaaactctctaaacctatttttggtggggcgtgaggtgcatggttttgttagaagcacctcggccactgtaaggaccggtcttcggacctctgttgcgaagcataacagtgcaaccacaagtctaatgggtaaagcctgactagaagtccagatcatctcaaaacaaaggccatcggtatgataggtttggggccagggaaggctgactttgacctggcgcaagagggggcttatctcgtcccgggggatccagcaacctttaccttgtcggggaccagcgggtggcgaaaccttagcgggtccttctgttttgggttgagctaggaggatagtcttgacatgatcttgacttttcgggttcctttgaggtatcgcgatacatggttgacatgaaatcaagtattgtgtcttgtgggtaaagatgtacacctctgatcagagtaaaactattcgaatagccacgccctcggttatgggcaagcctagcaatgtaccaaagttagtgtttttcttctaagtgatggatggaaatcatggcactttggacaggcggttaacctgggtttaaggccggtatgcgtgggttcgtaaccatgataatattgtttagatataggaacgagtttaaactatgctttaaaacattaaaatattgcaactttggctttacgcaaaaatgaaccctattatgccaactctttgttccctttgcattataattcatttcccggcatagctcacttgagtacggtggttgtactcattttcttgctcaatctttccctctccagtcagaagcttcttgaagaagaagtcttaggtagagtcttggcttataccccagttgagcacctgtgaagatggagccgtaggcccgctagtccgctgttgtttttcttttgttgtcaggcttaatgtgcctttgtaataatgtaaatattatcgtgataattaataaagatgtgtcttttgtatcaagttgttgtggtgtaccctggcttttcctgggacggggattaatacactagcggtcgggaaaggtattttctgggcgtgacaccattaaaaatccactgcaatagtttgatctaaccaatgaaacatccatatgcatagaccgaaacatcaaaaattaaaaaaaaaacattctagacatacctcttctttctctcatatggttggccaccgcgtcagcaccggatgctgccctagctgtggaggggacatcgttagcgatggcgtgcagctgccggggatggcgctgtggacagtgatgtcgtacgacccccacccgctctagcatccactctacacacatcgccatcaatgcgtagaacttaaccatatctgtgtcactgctgcctccgcggagagttcagcgtgtccatgtcgccgccgctgtggagatattcgtgtcgccgccgtcattgtggacaactcgtccatgtcttcatcatcactgccgtgagatcttggccattatccacgctgttgcagctatgcaccgccgcagccttgctctcttactagtgctatgagtttctcgtgcatcagccacctccatggctctatcagggtaggggaagagagggacggatagagagagagagagagaaagaaaagcgagaggagttgataagaatggctctatcacggtggggggaagggaagcaaaggagtggataagaagtgagttgccagcgtgcatccggtatattgttttcctccgaactaccgagacgaagccttttcggaaaatttaactcgcttctttagatgccatgttattcttcataattccttttttttctactagagcctcatgaatgtccattgtgcccctcttcaccccgttaactctctttgacatgacgagatactagcgatggaggagaaactatttgagctcgcagacaccgttcacaagtatgatgacgcacgtagcaatggcaatgggttgcagcagcgtggtagaaggtgaaggcgcgggtgggggcggggtagggggtgcggcggtgagggggtggagatggcccaagtcatgctaccaccagcaaagcccatcaaagaccgcaccgtcgagaaagcgcacatgattgttgtcgaggcgcagactcgctgtggttattatcgatgggaactttgatgctgatagctccattgagcccctcatcggcaacgaggaggtcgaccccaacaaagttgtcaccgtctccgcgcgtcctaagtagcaagtagttaaataacccacctgagccctaaattaaatgcacggggatgtgtgtattagaaacatgctgcaaaaatctccaaaatggttttattggattaaaattgtttttgtgtgcattgcataatccttgttacttgaagccactccattttcatcattgccacaatgttaaaagcaaaattggatctatagcaaagttatcttttttttgttttgtagcatcgaaagttcattgttcactttagtagaacataaattcctgccttttccctacatagcatttccatcgctccaactccctttctagttttctttgactgaaatcgacaaaaatggcaagacaattgacactatagggccaatttattcttgtccctattttgatgttcaatattaattttgcctctgctttttagggtttttgtttatgcccctggtttcttgaagcgaagccaagttttatctctactttagaaggagatgttagctgtgttaaatttttagcaaaaagacatccatacccttgcttgctactgtacattccgaactttggcagattcaaatcatcaaagaaaatctgacagattctagcgcagcaagaagtggcataagcaataaagcaagcaccagctccacatcttttcttcagctagcaagcaaccagcaactcctcacctcttcagcaagacagttgggcgttggcagcgatgccgcgaggccgtgagagacaacagcatgacgcctcaccgacgttgtgccgccaagcaggaaaggccacgccgaagccatccacaccacgatggttggacgtaggggtgaaaatggagcggattcgaacggatagtagttataccatatcctaaaccatattttttaagcagattcggagcgggtgcggatagtgtacggatgtggagcggattgtttcggatgtcggaaatggtgcaaagtcggtgcggaatcggtctggaaacagattaaatttatcggatgttacgtgtgtatgcaatcaatacaacatcgagttagcaatccaaggaacattaatacaataatcaataaatgacccatcgtaataattatatgattaagtgctaaacatcatgaatacatgatgtccataatataaaaactagtaatcgtgcacgtgcaaggcacatcatgcaaatataaattaacttgagatcagcatatcaccgatatgacaacaataataagtttattaaatttaaagtgtacgattcatttcacatcaaataaagaataaataaacatatattcaagccatgtttcattgaaatacaaaagcataagataaaataatacaaggtcctacgttgtatgaattaaggattagacagaaaaaaaaaacctcaaggttcaagagaatgtggaaaatggagataaaaggcactttgatcatccgatgctattggtcataaaaacattgtgcttacaattgtataagaaatggccacttttatgtgaatgtgtgatcctcaacttctcctagaagttttaaataaattagagttgcagatatatattatgatcatttgaacctgacaaaacagcacaacatggtcaatcagctttgttagaaaatacaaaaaccctgcaatatttctagaaaatgaacagctaacttgtaactccaagtagcatatattgcaacctgctcttagaatagctttcttttttaaaaaaaaaaaacttacacttaatgatacttagacaatgtaatcccaagcttactgacagtgaatcgataagccaatatctgattgaacatagagagattttaacgaacaattgtgcagaatatgaagaatgagaagaactgaagatacaactaactcgtttgttttgaaacaaaccattccctcaagctagctagcaacattgaaaaactaacacaacttgcactgtacttatgaagtgcatgcatcgtatcgatcaccagattatgctaaagagatccatcaagcaaggatgcatttagaaaacattcagattaaaatcagttatgatatatagttcagctgctaaaacttttattgaggtcaacaggttacaggtagcgaatgactcagaaccaatccaatgggccaatccgtgataaaagaaaaggtggcaaccgtagatctttatattagatgaggttttatacttgtgtgatactggaatatcagttcaagctattttctgctagctatgtcataataaggtgtgagatttgggtacctgttacactttttttaatagcagcctaaaatctttttatcatcagcaaattgatccatgtacacataaggaccacttaggtaccacgaacctgcagcacaatgataatattcttcaacacatcattgatttgcttgctcagggatggaagaaaaagtcaagggggacaacataagagcaatcagacaacaatatcaagaaaaacagtagttacctttttgtatttgtgaaatttaaagaactactactatgctggaccatgccaatcaaggttgaaaataacaagccaatataaaggcaaaattaattagattcatggaatgcaatttggttgcacgctcctagcgcagaggtcgggaacacaacccaccttgtgcttcaataaaatgtctctaaagaaagatgcatcatttcttttaatatatctgtctttggatccactcaaaccaaattttaagagattggtccttggacaggttcattgtgaggcaatctaagccttggtaatgaaaagataaacactcaaattcctggaccagagaaagggatcaattttcatagtcagagttagaattgttctatgccaagttgagttcatctcactggtggagaaagaggctttactcccgattcgtaaccccctgtagtccggttttcaaatcgggactaccaatccgggactaaagatagtgatttttagtcccaggtgaaaaaaccggga

SEQ ID NO: 15345 - DNA, 555 bp, Oryza sativa
ttagtacttgggtagtgggttgttgcaaatcaagccttcagtggttatgacaatcatgtcatcgactttagatagagaattgaatcacttgcattacgagcttgactggattagttagctgagtgggttctggctcctctagattgccatgaatagctggagaaatggataaatatgagtttaagcatgcttaaataagttatcttaatctttccttgcgatacttttgctttaattgttagttgtgtgacatcttaagttcacagagttgcactttacgtccttgaaatattatgctatattctaactttttggctttggatattttgtagtaacatgaggcaaacgctagcttcctccttattaagcttggttggaacacgtgtggtctatgaagatgcagattcacttgaaccttacatggatgatgcctgcttgattgtccaagtgaaagcctattcgataggcttttatgtgtcctgcaagctttgcttggcaatagccaaccaagttggctgaagactaagccaagctccaagccagctgttaaatttt

SEQ ID NO: 15346 - DNA, 915 bp, Oryza sativa
ccaactcatgatttgagccccttttctcttcaagaatactagaccgtccaagacttttgtcaggttctaacttggttgttaacctgctattttggtattttcggatattgtctaatatatgtgaatttggcttctgaagcagcttcaggaaaagttcattgtttaactcagtatttctaccgcatccttgaattctttgaattgagctgccctgctgttagaacgactattctcacccagtagcccttctcccttgctctctggagattgctcattaccatgagtggcatggggattatttaaatcattgagcttgttatggattaaggacttcagtgaaggacccaattcacccttattcttgcaatcaccatgcgggcattcaccatggcacctataattttcacctaaaaaatttgccaagacagattcaagatcatattcttcagaatgattcaagctcttggaaccctgagaatacactgatcccgataaataagacgcgaagatgtccgtgtgctgatttaaggctgccactggtttatttgtatgctctgagcctccatctagggagacatcatatcccaagtcaggtaatcctctttgaatctcattgcttggaatttttttcaaaagatttactttccccaattcgtcctccataagttttttgactgttcgtttctgtgaagcgcattcttctttgttctgaaaagaagaaaagtaaaatgatgtttaggaaagttgcgactttcagatgcacgcataatccagtatactgaaaacaatgatttggttgtaatacaaactagccattgagttgctttgtaacaagatgctgtccaataccaaattgtgtcagtgttgctattgataacaaagatgattttggtgtttatggttaaaacaacaaca

SEQ ID NO: 15347 - DNA, 9420 bp, Oryza sativa
  unsure (1)..(9420): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgcatttgcagccaggattggagttcaccaagagagcatggggctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccaccatggttttagggcacggatcctatgccgtaacgggcccacgtgtaagtggctgtcataaactgtgtgtggacagtcgtattgtagagaatccttattaccggtagtttcaaaatgcgaccataaccgcttggtaaagttgtgaacttgtcatgttcaaaataggctttgttcggcagcgattgctaaggcgcaagtccacgacaactaaatcaatatactcacccgtcttaaaatataaagattttagttggatgtgatatgtcctaattctacgaatttattaatgctttacgttcagattcataatactagaatatattatatccaatcaaaatcccttatattttagaacggatggagtaataaaagtactcctcagagctgtttgaagtctatttgtaattggatttcaaacatggctaatattgaaagtaaaattcaaatcgaaaaaaatgtttagtttcatctttttatctttcattattgaataatgaatggtaaccggggtttatgaacggagccgataggaagtggtaaacgtactccttccttctgtccaaattcataataattgaaacattatatcctgtattagatagttatattttaagatggacataatactttgtaaaacagtaacaagtcgcatttataaaccctgcttgccgctctactttttttttttaagtatacattgcttgctcatgctcggttgctaaggcatgtgctccataatttggcgtttgccatggctagatctggtttgatttcccctagtttgtttaacatccgaataaaaaacttaccagtctaaacaaatagcagtagtgttttgttttgtttaaaggctaaacaaatactttggttggcagaagtggccgatgcatgccatcgatgaactacgcataaacaaatctttctactactaacttagcttgtagccaccaacaagcagcctcagattacacaatacccacacatgccttcccccaaagtcccaaaccctaaggtacaggcacagccacaccgaactcccatgtgtagcgtgccaatgtgtcgacttgttgccaaacagctacacaagaatgcatgtggcttgcatcactcactcatggcatgttgcttcttggcctcgccgttttttgtcctctcctaatcctcactcaattaccttacctagttttagttactccatccgttccaaaatataaatatttttagctataaatctgaacaattgattcatagaaaaaaaatgttatattatgggacgggggagttactaccttacccccaactgctgcaacgatgaacagcaatcttttgtatcatgcaaaacaaaaccaaaatcctcaccgtgatacaatgaagtagtaggagctaaaatgctttgcctgcttccatcggttgagatggagcttttgcttgggatgagctcccagtttgagccacaccgtttgtcatctctcttctcgcaatgcaacgccagctcgtctcgtgaagatagggggacactgaacagaacttgactggacttcacttgtgatgtttcaggacaggcacatcaagaacagcagcagcaacattggatgggtacaccactttaacctgggactcagctccagaatggccatggcaccgcatgcacaaaccggataggttgagatgggctcactggagagtcactggagagccacagtgtgcagcaggagcagtagcaataggtcaggttaacatcatagccagcaacaaccagcctcactgttctcttgccaacactcttccagcttcccactgtaacaagaacaaccccaccgtgtgccgctgacgggtgggccagtgacggcgacggccggcgacgtacgagtgcccgtgacacacgggacggcgatggtgcaggccggccggcagtgtgcatccaatccaacaaaactatctgtcccggccatgctcacagtcccattctgggcacaaaccgcagcagggaccgcgtgcttgtcatcactcttaaaccggccgagcttgttgctgcactgcatgccttaacactgtttcctcttcatcgccactggcaggcaagtggccacactggagtacgggacactgcaggagcaaactggcaagagacctgcatagtagttacagagatggatgttaagcttgctgataaattcagaaaaaagtggtaccacagttcaaaacttcaaagtaagtgaggccaagatccagtctcagacacggtgcatctttcccaaggcgtatctgtactgccaaaatgtaccatttctgacgaggtatttcgtgaatcattattcctcagccatccaaattgctcgcaatacaaaaacaggctaaaatgtggtttgtgccggcgactcgcaaagcgcccagggacaagagttcgctttattcccccctccaacatctgcacattttagtcgtagcttggtttcacacctccaaccgttaaagtaccacgaatcaatcgcagaaagaaggtgcactgttggtttaattaagcaggacttgaaagttcaaaaccagggaggggaatcagaagccagtagacacaaaggcctccagatctcattcagacaggttcagatttcattgcggaagccaaataggaaatgcaagcatagtggccagtgagtagtagtagcacattgtgggctcgaagtaccccctcccttggaaagagctaaagatacgcaacttttaagagccaaaaggaaaagaaaaggcagtgagagatgaagcaaagagatggatgtgtcatggtgaagctgccttggagagtgggattcggtgccaactacaaggttgatgcatggggtcgcaccatgcattggccagcctttgtatcctcttttctctaaaatagagtttccgatgaggaaaagatagtatagggctgttaagccctcactgtagctagtaatagcctagcaatatccgtacgtgcaatgcctatgaattgagcttgcagaaaagaaaaggcagtaaaggagctaagcagtaaagaacgatagatttttatctacttttgatcaaaaggaaggaaagaatgaccagaatgatgcattttttttccctacggctgtttcctgggctctctacgatgaaaatcaacagctcgagtccctactcgctactccctaccacgtgaaatgatttcaggactgcaaagttgatcaatgagaattgctattacctctccactaaaataaacaacttaatgatttcaggactgtaaagttgatcaatgagaattgctattacctctccactaaaagaaacaacttaaagataaaagaggtaatagaaatctataatcaatattggggggggggggggggggttaatctgatacaacatatttgcaattcccctcgcccacctcctcctacagtttaaattcactaatgcaggcagttactatatttaagttttgtcgatgtggtgaaaacatggaaaatggttcatttgtcagaaagttcaagataggttttacagaacttcactaagacacataacttaagccaagctaagagtagcataacattgttagccaattgcctggctcctaaatggaagtcaagtcacagtattatacaagacatcacgaatcagttctttgatggtgatggaattgtgctcacaagcaatgtcattcatctgaagtaatagtcatggacagggcataaataatggcaacatggttcaatggttgtctggttgatattacaggtcaactacatatgctatatttatgctgaagaattgcatccactcaaagtcatgttcagaaatacacaagcaaagatatgccaaatagatgtccaaaaatcctagctcaagttggtgacaggattattgatccaccatgcaatagatgttttaaacagtcagttaccttggttatcttcattccaaaattcaatccaaactgtgcagataacttatgttttccccctgagccgacaagtattatatgtatgatctgcataaacactaactttatcacaagctgattaaacttgaatataccttagaaagctccgttgagggaaaacaggcagaaccttcactaatgtcacaaaaccaatgcagagaaacttgtatatgcaaaaaaggaactaggaaacaacatgacaaaatcatcaacgcagaagggaatcaaaggtattgctctcaaatccttcattgctaagagacttccgtgccagcaaagctcatgaagtaagcttttctccagaatataatgtccgtatcaaacatgcaaattttgtttctaatactaaatgcgcaacgccacttgcctatcactaaattgacaaatgaattgacattacaataatatccaataaaaaaaattctgcaaagcaggaatgtatcacaagaaattcgctaatgcgtcaataccgaaccacatgtctgccgtaaggcatctgatcaatgaaaaagaagatgaaagcagatgctctttcatcttcctgaagaaggttcttttgcgaaatataatttatagagaacctttgacacatactttccatgatggctaaagtatgataaatgtacctggaatgtttatcatgttgatgaaccggtcatgcagaatgaggctacatctagactgtgagtattggttatcccatagtttactgcaggatgacatgcatatccttcaggagtagatcatgaactttccagaccagatacaagtgtaaaaacagatgaatgacaaaaataatcatagtcattattttgtacccacgatagtaaatacatgtaacagtaaaggatatagtcaattgctacctgataaaaaatataagcaaatcgataaagctgttcaagagttgcagtgtagcataaacaataaagtaataaacaaggcaaaccaaaaattttaatcccattgaagtaaaatacatgaattatttaattctctctccctcacaacgaatgcatccaagcaagcagagacctgcataaactagtactatatattatagcgaactaaacagattacacttaaggtagcattgcaataagaaaaagtaggtgtaggtatgtacgtgtgcaactatatattgaaaaccttttgaaatatttgagctacaagatacagaaagagaaaatagcttatccttgtttacaattgcagaagagcaaaactaactaattcaatagcaacatatcgatttccctggaaattttaagtgtcttattacttgaaatagggtggtatgccatacaggctacttaataacacgaatactatatcatatttaagttcattgcataaagataatttaagtagtaaacatcggtaggtatgcatgacacacactgtgaaatatgtagctgctccagtaatgtaccatcaaatgcaaacagcttctgaccaaaacctgatgagaggacccttaagaatctcatcagcttgtttgtcaacacttatctccaggtgttcagagataacatatttgatctttttagggtttatcatgctctactaatgtatttgcctgggattataagcttggtctgttatctagaagttcatgttgtttagtcatctttggtttctacaaaacccttgcaaaaatttctttgtcgacttttattcttcatactatatatatttcaatagaactactgttctcctaaaaagtacaaacatgtagcaaaagctgatatttgacaaaactataaaacctgtgcggcttaagagtaacaatctgcatagatatacaaacaatgacataatcacaagggacaggtgctttttactttttgagtaagcccgatcactacagaatacaaccatcttcataggttaagtaatgctacagttaatctgataaagaagaaagagagaaaatccacattggacatggagatgatgaggtcacgagatctccaaagatttcaaaagcagacttatggggagaatatatatggccatatgggagtgcacgaaattactttcactttaaaaagggcccaggtatgacaacaagcttcctaaggtcagtgcaggactagacataaccaacaaacatcgctggagcttcagtatgtattcgatagaaagtgcagctaaaacatggatcagcatttagggtggcatcaatatctgcagaggccatgtaaaataaaaaacctactacattatgaaaataccgaccatgtaatcgattgtatcgaacttggaaagcgtgatatcatacattggtctaacatcagagaagtggacgattctgctaatttctaaaatagttcaaaacagtcagtactgaaaaactaaattccctaagatcacacatggcatgtcattcagctttacaataaatagatacatgcaatactattctaaggaaaaggttttgctgtatgatgctgtttgctgaaggtggttgtgcatttatcagtttggtgattaaagttcgctgtgctaacaaagcctcctacaatagtaagccaacactttcgaataaatcaatgcgtattcattttacacaacatagttccataattgcacttacctgaacatggcccaacaagtgtacagattggaaaagtgacttatcttgcttacaagttaaattcataggctctgaagttaaatcaataataagtacacaaggaacatggtatgctataatctaatacttttgttgcttatacagaagtgtgtaaagatcatcattaaacctactaaattgattgtaaactattagccctatttaaggtataaggtttacatggaacgaactgtaaaatgttacctatgaaacactgaggagagccaatcatccttctagcttgagagaggtttcggcttccctcgccttctacatcctactcttcctcgatatccctgatcgcgcaaccacatcctcacccatgaagctccatccattgttgtctgcaacaacctctatcgacccatccccttccctcaccagcggaatcgagaaatgcagcttctgttgcagtgcatcaacccaataaccaattcccaaaccctgtttttcttcagtctcctgcaccctcaccttggagaaatccctgagcattgtcctgcccctccaagccaccattttaacattacacaggtagcgccccctgatcggaatcgtccttcctcgccctagaatcttcataccaccacccttcttcccattggggatggacggcgcgagccgcgaggccacgctcgatccccattgacctcctcgtccccatcagcgggcgcctcgactcgagattggagctgcccaaacccctctcaccacaccggcgcactcatcggcgcatcctcgtagtcgtagatccacgcgaactcccggctctcgccgcggcgaagatgaggtcgtcgtcctggaccggcgccgccgatggatctcccgctcgcgaagaccagcagcgcctccgacatcgccgccggcgccaatccatccatctgatggagaaaaaaaaaaccaaaaatccaaaccaaaccgatcaaaattcaccttcgcaaatcgaacacggatgcctcgcacgaacgaaattgagatactgggtggcgaattcgatcggagactcgctacttttttgggtggtggattgggtttcgtcagccccgaaacgcgaatccgaaggaatcatcggaaaaattctggggtttttgttcgtagaatattcatatgcttgactggctcactgcctaaaatggaagaaaccaaactggctataggccgaattccaaacagaacatgaaagaaatttgggccttgaagcccaataaattgaggcccaataatacaagtacacctaattagcccagtagcctcggcctgacaaattgtccacagctctcaactagcccgtgatctcaaggcccataataaaaggataattcaaaattctggcatcctcatccacaaaaggaaaaagtacgccgaaggtccctcaacttgtcatcgagttacaaaatcgtcccccaaccacaaaaccagatatatcatatccctcaatttacaaaaccattcactttaggtccctaggtggttttcacccggttttatctgacgtggcagctgagtcagcgtgggacccatgtgacaggtgtccacgtcacctctctctctctcccccctcttctctccttcctctctcatttttcgctccgatgtggatggcggcagagtcttcgacgcgacggggaggagggccggcgtggccggcggctggcaggggaggagcgctgcggagagtagggccgatgcgacgggcgccgccaccgatggctgctgtcgtgcagatggccgcggcggtcgtccccctcaaccgtcggcctcgatgcggcccagcaatccgctcacgtccacgatcctctccgtgcacctccgcgccggggacgcgtcgttcgtggaggtcgtcgtcgcgcaagcgcggccgcgcgggtgttcgacttccggtcgccgctcgtcgacctcctcgccgtcttcgccgcgcgcttctgatactctgctgaggcgcggcgtacctgtgggtggtggcgatgagcgcagcggggtcggtccgtggtcgcgcgcgccgcccatccgcctcacgccgccaggtagctgatggcgaacccgccgccgccgaacgccatgccgtacgagtgcatcacgtcctactccacgctctccgacggcgccccgacgtagtacatctccgcgtgggcgtacttgttcagca

SEQ ID NO: 15348 - DNA, 13479 bp, Oryza sativa
gaagagcaccccggaacggaatcatggcagcggcggcgacgacgaataagctccagacgatgcggtggagcgacctcgacgaggacgacgactacggtggcggcggcgacctcagcaccctgctcccaccgcgcgtggtcatcgggccggacgagaacgggatccgtcgagtaccgcttcaacgaggaggggaaagtggtgaaggtgaccaccaccacccgtgtccgtgaggtcgcgcacacgcgcgtcaccaagtgcgccgtcgagcgccgcggctgggccaagttcggcgccgccgcgcacaacgacgacgccggcgagccagggccccaccggttgctcgtcaagccagacatggccgcacatctccccggggcaccaccacagcttcgcatacccgcgccgcttgtccccggcgcggaggtgcacggagaggagcgtggacgggagtggattgctgggccgcgtataggccgacggttgagggggacgaccgccgcggccatccgcgcgacagcagccatcggcggcggcgcccgtcgcatcggccctcctctccgcagcgctcctcccctgccagccgccggccacaccggccctcctccccatcgcgtcgaagacgctgccgccatccacatccaagcgaaaaatgagagaggaaagagagaagagggagagagagaggggtgacgtggacaccctgtcacgtgggtcccacgctgactgaaccgccacgtccgataaaaccggggtgaaaaccacctaggaacctaaagtgaacggttttataagttgagggatatgatatatctgattttgcggttgggggacgattttgtaactcgatgacaagttgagggaccttcggcgtactttttcctccacaaaatggtttcaaaatgctttgctatgcataagcttatttgaacagttgtttttttttataaaaaaaaaacgaaactgtgccttcctctctcccctacttagagcaagtttaatagtataaccaactactagcttcaaatcatttatagctaatataatagttaattcatacaatagttgcttactatactattaatacctggtcctacctgtcatacacacattacgtttttgagtctgtgctgtagctggctatagatctgtagcccgctgctcttctatctctttaaaatatgtttatagctggcttatagcctgctattgtacctgctcttatgacaactaggctgtgttcgctggattgtgttcccaaccggaacagtacacatggaaaacagaacggtctattagcacatgattaattaaatatttgctattttttttaaaaaatagatcaatatggttttttaaaagcaactttcgcatagaaaacaagaaagataagttaggaaatctgcgtaggaacacagcctaaacgtgtacggagtaatcagatagctcccttgatacttgaacgtgccctgcatgccgtacacgagcagaacctgcatagatcttgaacttgttgcgctcatcaaagaggtcagaatgccacgcatctctgatcaaaacacacatgttcgatcggcttccacgcatagtgcaggtgtcacctgttgttcagcatcgtcagcccaattgcagccgacaggagtattctccagaaaccgcacgtggtggacagattttgtgatgacagaatgaaccctgcctgagctgcacgatggtctgttcgaacgctgaatttgcaggatagccttcgaaaacgtgtgaagattttacttcaaattcccgggtcatccacgaagcgcgcatctggaatacgtaaaacggtggtgttttgtgacgataagtcgtccgtgcaaacgaacttgctggaatttgaaacgcgtttacggaacggaagcctctcgattcaagataagatcagtgcagcacgagcacatcatttcgttgatgattcagtttattcagagatcactatcgattgatacaccaatgtctgttcttttttcagaatgataggagtatttacaagtttacgacttctactcatgactcgatcgcttcactcccaagtcccagtagcaacacaaacagataaggcagcctcagtcttctgccacctcactttcactcacgtcccagcattgcagccttgaacctcctcacaagctccttcctgaaatcaacaacaaatcacccaaattaatctcatcaattcatataattataaaatctgtcgcaaagatttgaatctttttggtataaaaaaacgatgggagattttgatttgtggattgcaattaccggagcagctgtctgtcgaaggaggaagacgagagcaatcccctgttctcctctgctcgtctgatgaggtacgggatgatctgctccactggaccgtacggcaggtacttgctcacctggaacccggcgttgcggaggccgagcgagaggccatccgccatgcccatcagctgcgcgaactgcaggccgcggtcgccgccgccgccgatgccgagctccagcgccctcgccgcggcgagctgcccggactcgacgttgtgcgtggcgagcgtcacggcggcggcgccgcggcggacgcggtcgaggaggaacgcggcgcagccgttgtagcagtcgtgggtgtcctggatgctgcggtggaccggcgacggcacgccgagggaggccgcgaggcgggcctcgcgcgccaggtacgcgccgcggaccagcttgagcgcgaggcacacgcgctcgccctgcgccgctcgcgccatggcctccagccggtcgcgcgcgtcgcggaggtaggcctggacggtgccgtgcacgatgggcctcccgccgccgttgaacgccagcgcgccggcgaacgtgaagtagtcgatcgccggctgcacggtggcgtactcggcgtccaccagcagcgggatgtcgtactccgcgcaccgctcgccgatcgccagcagccgcccgtgcgccatctcgagctccctctcctcctccgcctccagcgccggcggctccgccgccgtcaggtacagcgggctggagacgcacagcaccgggaacccgtgcactttccatggcagcttcgtcgccgggtgcttctgctgccaccgcagcagatcactcgccttctccagcaacgcgaccgggcacagcgccgtgatcttgatgcacacgctcgcctgcaacgaacacgcaaaaatcccaaagcaattcagcaaccacacaaatactgtcttagcttaatcactatgctaattatggtgtagtaatctcgttctgtagtgttgttgagtgtaattaagagtgattagagatgtctaaaaaaaggattagttgatggtattaggagggttttgatgagaaagcgggtggaatggaaacgagcggcggagagagcatgtcggaatcatgtggctagttttcagggcccacgaggcagtggcatccgtgcgattcactggcagtttactaccggaagattcccaaggaatccgcgggtccgctcgcgcaagattccgtcctacgtggcagcctcctggtcccacagccacgcacgccgacagcgaggagagagaaacaccggcgagggttaagcggcggcggcggcgactcaccgagccaggaggcagcgcggcggcgacgtcgatggcggcgaggaatccggcggcgttgcggtcgcaggcggggccgtcctcggcgtcctcgatgccgtagtcgaggatcccgcccatgccgccgcgccagaggcggcgcaccgccgcggcggcctcctcggcggtctccccggcgcagaagtgctggtacgcggtggcccttgccggggggcgccccgccgcgctcccggccaccgccggggacctcagcgccgccgtcgccacgtccacgagcgggcccaccgacagcgcctgcagcacggcgagcgtgcgcaccagcgacgtcgacctctccccggcgaacagcctctcggtatccccaaactccaacacctgcgctccctgcgcctgcacctgctcctgcacggaagacgcgacctcctccaccgcctttgcggcgcctccggcggccgcgacggccgcctccgggagcttggctgcggcggcggcggcgaaggaggcaagcacgcgcttctggatgcgggaggcgatggccatggaaggtcggacttgtgcctgacacacccaagaaaacacaaaccaaagcaagaaatgctctcctcggaggaagaagagattcagaagaaggcaatgaatttttctccggtgcaaaactagcaagacgaggaggaagacgagcaccaggtcggggcttataaaggagaaggaggaggaagtaaattgatcaaaaggctgtaaattcgcgagctggttgaggttgaggtgaatccaagaatggaggagatattgcggggtttttttgtttctatatataaaaaaacgaaaaaaaaaaggagaagactcgcgacaattgacagggagaggatgaacgagaaatgggatggaaaacaaacggaaacacgaccagagtgaaggcgaggttaacgcgcgcgtgaggcaaaaaatatatatatatccatgcaacggcgtgtgagaagggacatgatgatgaaagcgagcggcgagcgagatcgccggaggatgctgctgactcggccctcccttggaatgcgttgactgactcggatcctgcgtgcctggatggattaatctttttgtttaatccctttccttccacgcctcgatctctttccttgcaagcatgtactccagtagacaaggttgtcaggatcgggataccagacagtatcgttttgcttaaagtaatatcatattatagaatcgtatcatagtatcgggatactatgatattttcttttttaagtttaattaatatttatattaattatatatagacattctatataaaaaaaatatagtaacgatatatgtcatgcaaatagagacctttatcaagagaaaccacattggttttgatatatttaactgatttttatataaatttgagcatatttatttacattattttcaaaccaagatattttaaataatattttgtagtatcgtagagatcgtagaatcgggataccacctaagatttcgtaggatcgtgtagtaatgaatagtaagatcgagatattatgaaaattaggatattaggtgggatcggtatcgtttcggcttggtaggatcgtagtatcgtaagatactaggatacaaatcgggatactgacaaccttggtagtaggagtagcactttccagtttccaggtctcttttaggtgtttctcaaaaggaaaaaaaaagtcatttaggaactgaaaaaacgtgctggaatccgtttctcttaaaaaaatgtgctgattttgaaaagaaaagatagaggataatttacaatatatagacggggtctacagaaagaatataaatatgtttatgataaagacatttgagactatgccctttttttttagtattgtgctctaatttaccccctttttgtttactctctggttttacgactttaatttttaccacttaaatctctctggttcatttgagatttttggttgtgctaaatagctctgctgcaaaatgggatagtttatcacgacatgattaattaaatattaatcattataaattttgaaaatggtttattttattttaaaacaaacctgtatatataaaaagttttttttaaaaggtaatacgaaaaataagtggtcaagacagtaagttttattaatccatgagacatttttttttaagaattacacaatacaacacagacacccataaagcacacgcactcacctctgtgaacacacgcatgtaaaccctacccctataagtatcttcgaagactgggccggtaaattctagagagattgacgaagtcaccacagacgtctcgctgtcgacgggtacgtcatctaccactgaaatcacaacgccgttaaaatcctgaaaagtttgctcccatggggagtcgaacctaggacctcaggtgatactgaggctcttgtaaccactagcttgtaggccctttcgcgagacgttttaaaattctaatgacagcactagcaatctgtaccattcttcttgatgccgacggttcctttttcttaaggtgatagttatggtttttactcacctatagttgttgccttgctgatggctggataatcagcaaatttcaaaagtcattttctgacttgacagcatgaaaatatataaccttgctatccctttatagtttgaatttggattagtcattactagaaaatagaaatgttactctgacttactttttttttctcacgcgatttaacttgtaacacatatatccgactattttaaatctaaacatgtgttttgtttggagagcttaaaattctgagaaccagctagttggtagccagcttcgaatgtggaaaagctgggttttccagtttctggcttctagttcattttctgtattatacaactacagcttcttaaaatctgaatcggaagctaactgtttgggtgagcttctaattttggatgttacataggattgggaattcaggatcctctgctttgccaactgcagagtcatcagtatcctccttgccttccaggttaatttcagctctcacgaaatgccagatcaagctgggaatctgggatacgacgagcaggatatgaatccctacagcaaattaaaaattctcataactattaaagaaaatataagctttggtaaaaatgtaaaatgcctgacctgagttctctgtcgtattgtgtctcctcggagggcgaccggtgcagccagccaacggcggcagccggccgggaccgcggccagtgcagcgcgcgccccacgcgcacgcactcgataccgacggctgtgccgacagcgacgcggacggccgtggctcgccggcggtcgacgtcgccggagacagccgctgcaaattatgacggcgcgcccacacacccacacacacgtgaggctgcctgcctgcccagcctgggctttgctcatcagcatcagacaggatcagatcacagtcttaattagctgctgctgctgctgtactaattaatggagtaggagtacttaccatagatgcataagctgacactcgcctgagctggacctgcatcagcgtctactgtaccatgatcttgatgacttgatgaatcatcgatgcgtcgacctcccggttagctggcgcgccgacttatcgatccgtgcgtgttaattaatggcaagggctcccacataaccgtgaaacttctgctctaaaccctgcgattataatacgttatcatctctgatggttcagccatgtgagctattgctaataaagaattgaattgcaagttgctgctgtgtgtatcgtcgtcatggcgattttgacagttctgctccctccatgtccaaatatatttttcaaacacgtcaaacgattgcacattagtatattagaataaaaattcattcttaatatatttggatggaatcattcagtctactcggcgaaaaaaaagtatattacaagaaaataaagttttacttacacaacgcgataggtcgtaccggccatttctgaattacaaggaaagaactgcagggagagaaataaggaaaaaaataaaaactaaaagctgccgctcctaaaaagagggagagaggaggtgaaggaatcacatatcgggccccaagctccgcgcccaaatactttttactattggctgtcactgtttcaatttttatcggttaatggttttcttaaactcttttcttctaatatattgacgtgcaatctttttgcgtgtttatttttttttctttttctttaagatggttagactatgatgagtgggatattgaattattgatacttatgtttaggacgtaactactttgataataccaaactatttcttaagatttttttttgttgtaaaaaaaagacgtacaatcaaaattgaaatttgagtagttcagtcttcacccgataagtattccatggaaacggagggatcggagtaccatatttttgttagctacacggctctttgtgtgtgacggtcggcatgtatatatggtggtagatgccagcaacctacgcggcctttgccgcgccgttgcttagctacttcatctctaattatcttccttttggctagtggttgaggcagcggttgttatctgtctccgttatcatgtcgccttcctgttcttactcttgattttgctgtcgatttcctcagctcacaagggtcacagtcgcatgcatctctgaattgaattttgctgtcgattcttgcagttcagttggatgccgtgatcaaccactgtactcagccgcggttaattctctgaatctcttttgtcccacacggcgagagagagaaattatcaaatgaaaatgaatctgacgaagcttcgtaagccgctttcatcttacgacgataaaatcaagtcaaatcaggccaaattacccgtcggcctagctttgcgtgggatgcgtttggtctcgtctgcatcatcatcgctgccggtgaagtggtaagcccgccgccgccgccgaccaccgccttgaggcttccttgggccaggctctatgcgttctgggcttcacctatgcactgggccgtcgtgacttgggccgttctcagctttgacttgggccggcctcagctactttacggggcctggttgcttcttctggacttggttttccagtggaataagttcatctaaggtcccttaacttgtcaacgaatccgatttccgtccttcaaccgcaaaaccagatacaacgagtccctcaactatcaaaacctatgcagattagatccctcggcggtttttatggcggttttgactgacgtggcgcctatgtggctaatttgactcggtctcgatctgatgtggcactgacgtggcaatttgatccggaaaaataataaaaccagtgggacccacatgtcagtttcacacacaaaataataaaaaaattgtgggacccacgtgggccccatatgtcatcctctttctcccctctcatctctatcctctctctgtctcaccggtgggagaggaccacgtgaggtccaccgtgccgaggctcgggaaggccgatggcgtgcaggaggcggacctcgccgtcgacgccgccgcctgctccgtgcactgccacacctacgtcgccaaggacacatccaagttaagcagagcaccaccgttgccacgaacaccatttgatgacaacacttcttgaagaaatcgattggatcaagcaggtgctgcggatgtgcggcttccaatgaaacctcgtctacacgcgcgcgtgcatgtgcctcaacatcatccctctctcccggccgtgcgcgatcaggtgagacgccgccgtgcggcgacgccaccatcaccaccagtccaccaccaccaccacctcatcaccatctcgtcgtctctaaccgttcgacgcattaatctttcacgtacctatcgatacagtgaggcatcgacctatccaaggtggcggtgctcgtcggcgagaagggcgatatcgacagggagcgcctcctcccggggctgcacaggacggtgatcctgccggggatggtcgccgccggcagcgaagagctcctctgcgacgaggacgggtttaccacggaggacgtcgtggccatagagtcccccaacatcgtcaccctcgctgacggccaggacatcgccgccgccgccgacctcctcaaggccatctgagcgagctggatgctctgctctgctctgctcagcttcacttcacttttgcaaattaagcttgcttccatagaatattggaatggaagtataattaatcgagtcggctcaacggcggcacgcggctgcagcggcaaccggcgaggggaagaggaaggggcctcccgcagcgcctccttcttcgcaaggagggcgacgatggcggcctccatctcccccgtcgtcatctccataggcaggccgtgcagccccggcgtgccgcccggagatcctcggtgtcgaggtggctgcggcggagacggtctcccgctcctgctgccgcccgccacggcctcccacggcggagacgaccgttgagaggcaagaggggagctaggaggcgaagcgcggcgagggatgtgcggtggcaggagcggcggcggagtcggtggtggtgttgctggacagagaagagagaggaaaggggatagagatgaagagaaggagacgagagagaggaggaagaagggaggggtgagaatgacatgtgggttccaccatttttttatttttttctgtgaaactgacatgtgagtccccgtattttattatttttcggatcaaattgccacgtaagcaccacgtcagtgccacatcagatcgagactgagtcaaattagccacgtaggcgtcacgtgagccaaaactgccatcgaaaccgccgagggacctagtctgcacctgttttgatagttgagggacccgttgtatctagttttgcagttgaaggacgaaaatcggattcgttgacaagttaagtgaccttagatgaacttattccttttccagtagagagaactatagggccataaggtccaaggaccaccggcccggaccaaggcacgatcatttggccaggcccaagcacgacatggcccgactagtgtcgggcccgtgctgacacggcccgacagttgccttggcacgatgggctggcccgtcacagtacggtcgaagaaaaatagtagagggatacaaaatatacttaatcaaccatataaggcaaggcccaaagaaagaggaatacaaaatagattatttccagccatataagacacatcccaaagagttgagggggaaaaatagacttattctatggagaagcacaatggactgtcgtgccttcgggccaacccagcatgacccgagtcttattgggccatgtctgggccatgtgtgtagcccatgggctagcacggcatgccccgacgtgtaggtcgggccatgctggcctgactgaccttggcccagcccggccgtgccaggcagcccatttggccattatagagagaacagtatctgtagaaaatataaataattgagaatctgacaggaaaaaaaacattcagaaacctgttctttcagaatctgatagtaggaaaaatcatccaggaacatgttcattcagaaatctggtagggagaaaaaaccattcagaaaacatgtacattcagaatctgatagaaaccctgttcattctgattccagtaggcagccaagtagccaacgcagtgacgcacggacagccaccgtatggaaatggagtcaattcatgaagctagcaattgagtactgtagtaccatctggaaatggagtcaattcatttcatggagctatcaatcactgttgtacgagtataccatatgaaaatggagtcattcatttcatagtagtagtaattactgtactacagtagaaacaggtagctccatgttggttggaaaggaagtataaatggagatgcagccttgcaactgcagggagcagcaaaggcaaaggcaggagtgcaggaggacacagtggcatggggctcaatatcatcatcagagtcaggccaaacctgggtcaaggctcaagatggtccaacctgttgtttgtcagctgatacccatctctacctgcttgtcttccctcgcgtattctcgtgggtgggatcaccaaacaaaccaaactagtggtagcagctcattttgcagatccaacctcaccagatccacaaattacctggcccaattatgttcttcaggatcaggatcaggctcagggctactaaagtcagaagcagatgaaccaagccaacaacaaccagtgcagtaattgaagcagacactgcaccaaatggcgcggtttcttgccaaattccaactcccgcctctggttcaaaacttctggagcaaagcagtgcatattcaggtcagtacaaagcagaacaaagcaaatttgtgttcaacatattggtgttagcagaatagcagttagaaccttcttcaagccgaatgaaaaatgcaaccactggtgctaaaaaaaatcttacagaactctcacaaacaaagccatttgatttaactagatgggagttacaggaaatctagattgactcacagcatgccacatctgcgtttgtaagagttccgtaagaaaaaaaaaattggtacgcagggccagttcaatttgccaggctccaaaaagaacttgaagcaatggagagcaaaagagtgatgtcctgtacaaaaaaaaagggcaatggccatattctgtctcttgtaattggttctactaagaaccgtgtttgcttcaggactcatacagatttataaacctggcaaaaatctaatggctactgctataaactgaagaaggttacctccatccttatgaacaggtcaaaaggatatttttcccttttatcgcacatccaaatgatcatgatcatagtcagatcatgaccgacaatgttgtacataatgacacaattctgacttgcatttttgttccaccggggttactggtccgttgattatactcttcccatgggtgaaaacggtgggtcaaggacgatggatggaggagtcatttcttttcgcctctttgttttcttcttctagatctcttttgtggttaccgattcaattatctgcttgacttcatccttcaggagcatcttcagtgagctggagtacagcttatgcttgaatttctcaataccaatggcagaagaaacttcagaacagtgaaacaaacaaatgcatactgaaaatgcctgcaatgctgacacccgtgcgtggaaatccaccgaaaaatgtccattcccaactgccttcatcgaaatggcagggagagcctctttgttaccctgtttcaatgtttggagagcactaatcagtaacgtttgttactaaagcatgtaaactgccgtgtctataagtaaagatgtagtatatttctccagtacttttaagggaggatttaacaacatgatcttcaactacatctataaaaaatattatggcactgctaattcatgaatattcagacatactaaggtcatgatctgaatgcaggacttaccgccttaattggtgtttgcagtaaaagtataacaaggagaaaaattataaggcgtacctgaaaaggtagttccataggatgcttgctttcagtcatcactgaatcaacccaatgactatcatatgcattgtcaaggacaacaattgggcaagacatatcccatccaccacaatcgcaacctccaccagtcttcaggcggtcaagtagaggtgatgggctgctttcatcatccctcggtaaaccatgtgccccgcctgctgcagccactttaatggtaccggatgatgagccgtctttcaattctt

SEQ ID NO: 15349 - DNA, 7832 bp, Oryza sativa
aaaccaaaagaatcattagtgggatccagtttaagaaccgcatgaagatgagttggtgatgaagtaaccgtcaaaacttgagcttccttactttgctggcaattaggtgtgaggctttgttcagtccttgagataccgctcaacaaagatttccgcaatacacggccttttccttcaaccagcaggctactatgtttggcatcttccttttccataagagacggattcctaagagacttggacttcatgataggatccagaattttcttgaatggactagatcgagcttttgtggtgctgttagcaccatgagtactctctggtggacatgtagcatcaaaaacaccaacctttgttgacaaggacttgggcagtttatttactaggtcaccttcaccatgcttactcccatcagaataaacatcaaccgaatgttggcaattcgatcttgcatctttgctacaggttccttctatctgtctcgtgtggacacttttgctggtgtcttcatcaagagatatctccaggaaatcatctcctgcacaatctttcagcagattgcagtccttgcgtggcctcccaagtcttgaatgttcatcaggaagctcacgcaatgaaagactaaggaactccctggtagcctgttgaactttactacttgcatctatggaagaactcggtttgcacgaacggctctgttgccgcgataagtaaggtccacttgtgctaggctgagaggatgagtccacaatctcaaaggacataaatgaatctctactgagtgcagaatctattttcctccttccttcttggagtttcctcagtctgctaacatcactagaactctggtacatagagccgcgcttgtgcatgatgctatcatcttggtatgcctcacgtcggcttgaaggcaaacttttgcaatggaaatttggaatctgctcgaggtgcagttctggttttccatctgggcatttcaacatgtggtgtctgcccggttgcacttccctgctaggactgtctgcctcctcattgatagattgcattgcttccttagctactcgttgtcgagaacgatttcccatagataaaacctgcatgtcatcaaaccattatacattattagatgtttaggtccgtagcactattcaaagaatcattttttttttttgctgcaggaaaggattaccgccttcttttgttttgccaccaagcaaataatttctactagtacactgcaatgaaaaaggtggatcaatcttaagatccacccacccttctgtatcttataaaggtagaaatctacagtcatacacaagcatacaagcagtttgagcagggaatgatactaaaataactaaccaagagaaattggggtaacaaactggatgctgggatgcaaaacgagatagacaatagaagaaatgttgaaatgatgccctcatcagtaaaggaaaaggtgggcgcagtggcgtcatccctaatcttagaaccataaaaggcaactactataaactccatattagtagcctagtaggcaagacaagtttaagaggaagaacacaatatgcctaactaaaaaaaagatctacttaatctactgaatatccaccctatattatcaggaaggattaaaaaaactgttcttttttttttccttttttaagcgcaaactgtttcttttctcatataaatacagtgcaatgcatttcttgcatccaaggaaacctcgaatctgttaaacaaaatctgagagaaagatgaacatgtccacatgaatgccagtcaaatccctccaccaaacagccaaaactcttcctgtccaaaaactccacagcactgtcgcatctgcagcaaatccagccaatacaagtcccactgggagctcttgaggaaacacataaacagcttcctccaaagaatagttgtccctctccagactccacccgcaaaaccaatccaatctcaatcaccccaacccaaatccccagccaaccacctcaagaacacagccagccaagaacaacatctcccatgaactgaaaaaccttatgaagaatgaatcaagaaacgcccattacctttgcaaggcgaaaaccagatcaacgctgaagaagagctaagattcctcgagctcctctctcactcactctccctcttgagcgagtggagtgaggatgcaagaggcattgggggcagtcgccagcacactcttcttggtttcgcctctcctcttcctgagctgagcttgctgctggcggctggcgaaatattctgaaatctctttgcgcgtttactagctatactagccagatacggagatgaaatatcgtcctgacacgaaggactaaagtgcaagattgtgtaggaagtgaagtgagtggcctcggatatcacgagctcgagggggtgtcctcctccagctgttgattaggccacctaatgattaattagtgctcaattagtagcaaagggtattttaattggctctctgggagaacgtgtcattgctggggagtagtcactgctcacagtggagttctttcttgtttctgaactgcgttacgttgcagtttagcagtactgctgtaaaatacgcgtgaatattagagaataacctaatatcaaatataattagaaaatgtgaggcttctaatttagatcgtctagtctatcatcttatagagatagccgaaaattcctgggcgtttctctaccagtaccactatgatctgcattgccttcaaaatggtcttgtaaagcttcctttttttgtcgttaattcattaatctttgctggaacaatattcatattaatatatagagtaaataaaaaagcactgaccttggagtgatggaccagtgcggcgttgagaaaattttcagctcaagacacgagaagaaataatcgccatcctggtggttgcttgcaacctggacgatctgaaattctgaatgctgttcgtctacctcgagccggaagaaatcataacgccgctccacccactatagattgcgtgcacttgactggatcatatcagaagctctcctgcttctttctgcttacggccatggccccccacatcaccgtagtagcatatagcacggctgcacgacgagcaaggccatggatgtcgcgcaggagtgcggacgacgtcactgacacgtggcgagatctttgaggcagggagggtgtggggaccactttctgatcaccgtgggctccactcgccagtcgccactggtttctcttcttctgccccctatcatcatccacctccagaatctcctctccacctttgcctctctctccctttcagcttttgatgattcgatcacctggtaacatatgaacattctgattcaagttagctaaacaatgctcaaagtactctgtactcaccatttcatcaagtaggtaaattgatgttcagacacataatcatctgatcaaaccaccgacagtgatttcttcaggctggaacatattcggtaaaaaagagctaagtgttgaaaactcgtgaaaatcatacctaaaaattttgtaaattgatgaaaaaaatattagagataaatgtagatatgaaatacattttcaccaaatctcaactccaaactcaacttcgtttaagagatttggtgagaatatatttcatatctacacttatctttagtatttttatcatgaatttacgaaacttagctcgtttcgaacacttagctcgttttcaccggatatatcatcgttatataaatgttcagttgcaagaactactagctatagcagcataccttgattactgcccctgtgatcgatcttgagcttacattaggctgaacaacctaatgtatgtagctggacaaatatttctgatgcgttggtcgcattatacttagcttaggttaattagccatagcggctacacatctaaagatgcagtcacgttgtgttgccttccaaaagcatcaacagcaagcatgcaatgcatgatgcgtggcgcgtcccccacaaaaaaacacaatccgacgactaaacaaacaaaagcatcgtcatcaacatggggtgagaacctgtcgtcaaagattcttggcctgatccacaaaccaccagcttaattagttagcttgtctcctagcaattactactgctaattagtcagtcacacacttgctgctggtcctgagaggctgagatgccctgtgccttttacccacatcttttactaaagtcatcctagtgctaattgactatatatacttgctaagtattctcttttttaatccaacaattgaagaaaaaaacattggaattggtctatttgcaaggtgcaaaatagcagaaaaaagagagagaagaaattactcagggtgctgatgagtcatgacagagatgcatgtgctaacctgcagaaacctcaaccctgtagcctgtaactctctgcaataaccaaacaagcgcttggttcccttgctgacgagcaaaaaactggcctgaatgcgactatgaacagtgtggtatcctatgtggctaatgcagccgtgcttgcatttcagagtaatcaagtaattggtcagaactactagttacagaagcagaagcgatatatagtatttatcatgcaaaatcgaacctgctaatattcagagtttcagaggagggatgatcctgtttcagtagctacctgtgaactaacccgtgccgaatttgtacccccgaaaaatcacatcctgtcacagtgtcatatgttcgtagccggtcgcagcgatcaaggtgacaccaatccgaaagcctgaagctcttaactgtgtgagtgccgtagtagcagacagagggaaagacaaggtgactgtagaatgattaattggctcgctccatcatccactgttcatgcacacggccatgaaatcagacaaggcaaacattagagtacactagcgtatttaataatgtactgtgtagattggaaaaggctggagaagctagttttaccagagcatttcagaagttaccttgatcacgagaccgatttactgacgagcaaaacaatgtgccaacaattcgatgttttctacagggtttggcatggcctttgttgtgcttcttgatttgatctacagttctgtgcacttgatccatggatgcatagatgccaagtacaagaactggacacgggagggtactagcacttgattaagatcatagttaattagtaactaagaatatcgatgcatggacgattgctgctggatcccgtactgttgtctgcccaaggaacccctaaaattaatcgagtcaatggccctcttaacttcaggtcttcaaccctcgttagaactaattaagcatcgtggagaaattagggttggatgcatacctccatccatgaatctaggagtcacgcgctcgcaccggcgacggtggtcacggccaccggcgatcgccggcttcgccgcctcgccggatctcgtagccttgcctcattctgttcggccatcggcctgcatgctaagtgggctggcccataacatgggccaaccttttggtcctatgtgggccgtatccgttggcgaattgggtctacattttggtggacctttcatgggcctcctcgacagcccgaggaccagactgggacggcccaggatttagtgggcctgtttagcgatccaaacaagtatggactttaaagtcagataatcagaattgggaaaagtacatcagaggtccctcaacttgtcatcgagttacagaatcgtcccccaaccacaaaacagatatatgacaccccttaatttacaaaaccgttcaatttaggtcctcaggtggttttgaccctggtttatccgacgtggcggctgagtcagcgtgggaccacgtgtgccccacttgtcaggtgtacacgtcagcacctaatctttttcctctcctctctctgttctctctccttccttcctccctctcgctctttgctctcgctagggataagcacggcggcgcgcgcggcctgagggtggtgcggccggcgacgagcggcggggtggcgtggcgatgcggcggcggcgggccgggcgcaggcgggcgacgcgactgcgggcgcggaggtggaagcagatggatgcgacgccggcgagctcagggcagagagagagagagaggggggcgagtggaggggaacagcggtgccgcctgatgttccgctcgagctgcgccttctcgatctgatcccgctccatctcttcttcctcgctggcgtcgtcctcctcctcctcgtccgggctacaccgccgtcgtgctttccgtccggcatcgtgcatcacggtcacctcatcgtcttcgctctgcttcttggccatcgctgccgccgccgccgcggggcaccctccctatgcggcgggggtggggggggggagcggctggcgacggggcggagaaggtcgatgagcactcattggcgaaaaggctgcagcggcgggagcacgctcatcggcgaaaaggctgcagtcacggctggtggtggaaaggcggcagcggcgctcgccggcggctgccgcgtgtcgtctccgcaacactggcttccgtggacagtggccctacgcccctaccccctccttcccgctaaggaacctccgcgagctcgccttcatcaaccccaaggtatcgaccgccggcgagaccgcgagttccttaaggccatcctcggcaagctctagggcaaccccgacgtcttccaccgccgccgcctttttcgccccaccgtcaccactgcgccgcagctcggggggattcggcgtgcaccagggtgcatcgttgaacgaggaggcccctaccgctctctcgatggacgcctctccctgccagccgccaccacctcggggggattttgcttccaccttcgcctccgccatcgtcggagcttgtcggggtcacttcccccaaccctccgaggcgatgggcctaccgacacggacggcgatacgggcgccgtctccgcttggagcgttgccgctagcgaccaagcaatccccgccgcacaccggcgccgtcgtgcccctcctccgccgcacactggactccgacggggccgatggtggttagagcgagagagactttttttttctgtgtgttatgacacgtgggtgctgactcagcattgttgactgaagtcaactcgccacgtcagctaaaaccggtggcaatactgccttaggacataacctggttttgtaagttgagggatgttatatatctgtttttgtggttgggggacgattttgtaactcgaagttgatggacctctgatgtactttttccatcagaatttgtcggaccaaactttggtgggccagcggcagcgtcttatctgtataacttgggggaaaaagtacaccggaggtccttcaacttgtcatcgagttacaaaatcgtccaaccgcaaaaccggatacaacgcatcccccaacttacaaaactaatacaaactaaatcccttgacggttttgaccccggttttatccgacgtggcggctaagtcagcgtgggacccacgtgggcaccacatgtcaggatgccaagtcatctctttcccctcttctctctcagttttctcatctaggtgggcaggccggccggcgggttggggagaaagccgacagggtgaaacgggagaggaggaggtttggcgaccggtggcaggcgggtcggcggcggcctcccccacgccatggacgacgacggtgatggcggcctcactctccccatcccgttccacatcggcgccatccgcctcagctctcccctctccccgctcttctcctctctccgccctccagat

SEQ ID NO: 15350 - DNA, 17050 bp, Oryza sativa
gtccacctagacgaggagaaaactgagagagaagaggcgacgggcagagtgccggcctcgctggcgcgtgcctccactctcgcccacgccttcttcttcggcttccacttttgggtcggtgccggcctctcatcccgcgtggcggccatcggtgcctttccgccactgtcgcctccgccctttccgccacacggctcgctcgcccgccaccacctctctgccacgacgctggcccgctaccttccccttctctcgtgtctcagccaccgccgcatcgttggccggccgtcaaacctctcgccctggcgaccccctccccaccgccggccagcatgccgacgacgtggcatcctaacatgttgagaggaaaggtagggagaggctggcttgccaacgtggcatcctgacatgtgggtcccacgctgactcagccgccacgtcagataaaaccggggtcaaaatcgccgagggacctagtttgcactggttttgtaagttgggggatgcgttgtattcggttttgtgattggggggcgattttttaacctgatgagggaccttcggtgtactttttcctaagttgggcgggggaagaaatccaaacggtccaattaaaagagcgaagtaaaattccaaattaattcgaagaatcggcgtcaccaaatcaatctcgcccttggttaatcttgtacgattgttgtgaaaatcttaacatcaaattaagagattgatttaatcaaacattacaccaaattaaccgatacacgtttcagcatgtacgtaggagttaggataggagaaaatcaccagcaattaagccattaattaacaatgaccggaaaagggagcgcgtgatctacctaccaataattccaattcctaagccaagaaactaactaactaacgtacgtgctcactgccattgtcgtcatcgataatcgtcggttgcaatatcctcttttccgttgccatttcgctttccaagcctccaacttttatgctgttcatgagcatgacagcgtgcatacatggcattacagaatctacagatgcacaggctagctgctctgctgagataggcgcaggcgcagcgcaatccaaagcagctgacgccttttgcatcctgccttctttgtaggcttcgtcctcctacctctgccatggctcagcgacactggccatggcggctcgccgtgttcgtcgccgccgtcgtgacgccggtggctgccgaggagaggctggtggtgggcatgactctcctccaagctgccacatcgacaggagcaggcgaggaattcttcttgttcttcttcttcttgttgttcttcttcttcttcttctctgtgtgcgatttcttagtgttcgatcgattgcattgcaccgccgcgaatcgctggcgaggtcaacgagaaaggaaatggagattcatttaccaatttaccatgcaattggaaaattccttaattagttgaccttgctaggcacacacgtacacatcgtttgcattcttgatcgtgcgcgttgtttcaatcgatctttgcagtgtgcctcgacgggagcccgccggcgtaccacctccaccggggctctggcggcggcgccggcggctgggtgctccagttcgagggcggcgggtggtgcaacgacgcgccgtcgtgcgcggaaagggccggcacgcggcgaggctccacgcgctccatggacagcctcgaggtgttctccggcctcctcagcaacgatccggacatgaatccaggtgcgaagtgtacggccaatataaatttccaagttaagtcactgtgtttctttctcaaacaacaacaagtagcattgcgcaaaagaagaaaaaaaccattgatttatactcccttcagattagtaatcttaaaaacaaattttatcacacattttatatgataatatctatgctatttaaaatgatattagtggttgtgtccgagtctgcctccaatatcatctgatatgtggggtcataagtataaaatcatcaactcgtgaatggtattggaattgctaattgtaggaattttaaagggttacatacacaaccttcaaatttacctttcaccctctttatctaaaaaaatttacctttcacccatagatgagttataagcgttcaattttgtatatccgaccaaatggcttgtgaaaatagacgaagaggataaaaaaaaaagaagatcatctagcaacatattttagttttgactttggatatgacattatatgtctaatcgagtgactatgctataaccttataatttttttctttgcttttatcacttataatatccactataacacacgggtctttagctagtatacagaaatatcaagaaatatatgattttatcgaagtatttcttttttaaaactggtctatacatattatgatctccatatttcaaaataatattttagaaattatttctagttaaatattttaaagattaatagcggtctttttttaaaagattaatagcggtaacaataaatattatgaatgcggaggtagtagctcgtaatgagatgcctttttcttcaaataacttcgtacatttaccagttcatacggcaagttgttagcaacaacagacgtttccgttcttggtggtacgtgagtttgcttttgcaaaaggtgacagcgagcaagtacagtcacaatcgggtaggtaccatgaagggatgaacagctcatggtcaagaatagttagtgccgggatggaatgatagattcactatgcaaaatgtggaatcgtgcagtagtacatttactagtctagactctagagtcggcacatcgacatcaggctagtgtaaattcaggttcatcaacctacaacacaacttattaggtttctcgagttttagcctttcaggttgttgttttagaggattcataatgtatatttgcttgtttggtgatgattcaatcgttcgactagtaatttcagactatctaagtgactaattaagttggcgttcctaatctgctatatcacttttttattctaactttgattactttgatgcagacatgcagattttatacagtacttttgttttctactttctccatttcatatcataagactttctaacattgcccacattcatatagatattaatgaatctaggcacacatatatatccacatattcatgaatgtgagtaatgctagaaagtcttataacctaaaatgaagatgatatttgttcttcttttaccgttcaattattctatttatcatttaaacaaaaatgtagggattttaacatagtgtttgtcgtcaatttggcagatttttacaactggaatcgtgtcaagctgaggtactgcgatggtggctccttcgccggtgattcagaactcagaaatggcgtacgcttccctgtttccctgactgaaacaaaacatgtcttcaattgaattgcttgtgttttttttcttctgcattgttcagaactcaactcactgttttgtgttttaccactttgcagtcttcagtcctctacttcagaggtcagaggatatgggacgctatcatcagtgatctccttccaaaaggccttgcaaaagcccaaaaaggttcattggttctcctgaaaacagtttgttccattcagtattttctgcacaaactcattttacaattttcatcgcgattaacttaagctggaatccaattctttgatgccaatgtaagcttttcaacactaacaataacttactagctactccgagaatcctaaacggcatcataattcataactcactcattcttcaggcttcagagcttgccctgttgcctttgttcttaacaagttctgaatttttcaggtattgctctcaggctgttcagcaggaggcctagctacattcttccactgcgacgacctcaaaggacgtctcggagatgctgtcactgtgaaatgcttgagtgacgcaggatttttccttgatgtgtaacagtggagtctaatcaagcaaaaaaaaattactttggttgactgattcttgaactcattgggttgaaacacaaaaatttactttggttggtgtcctgcagggatgacattactggcaacaacactgttgagcctttctttaggagcctagtagctttgcaggtaaccgactagttaagcgtgtttctgcacattggatttcacattatttggtagtgttttaatttttaaagccatgagtttttcacgcagggagctgagaagaatttgaacaaagactgtttaagttcaacagactatccataccaggtagtatcaattaagatttttttttatcttccctttcaaagtactgaatttcattgttcaaaagttacaactttttataatcttcttgtctcacttctctgcgcagtgcttctttccgcaatatatacttccatacatcagaaccccttacttcattttgaattcagcttacgacgtatatcaggtaaaaaaatgacatggcgcaacttgatgttttttagcatatggttatacaactcgcaagcaaaaacgcatgatttttaccttttttgaacagttccatcacaattttgtgcatccttcatgtgatcctaaaggccaatggagccactgtaagtcggatcctggtgcatgcagtacatcccaaattgcgactctccaaggttacctttttttttctctttcttggtagagctaaatactaatctgtgcaattttcatataaacaataggtgcaagtctattgctcttacgaaattcacactaaagattattcagatttagattccattgaacaggcatatgtgagatttctggattcaagttgttgtcttcgtgacattcttcagagttctgaatctgtctgcaggactcaggaatgcaatgttgacggctctgaagccgttccaaaatgaacagggtgtagggatgttcataaattcttgttttgcacattgccagagtgagctgcaggaaacatggttagcaccaaattcgcccaggttgcataacaaggtactggcaatctacatgaaaatgttgtgtatatgcggtgtatttgcaggcagacatagatgatatctggtttgtttcagacaattgcagagctggttggtgaatggtactttgagagagggcctggcatagaaatcgattgcgcatatccttgcgactcaacttgtcacaatattataccttctaatcaggtttgttccattctagaggagtttttttttttaacacaaaaatacagcattgtatcatgtaccatatccaaataactgtttgcttgcaattcaaacaaaatgaatgaaactgacaaaaaatgcttggtgactaggaattggggatttaggagtttggcaggggagcatccatgcccaactgtgatcaaaataacaaagatttcatttagtttggtgaataaactgaaggatgaacactgttacaatgtaagtacacttctctgcagaacaaaaagacatcttaattggataggatcatcggacagaaggttagcattaatacaattcatatctactgatccattaaagtaaatgcaagaaaaaatccaaaacaaaaataaagtaaaatgtatggactacttgatcttagcctgatagaaattgggtgttcagttgagattgctgtacgttgctgtggatgttgctgcagctgcaaccacaataactactagtttatatcaagctatactaggctactgcagccctgtgactgtgcagcactgcagccacagccacagccacagggaaccgaacatcccaaatgaatatgcagacacagttaatcctgattcctgaatgaaccaaatttcagtccaaacaattcgacatcttgcactctgcatttctgcaactaaagactgcacccatgttttatgagttccaacatcacttgattcatgttactaaatatgcatctgtttatgcagaatggagactcaggcatccacaatggaggtccctgcatgaacattcctcccaaattctacagcatcagcctacagatgattctttacctgtctatattgcacattgcagaacaattcataatttcatacgacatttgattgaacagtaaaacagagccaatgctcttgtaaccactgatgttctgacacttctgttttcctctcactgatacatgaagaaactattaagtctataacctcagcagagttaacaaaaaaagcgagagaatatgcattgcagaagcagattaacatgctacaacagtatcaaaagctctacacaattgattagcacttgagatcacaattgcagaagcaggactcatatatgacactgaactgtaaactctgtaagaggctaaagagctaaaccatgcacatctgagtcatgatgctatcactatctttaccctgatttgcttgagctgcttgacaatacatgaagagaaaaaatcgaagcttttcaccttgcgtcctcatccggatcaactgctgggaagaaccagaacgagtcgccgtcggcggggaactcgccatggcggtgcggcaccgtcttcttcagcaccagcagatcacccggcgccgcgcccaccctcgactccgaccagaaccacgcctggccacgggcggcgacgtccacgtcgggcagcgtcgacggctggtgcgcgaacaggacggtccccggggcgcggccggccgcggaggaaggcgggacggccgccgagcacccgcggccgagcagcagcacgcgctcgccggggcaggcggcgatcggcagccacgccctcgcgtcccagttgagcttgtagagcgcgacgcggttgtggcgctcgtccgagagcacgaggaggacgtggccgagcgactccacgaggtagtgccgcctcagctcgagcgacgggagcgcgaaccccgtgtccttgcgctgcaccttggggttctcgtccgcgagatcggcgcgccacagccgcctccgctcgtcgacgaggtacaccgtggcgccgacggcgacgacgtcgctgagggccgcgtggtggcggaaccccggcgcgcgcagcgtctcccacccctggaagcggcgccggggcggcagaaggcgaggagcctgtccgcgaccaccccgaggaagcaccccgcctcgccggcggcgggagacgcgtgaggacggcgtggaacagtgcgttccacctggcgattgtttaagaaacgatcctctggtcgccggtgatggggttgaaaagcatcacgcggcgcggcgcgtccacggcgaccatgacgacccacccgtgccccgtggcgacgcaccggtgcatgtccctcgagggcacccggtacccgtacgaccgcccgccgggcacgtcgtagaacacgcggcgcgccaccgcccccgcccccgggggcgactcccgctcggggagcatcagccaggggaagggcggcggggcgtggccgacgcggcggcagtagaggcgccacgcgcggtcgacgaggcggagcctgaggtagtcggcgaaggcgaggaagggggcgaccgcggcgaggatggccccgcggcgcctagggtttcgtgggttgcgcgccgccgccatcgccgcctccgccgcgcgccgccgcggcgcgagcgaccgacgcatgcagcccacgcgacgcgacccgacccgacccgaccgaacgggttcgactcagccgcgtgctctctctctctctctctctctccgcgtctcctcgtgcgcagcgcacgcacacggccacacgcctagcctttgtatgatcccgcgacgccacgcccctctcctatatacccccctccgtcccgtattattgtcattttagattgtttagcacgtattaaagttaaaaaaaatataatagtaccctttattatttaataaaatatattgttgtatatggaatgatggttgagggtagaaaagagacaaatttaaattagaagtgattgatgggataagtagtactctattgtgaaaactattttaaatcccaaaaagacaactaatttggagcggatggagtatatttatatgaataaaaatgtgaaatggggaatttccagaaaagcaaacttgaaatctaaaattggatacaaataaatggtttttatttcagtatagtgaataatattgagggagtctataaataaataaataattaaagagctttcaagagaagtggattaattatttaatgttagtctatatggttattcaacaggtggtgatcaattagtcattcccacattcttcatgtttttcttcaatcacaggaacatgttgagcttgaataccaatgcataaaaaacacgggtaaatttatcatgaaaaaaatcattgtacaatattattttttttaaagaaaaatcgtgctacgagagaaagccatagtccaggatgtaccatatctctaagaccgcgtcactactcactacccaaaacaacatattttctttatataaaagaaatatgtcttatgtgcttgcgtaagctctattgtttgctctttggcttagcagcggcaaccaaaaaatattttttaaaagttgattttgatgtttttatcgtatttatttgccagcattggtttttaagcaagtaaaaatacatataggaaattttatgtatattttttcgctaataaccgttatgattagatgtaggcaaaacgatgggactgccaatcgcttgatcaagtatcttgtaacgaggtggaggtcgaacaaataatttatattttcttttgaagattttgatgctgttttaatgtagtataattttgcatgatctccaaataaatgcagggtcttgtctatattggtatagcaaatctgctgctttgatttgcagcaataactcgagttggccttttcacatccattccaaaaccaaattcaatgtatgcagtatggcacagctaagcatcctgcagccatccagccaaagggcgtttcagttctcgtttgcatgcaaacaaaaggtcaatacttgtagtgcactggcatgcatacacggtgctagtccaaaaacaaaattcaaatctcccccaattcggggagaaatcaatttgattagcccaattcggcctggattcggagcgttcagagcctggttctcggactgacgtggcggctcatgaaggcccacccaaattggatcactgctaatcgaaatccatattgggccggaggagaattttggaggaacagcccacgttaattgggtcttagcaaaaaggcccaggacaggtggcatcgttgtcgggcccattttagcccatccaaatcgagacacatagattggcccagacatgtaggcccacataagattgatcggcggactggtacggcccatataaaattgcattgtggcccattttggaaatccacgtggcccaataaagtttggcccaccagtggacagcccgccgttactggtgctcgtcgccacaaaactctgcacttctctgacaaatcaagtggtaatcaagtcagcgagatgattctatcagttctcaaaataattttacaagcatttttaggcgcagctacacctacgtagtagttttggtttcttggcaagtaaaccgctttcagtcacaaaattcccgacgaaattcatatatgtaaatgtaaaaaaaaaatgttttttttcaccgggcaatatagatttttttttcaccaggggcaatgtaaatgtgttcttgttccagccagcactaggttcttggaaacagacggcctagaagcagagagcagtgctgaacaaacggcaacatcgacgaacaatgtcaactctgacagagaaaacaagctaagctatgttgaccttgatgatgtcctactgaacaatcgatctccaatcctaccaactaataaacaatctaatcctttttatcgtcttttgcacaatcactcgaactctagggaaaagtgagacgatcaaattaagcaattcgattcataattctctcgagaaagcataaggtcaaaccatttttttttttaaaaaaaacagaacatcctctatcctgtgcattaatggcgggtacgtgcaatgcacgccctctcagtactagtaacatgcattaagcaaaaaaaaacaaagaacaaaatatcaaaattaaaagggcgattaatctatacctaaggtaggcatcgtgacgggcacgtagtgcccacgactccagaatcctgattagtaccctccagatacaattctttaagtatgataagaggatgtgattagttggttaaactaattaaggagattaattagcaaacgtttggacgcctgagctaagcatctgctgctaatattgtattcaggcatgctccccttgatgatggctgtggctgccgtttcatggagctcatgtctctcatgctctgggcaatggctgtctctagccattggagtcattctgacgacgtttttaccccggatttagcatgtcttttctgagttttggctgcacttcttccacatttcaagtttctagatactaatttcatgttgaatctgcttttttttttaaaaaaaaagggggaacaccagtgacattatttctaacgaaaaagggggatacagtataattacatggaatagtgtaattcagattgtagcaactagcaacaagcttgctgcttaaactgaaaactatcacttcaaataggtgcagttaatagcaaactgtaaatgatgctctcagattacgtgtaggtaaaaaaatggaagtgtcattaggcttggaaatttatttatttttttaaaaaaaggcttggaaatgactaatgagcatgcagttagtacaatattgtcaagctatcagcatagctaaacatgcttgcacgctggggcctaattaaactaaaattaattaaaagcagaggcacaccggccatgcaaccacgctgctgcgatcccaacaacaattttcgagagcttctatgctgctcgtgcgcagctgcaactttctcccctcaaaagaggcaaccggcctgaacattctgaacgtgcgagagagaagaattccattgcagtgccaatttgtcatttgtttaatctcctaatccaaaagaaaccatcctctgtttagccgtccgtaatctctgcaccgtccattcaaatctcctaatgctaaaaaaaagagttattttgcacgtcacacttctatcctactctgaatctctgaagaatttcaactctgaatttgtaaagttcagagctgcgtgaggttgcacgaaacagtgtattaatggccgtttgtgccgtgcaagatggaaaggtcgatcagagttcttggccattctgcacgcaaagttaaactgtagttagttgctcgtacctaattactgaatgcatcgatgattagtcatgagtgtactgtgacacgctgcactggcaaacaacctggcctgatgagttcatcgtctaatctcaatcatcatctctgctgggactgttagttctgaacctgaacctcgcacgaatgcctgaataatttgagttgcgttgcgtcagcgtcatacattacactaatcctgtcaaatctatcacaattcacaactcatcaggccatgatttgttgctcatcaattaatattgtaaccaacttatcatccaatcattagaatctctgtggtctgattagttcatttcaactggtttggttgaacgtgatgtgaagatgctgtcaaatccctttgtttttaactgaacttccatgtgtactttgtatagtttcagagcaggaatatcagtaaggatcaaatccattaatatcatggttgactctcccctaacatcaagcaattactactactttccaaggtcattaagcaaacataatcttgccatgatttttatacccatgcacttcctttccacgcctaataaaaaataaacaaaaatcagcaatgtctcccaatggcatgatcacttgccatggaccagaaaacacaaaaccatatgcaaacagcacatcctttgcttaccattgactcctttttccatccaagcctaagcaagagaggaagctgatgcaggaattcttcagaggaaacatgagcttccaattcatggcaagaagatcattggcttgagtgtcttaggaatcaaatcaacatcacaaaaaaaaggtaagaatggccaatcaatccttttcttgtgccatctttggggggtgttctatcctttccatctcctttgcagcagtcaagaatattgcaaaagcagtgcttgttttctttcaatgtttttttctgaatcttgggagatgacgacgacgatggcaatgcatgcatgcgtccaattgcacaaaccctgtatgtaaagaaaggttcaaaagcaaaagcttctgaaatctttagagcatactggtcctctcaattccatttgcatctgcatctttatctgcatgagatgatttagtttatgacttggtgtcgagtagtactactagtaacctcactatcatctagaaagcagcgagctttgttgctaaacaaacaggggcattttgcaagattttctcaccgctgtcctacataggcacacaaacattggcaaaatgtgtttaaattaagctacagtttcaaatttaaacctaggactaggaggtttgaaatttttttagtgagatgggtttctcttgtttcgatgaacttgtcgtgtccattgcaaagaagaactcgttatatataaagctctctctcttcttgtttcttgcagcgttgagagctcgtcggcatcaatcgatcggcaatggagagtagctcgtcggtgtcggtgtccgacgagagctcggaggcgaacggcggcgggtgctgctcgtcgtcgacgacgccgagcatggacgcggtgaacctgagccggactttctccgacgtgtcgtccttctcggaggagcatggcggcagcggcagcagcgtcgaccacagtggcccgttcgagccgccgtccgccgccgccgtgtcgaggctgatcggccgccgctcgccggctgcggcggcctccgctctcagcctcagccgcctcagcatgaagccccgggccgacgtgctcgaccggcgctccaccgacgacgagctggagctcgtcaaggagaggttctccaagctcctgctcggcgaggacatgtccggcggcggcaagggcgtctgcaccgccgtcgccatctccaacgccatcaccaacctctacggtacgcagcgcgatcgacatgatcgccggcgaacttgttcttgctaatccgtgaccaccatgactaatccgacgagctaatgcagccacggtgttcgggagttgccacaagctggagccattgccggcggggaagaagacgatgtggaggagggagatggactgcctcctctccgtatgcgactacatcgtcgagttctacccctcctcacagactctccccgatggcaccaaagtcgaggtatccatccatgatccatccatggacgattcaatggatttctacttaccaaacgccatggctgattgattgcttgctccatctccattgctgttcatcctgcaggtcatggccaccaggccaagatccgacatctacatcaacctccctgctctggagaagctcgatgccatgctcattgtaagatcccaacaaatttgtcgcaaattaaaaacatgctgaatttgacgaattttggatgagctgaatttcgaatttgtgcaggagatactggagagttttcagaaggcggagttctggtacgcggacgccgggacgaggtcgttcgggtcggcgacgtcgtcgtcgacgatgtcgtcgtcgtcgttccggcggtcgacgcaccggaacgaggacaggtggtggctgccggtgccgtgcgtccccgacggcggcatctccggcaaggcccgcaaggagctccagcagaagcgcgactgcgccacccagatccacaaggccgccgtcgccatcaacaccggcgtcctcggcgacatggaggtccccgactccttcatggccatcctccccaaggtaattaaacaacatcaccaactccaatgcaacagtaacatcaccatttttttccgataatagaagctttatatgatacttcctctgtttcacaatgtaagtcattctaacatttcttacatttatattgatgttgatgaatctagacatatatatttatataaattcattaatatcaatatgaatgtggaaaatgctagaatgacttgtattgtgaaatggaggaagtacattctaacggagcttactcccggcctccgtatgaaatgcacacggccacaaaacaggatctaactagaccctcaacacaaaacaaaaaaattagtgactatcaagccgtagactagatcgccacccatattccagagtaaaaaaactcctatgccacctgatccaaacaacgcgataccaccaacaatagtatttgtcgtcatcatcttcttcttcgacttgttcatcatcgtgttcttggcagagtgggaaggcgagcgtgggggacggggtgtacagggcgatgctgggggcggagaagttctcgccggagtacctgctggactgcctggacatgtcgtcggagcacgaggcgctggcgatggcggacagggtggaggcggcgatgtacgtgtggcggcgcaaggcgggcgccagccacgggaggtcgcggtggggcgccgtcaaggagctcgtcgccgacgacgaggagcaggacaagaacgtgatgctggcaggccgggcggagagcctcctcctctgcctcaagcacaggttccccggcttgtcccagaccaccctcgacaccagcaagatccagttcaacaaggtaatcaaactaactaatctacaattcatacaaatgcaacagcattagcatccaacattagcattcaactaatcaaagtacgcgaatgcaagaacagcattggctttcaactagtaagagcatgcaaatgtaagaacaaaattggtactcttgattcagctgatcaaagcatataaatggcaagaacagcattggtattcaagtagtaattcagagcatgaaaactcaaggataccattggtattcatgatccagctgatcaaagcatataaaatgcaagaacagcattggcattcaactaattcagagcatgcagatgccagcattggcattctgtgatctatatcttcttttcaaattcaaaatttgatacgttcctgaccaaatgagattggcaaaatttttcatgtaggatattggtcaggcaatcctggagagctactcaagggtgctggaaagcttggctttcaacatcgtatcatggatcgatgatgtcctttttgctgacaagacggtcaggaaacagtgagcgacagccagagcgtctggactctggattgaagcttcccaacaagagctttagatgtttctgttagtgtagctgccaagagaaaaaaaattaaagtaacagtaggtagggtgattttgctgaccttagtgagggaactgtaagctttagcttgcaacaattatgtcttgtatgaccagcagtggttgtatgtatgaagtaatctgctctgtattcctttttgtttcctaacctggcctttctgtcctcttccttattaccaaatcatggtagtactgcacaggtttaagagagtaaaaaaatctgtggttgctaagaacccaggactgactcactgaacatgtatgaaaatacctggacacataaaaaagtttcagtttaaatctagagagcatccaatttaactgaatacgagctaatccgcacttcaaatctagacgcaaactaccattgcatttgcagatttgctgcctccatgatcctactcaattacatttcatatacttgcgtccatcgatggattgtgtctttgtattcaaaatggaaaatccaccgagatgataagttaattgcatagcacgagacaggtaaaaacaggataagatctggttaaacaaatatagctcctcccaagagcgaattgctgacatacaacgatgattctctcaaacttttgctcggctgtatggcatacaactcgaagttcaacccaaatataaacgtggtttataaacattacaacggtgaaaaagtgtgataactaacacaaatactaacttagttcaacttgaaaataataaacataatagataatgcatactactcataataatcactcgaagcaacatggccactctcatacagtgttccatcttctggatgcttaagctcatctccacagaaatagcagtgttgtttgtcaatgggaagacctggaacacctcttggataatgaactctggcgccatagtaaccacctgtaaaagcaacttgtatatgttagtaacattttaaatagaatatcaaagttttgagttctatttttggactaaccaattttttctttcccttcaagagagaccatgcaagtgggtatatatccattgttttcccagcgtacttccgcgaaaaataactcctccgagttcttgcaatcgccctttgcaataaaatttacatgaccatgaaaaccttcgtccagatttccacagctagtgatcgtcctgactaactcatatttgatctatgtttcaacaaaaaaaaacagataccagtaattaggccacaaagatatagtgtgcataatattgcattaagaaaatgaaaatataccaagggccaatttcaaacaaattattcaccagactattgccacgaattatctacttgattataaggataaaatcaaatattttaagaaataaacttaacaaacgcacacaagcttccggtgtacacacaccaactaataaatgttataaaaaattccagaaaaaaatgtatacaagtacttccaatagtagtacacatgtatgaagtctaagcatcaaattatttttagccgtaacaaaaaaaaaagaacatatgacagcttggtagaatattaatctggcagatttttttcttcttttctctctccatatgatgaatttaaagatgag

SEQ ID NO: 15351 - DNA, 2270 bp, Oryza sativa
ggatggatgagctagtacaacttacgcaaaaggttcggatccacctcttctgaaaaaaaaaaaaacaagaaggccttctttggttatttttcttcggagtaagttcactttttgactctgaatcggattcgtataatttgacttgttttggagagcggtttggccttcccgacctggggacttggggagagtgcttcctcgatgccttccggacctcagcgaggagggctgcggtggcggaggcggatctcggggcagtggaaaaggggggagctcagcggcgacgtgcgacgggcggccggtggcttgggcggcgtcccctccatcgccggcggcggacgacctcctcggcccgccaccgccgccgctccgtccctcgctcgccgcccaacgccgccgccgctccagccctcttcagcccgccgccgccgatggccgattggctgaagaagaacagaaaggagagacagagggaggaagaaggaaagaaagagggtgatatgtcagtgggtcccacattttggtgtgaatgacagtgtgtcccacacgtatttttttaattttaatacactacgttaacttcacgttaaacaaatcaacacgtcacatagacatcacgttagcgaaactatccttttaaatcaccgaaagaatcaaattacaccggctttaatagttgtggttctaataaattcggtactagtgtttagggacacgaatcagatcggtcaataatttagggagtcagagtggacttattcctttttcttctaacaattccattccaaaaaaagcagtacgtacacaattgggcttctttcttgggcctccaggcgcttccgcagccccagcctatagcacttggatttgtggattcatagtttcgggagtggaaataagtctattttgcttccatcgaccgtaaaaccggatataacccgtctcttttaactcccaaaaccgtctcttcttggcttcccaagaagagctttagatggttctgttagtgtagcttccaagagataaaattaagggataaagtaacagtaggtagagtacagtaggtagagtgattttgctgacctagagagggaactaagctttagcttgcaacaattatgtcttgtatgaccagcagtgcttgtatatggagtactccctccgtttcaaaatgtttgacaccgttgactttttagcacatatttgactgttcgtcttattaaaaaaaatttgtgaaatatgtaaaactatatgtgtacatggaagtatatttaacgatgaatcaaatgatataaaaataataaataattacttcaattttttgaataagacaaatggtcaaacacgtattaaaaagtcaacggcgtcaaacattttaaaacggagggagtatgaagtaatctgctctgtatcaaagcatggtagtactacccaggtttaagagagtgaattctgtggttgctaagaacctaggactgactgactgaacatgaatgaaaatacctggatacataaaaaaaagtttcagtttaaatatagagagcatccaatttaactgaatatgggcgaaactaaaaattaatcaccagtcgtggggataacaacgcaaaagttgatggatcaaatgccttctgcatacaaatttagttgaccacaatgtaaataatgctactagttgattagctacaatgtaacagatacctgatttctagcactttttatgctctttaatctttagtaagccatcagccatccctgcacaagccaaaaacaaaaggaaacaaaaatcttcagtgatagcagttacaataaacatggtaactcacatacatcacaagcgtggatttaaataaaacgctagaaatatcttctcatcactgacataacatgacttgcaatatacacacataacaaaatatctgaaaaacttaaaaagtagtcatcgatagaaaattgcagataaatttattgatcagagcagccgaaggggcacttttacccaagttctcccggttttgtcctaaacatataatagcaaaaatgtactccttgttgtacttcaaccaacaattaaaaagagtaagatccatgaatacatggcaaaggaggccaccctgattcatattaccaatggattatgggagacccaaatcttactagtatacaaacacccccaaggagaactccgactaactatataattatctatgtcataaagctaaatttgagctaccttgcaatgcagcctactaagcgcaaccttaagaaca

SEQ ID NO: 15352 - DNA, 695 bp, Oryza sativa
tgattaccacttgatttgtcagagaagtgcagagttttgtggcgacgagcaccagtaacggcgggctgtccactggtgggccaattcttattgggccacgtggatttccaaaatgggccacaatgcaattttatatgggccgtaccagtccgccgatcaatcttatgtgggcctacatgtctgggccaatctatgtgtctcgatttggatgggctaaaatgggcccgacaacgatgccacctgtcctgggcctttttgctaagacccaattaacgtgggctgttcctccaaaattctcctccggcccaatatggatttcgattagcagtgatccaatttgggtgggccttcatgagccgccacgtcagtccgagaaccaggctctgaacgctccgaatccaggccgaattgggctaatcaaattgatttctccccgaattgggggagatttgaattttgtttttggactagcaccgtgtatgcatgccagtgcactacaagtattgaccttttgtttgcatgcaaacgagaactgaaacgccctttggctggatggctcaggatgcttagctgtgccatactgcatacattgaatttggttttggaatggatgtgaaaaggccaactcgagttattgatagaaatcaaagcagcagatttgctataccaatatagacaagaccctgcatttattt

SEQ ID NO: 15353 - DNA, 4167 bp, Oryza sativa
  unsure (1)..(4167): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccaatatagattcatagtacaattttctgtagcaacgcgtttggcgtcatgaagttgcataaagttattatcaagaaggaaagcataatccacgatcatctagaattttgtcgttaaaaagacccaatttcctttggtacttactgtccgaatcctaaagctacacatccgtaatttaaacacaatcagaacatccgacggcgacgcatcgtccctcagctcctaaacccctcgccgttgctcgcttcgatcggctcgccttccgccgccgccggacgcctcctcgcgccgaccgccgcccgccgttcgccgttccttgcgcgctgaggcggaagctatgtattccccgcaacctccgagcgacggcaaccccgacgacggagccctagcacgccctcgccgccagctctcgaccgcctccgctgccgattccctcgccgtgttcgccctcgccaagttgatcgacgaccgcgccacacatcaagctgatccccaactcgccctcgccctagccttcgcgatctgtgcgcggtttcaggtgagcgcctcgatcattgttactgtttgagtggggatttcgccatctgcgtggcatggcatctcttctcagcggactgtaaatacttataactgatatagtgatatgtatgtttgtgttttttgtgaaggaacgatcaatcacgttcgactcatcatcctatcacaagcttggtgacgattcaggtgcttttaccacaaaaaatgatgatgatttcaggtatatatatgcgagcatcttagttcgtttttgggttaaaagctctgtgctaactgtaagcctttaacctttttcaaacgaaattagacaggcaactagaatatggattttatttctttttactatagatggaggatgcaaatatacatgagaattccttgaaaaccttcgacggaaggatgctaggaaaattccatgtacatcacagaattcctatgaaaatttgctatttgaagcacacctcacatgcataaatttaggctctaggatttgaaccgtagtggacggagttatgcaacccacaaagtccacaactctactactgtgccttactgaaccttggaaataggctacatgcggattgattttgtgtttcatggtttccccacaaaaggactgatgcttattcagaagcacagcttcgataagagtggacattacccctgctattaggtgataatataactattgggttatcaagtctcattgagcttcattgggatgatagtgactgattttgagttttttttttatcggccaatagtatggggtgcctcggagaggcatatgcaagagaaagaagagcgaagaaaatgaacaagctccatatatgtcaaaactatatttatttattacaatacaactttgtgctattcactgaaaactttcttttttttagtttggttgtttctcttttatcgaaacaatatagtaaatcttttgctagttcctcctggtgaccctctcttctgagttgttcatcagagtatactgagtgtggacccccgtttttatacagggaatcaatcgtgtaatcagtaccatttccttggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggcagcggcatgccattgccacaggcaacgaacgtactaagacctactggacgccatcgtcttcatctctctcctgataataggcatagggatcctccgaggcttcatctcccgcatctgataaattttatatttgcaaggatgagtaccaaccgtactcagcaagccaccacagcaacaatgcatatgaaaggggagttcaaaggatggccatagttcttttgcgcaaagcaagttttgtaattcttttcacaagcctaagacctagcattgaccgatcaaattttagtaccagagtttgtatttaaacaacgacggttctgtccaccatccattgtgatcccaaggatagcttcccgccattgattcgtcatggttttctgaggatgtccaccttcccgcctctcaggaagtggctccatcagcataaaaatcatcatgcaacatcccatcccacacacgttaaagaatttagagtctagccaagtataatacatgtctcggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtcttcacatgccgcatctcaattaccttcccaaaggtaattgcccaagcatatagcatttgataaatatgagtatgcatgattttagaatagcatttctaagcagttgtcataattgactagggactcatacgtaatcatgggtacaaggattttaagggtaaacaataatcaaggcatggcataatcacaagtaggacgttcatcattgcatgcaattttatttgtaaacaaacaatttcgcaattaggatcaacatgttcaacgaatagtgatgacttgccttgcttaaagtcttgcgggtcttggccttcgcttggatccgcaactccctcgggctctatagttacgtgcaaaaattgatttgaatccgattagaattcaaataaaaatccaaataaatccaaatgaaagtcgaatgcgaaagtcgattcctttttattaactttactatctgcaaactacggcaaacccaatttcgatttaaactactttgcgggtataattatttcattgtcaataatttactctccccgagcattgtatataataggttagaaatttctattacgagctaaatattggacgaaatcctagaaatattatacaatttaatttagtctatgactaaacgattaaatataatatacgtctaaaattcctagcgattaaatccgaatttctaccgtgaatcgattacttatagggattacccaaaaataatctataataatctataagaattcatctatttgtttagttattaattacatctaaattactaccgcgaattgatttcttatagaaattactaagaataatccataatttatattaaattttgtaattctacgactataattaatctataattaaattctaattattttaaattttctaaacttccccaaactccctctaatttcctatttatttcctttttctttttctccctttcctttttcttttcttttctcttctcccttttctttttctctttttctctct

SEQ ID NO: 15354 - DNA, 29331 bp, Oryza sativa
  unsure (1)..(29331): unsure at all n locations
cggcagcggcgtgggacgcgaggtggcgacgcgatgggcaagcggcgcgcgggtcgcggggcgcgagacggtgcgcggggcgcgaggcgacggaacggggcggcagcggcgacacgacgggcgcgcggcgatgggatgggcgggcggcagcgacgggcgacattggcgcggcgcggcagcgggacggcgatgggaacggctcggcagcggcggcgcgcggctcggagcgacgatgggacgcgcgcggcgatgggacaacgcggcgcgacgccgatggcgacagcgtggcaacggcggcgcgaggcgcgagccaccggcacggggctcgaggcggcggcacggggcgcgagcccgacggcgacgatgacgacgccggcgcggcgggcgagcggcgcaagcggcgacgcgcgggctcgggcgggctaggcaaaaggtggggtagaaggggaaaggctagggaccacatcgaacaccttgcgggcaatgaatagtgcacttccctattattcccgattttaggttatttcctatatgaatttgattctattatttctaaatcttgcataaacgaagtttactcaatatgtgtattatctcaactaatgaattcaccctaggttaatattactcatattttatttttatataatttatttgagttttaattagggtaaattcttattccatcgcaattaaatttaattgatccaattatggtcgcgataatattttatttattactatccacacctaatctttatttttaatttatatttattttaccaatttgtttttaaggtttattcctgattaactgttctttactcactattaatattcttcgagatcaaatccaggtaaaataggcgaataaaatcggcatgttgcaattagtttgaaaagtttttttttttgaatatctgcatttttagagttttgattttgtcggtcgaattttcagggtgttacactgagccaatcattttttttattgactgacataccaaaatactcaggcctagccttagaaatatattctattcacgacctacttttgttgaattagaagcaagaaccacactcaggtttacggaaatagaattccatgctcacaatatctttgactatgaaaccttcctatgcatgggggataatattctttcatttcttttcacatgcagtgggagttattttgcgggactacaaacctgggatgatcccactggaccatctgatgaatatactttcaaggaactgcaggatgaatttattgctgcctgcaaaaatgtgtaacttgccctgggcatacaagatgccaatgcccgaacatttggaaagactcagagaacagaatgagtgcaagatgttagaaataccactgcacttgtatgtgaagcaaaaaaatattctggtaccaatccacgaatatctgtctaaccttgaatttctaaatcttgcatcgttcgttctggggagataggggaggttgagtctcgttttccgcgctcacgcttttcaaactactaaacggtgtgttttttgcaaaaaatttctatagaaaagttgctttaaaaaatcatattaatccatttttgaaatttaaaatagttaggactcaattaatcatgagctaatggctcacctcgttttatgtatcttttcaatctcctcaatccccttctcctcaaacacaccctattttagaagtgttagttttgccttggctgggtaaagttggaatatttgtttgtggattagaagatggaaatgtatctggactaatatcattatgtttcagcctgctgagttagaaatcatggaactgaaagaaaggagtctttttacggaacgtcgcaaagtatatggacacttcaacttcttggtgaaagattcagatggcactcatactttgttttttgctgaggtggatctaaactgcaaagaggagaaggacgtttatctgtgctgtcctttggaagagaatgataatggtattatctttcctttcttgtgaataattgtatttattctttcattttgttaaaatgtgtactaatactttttttttctttttaaggtcattgttttggatgtcgagagtgggacgtggcacttcagcatcccacttctgctgactatctgggtggccacaaggatatctgtgagccgtacatagatacagatgatgaatatttcgaatttatgtaatgaacctactaaagacatcggcttcaggatcactcacaagtaggaaggttgtgacgctgaacgttcatatcgatgtttggaaggtaatttaagcaaaggggcatggaacttcaccagactggaccatttccttttgtactagctatagtcaattcatgttctacgtatgcttgttgtgggttctacttagattggtgctagtatgtgatattgtcatgactgcatggggatttgtacatagcctccatcttaatgaaatttgatcggcctttcttccaccgacccggcaaaaaagcctttcttctgccgacccggcaaaaaaaaaagattgtatggggactttgtccatgcgtattattggaggcaggttaggaggctctttcactagcccatcgaagcaagcgaagcacgatggaacatggtgaagccaagtggagctcttaccaagatcgagtcaaggcgaaggcgagctgagctgtggtgaaacgcattggagtaggctgacaacgcctatctggcggcctaagcctggcctgctaaggcctagtagactcaagtgagccaaggacataaaaaaaatccctgtagatacccttatcatataggggtaaaaatgtaaaagcctatacatggtaaaccatagggttagatttggtgttgtaaacctatagatagctctcaggtagtgtattgtaaagggcgttcaataaaaaaaatacaactattgtttttttttgttccgtacaccaggacaagtgtttgtctttcgacaacaattggcgccgtccgtggggagcctagccaaagtcaatgccgctgaagagaagattgacaagaaggagggtggttctgcagaggtatgcgggtgctgtcgaagattatgtcgagtatgccttagaagcctaagccaaagcctagctcgagggacctctggcaatgaactcggacaagcaagcctcaagaggagataaagttgagtgcctacgggctacgagctaagctgctttggtcccaaggccggagtatgaggttatgaggtagtcaagttgcaagagatgcttcactagatgcagcaacaacagtagctttgtcggcaagagtcggcgtagctgcacgagcacctatgccgaacatgcttcaatcccaagtccaatctctctggtaggctcacatgataccgccccaaactatagtcccaggtgttgctttgacgacataggtttcgacatcacagtctaggttgaacctagcatcgatcctctaggcacaattccaaatcttcctcaacaagtgaatgcgggtcttcctcaaagcatccaactgccacaacaagcagtttcacctccgctgacgacaattgccagaggagcaagttaaaggttggtggtgtggctaccaggggcgtcaacaaaccacttcgcctagtctacgcccagcatacactgcaacttcgccagccaacctagtcgcgcacggagctttggtcaggggatgtccccccaccaccactggcccagcagcaaccagcaatctcatcttcggatatctgtgttgtcctttggaagagaatgacgatggtagtataattagaattttcactccttttgtaacaattatgtttttctttcatttttttaaaatgtactaatacttaattcccttttctttttaaggttagatattgttttgggtgccgagtgcagcatgtgaaagttaggcatcctacttctgcggactatttgggtggccatctatacatatcccttcaccttaatgagggctcattcgaactggaggaaaaccgccggaaaaatggaggatccgttatcctttgaattcaatcactaagagtggagtcggaaaaccgtgggaaaaatggaggatccgttattctttgaattccatcactaagagtggaaatggaacatgagagaaactaattgagagcaagaaaagaaatcgaacaacccaacattcgtcatatgctgtttccgccaccagatacagcaaaaaagaacaaaattcttaacacatatgaatatactcatataattcaacccgttgcaaagcatgtgtatcttgctagttaattttaaacatgagaaaccaactaacatatattagatatccttccgtccccaacaaaatataaatatttgtagctacgaatctagataaatgtttataaaaatttaatgtttttatattttctacgattccggttaggattgccgttagcgtgtccggccgccgggcggagtacaaacgctgttctggacaacgttcccagcgacgcacttgcactccacgtcggacatgaatcctgatcggactcaaccccaaaaaaaaaaaaaaaaaaaaaaaaaaaaaaaaaaaaaaaaaaaaaaaaccttcttaaaaagaggtgggggaaggaaaaaaaaatcagtgcccgctgaatatcgtcactccgctcccgaatcccgatcccgccggcgccgccggtcgtcgttgccggagatcagtcgcgccgccggtcgtcgttgccggagatcggaaggtttaaggataatgtatctcccaagcgaccgagctccagcagcagcaagccctcacccccagccatccacctcagctgctgctcccctcgccggatcatcttctcgcaagcccgctgcttctacccaaatagtacttaattataggtatgtggcctcctaagattgcaggatctgaaaacagctgattttttttggttgccaagctcctcttttaaagatatatatgagttcttatgctatctcctctataaaaagtaggaccataagcttccttgaattcctaaaagggaaaaagaagttaaggtttttgctcgatgtagtgtaactagcccattcctccttgaattccatcttacaattggtgagctaaagtttttattgtgtaccaaaacaacaaattagttaaatattatctaaaaaaacaaattagttaaatgaacaggcgtggtattagaaatataatctattcactgcatgctttaagttcaagtaggggaatagcatatgtatatatgttcacatttattaatttccacttgcagtggggaagaagatccaggattacagctcttggacaattacgatcccactcgaccatcgcgatttaaaaatgcccaggaaatgagagatgcttttgttgctgcctgccaacgcgacgctaagccctttgcagagaagtggcgattgcctgaagatttggaaagactcagacgacaggatcattgcaagatgttgaagatagcactacgcgtgtatgccaagcaaaaaaatataccggtatggaaccacgaaaacgatggcgatatatattttggctcatcgtcaatctcaaatttctaaattctatcttgttcgagaagtgttagttttgcctaggctaactgggtgaagttagaaattttgtttgtgggttggaaattggaaatgttctacatatctggactaatatatcattatgtttatttcagcctgctgagttagagattatggagctgaaagaatatactcgttttcgtgaacatgggaaagtttatggacactacaactttgtggtgaaagattcagatggcactcttacattgttctttgctgaggtggatatcaactgcaaagaggagaaggatgtttttctgtgctgtcctttggaagcgaatgacaatggtacgaatataagaagatttatttctcttttttgtgaacacatggcaagataattttctttcgtttggtttaaatttgtactgataactcttgttcttttcctttttttgtgaacacatggcaagataattttctcgtttggtttatatagacgctgtttacaacgttcccatgcacttgtacaccacgtcgggcttttttttgaacggagcatcgggcttgaatataatcctgatcggatatactccgacggaaacattcttaaacgggagaatgtaatgagggtgaaataatccattctttccgaggaaaatatcagacaacgggtcctcctccgctcccgattgattctccggcgccgctcgattcgatccgttcgccgccggtcgtcgttcccagggatcggaagcccgttgtccgttcaagtgtaagaccgccagcgctccactacctcgccgacgcgatcgaccgcctcaactcgccctcgcgcggtttgttttttatttgccttctgtgaaggaacgagcaatctcaatctcgatggatatcaggtatgggaaggaaatgaagagggagaaggaatattctattattttattttagatatcccacacaaaaaaaatgactttttattttatcaatgacttggtaattactcggacgagcatacggctcgggcgatcgatccgtttggagtaaaatcaggctgacgtcagcgcccgatttacgtataaaactattttaaactgatttttcttctaaattacttatccaaatcatgattcgattgcaccattaaattcattgcaattaaatctttaaaacaagaccacacatggatatattccaacaaaaaaaaaagcttattattaaattatttttaaatgttgcaagatgttccaccatgtatatcagaattgtttcactaagtagatcgaaaatgtttcactcgtttaaatcgggtgttgtttcaccttatataaaaacaatgtttcagtaaatagcgaaagaatgttgcagttcactgcaacattagatttatacatagtgaaacatttttccgtggaacaaaaaaataaaccaaattcttttaatagagggttttaaaatatgtgggtttttttgttgcaatggaatgtttcgttcactgcaacattagatctatacatagtgaaatattacgagtacaataggtgaaacatttttggtggaacaaaaaataaatcaaattcctttaatagagagtttccaaaatatgtgagtttttttttgcaaaataatattttaattcactgcaacattagatttataaatagtgaaacattataagtacattaggtaaaatatctttcgtggaaaaaagggaggtagaagtgggtgggcccaacacggagggagggtgcgcagggggagcgcccgatccggctcccccgcgccagtcgtccgaggtaaagtattttcgtaattactctctacgttttatgttacaagacgttttgattttggttaaagtcaaactgattgaagtttaacagaaaaaagtaataatattttcaacaaatttattatgaaaatatatttaattatttatttgataaaattaatctaatattataaatattttattattttttctataaacttgatccaaatttaaaagcagtttaactttaaccggagcagtaacaatcagggcgtgaaacctgatcggaatctcggatacgctcgcagctcactacgtatattccggacacgctcgccggaggctgaaataaatcgacacctttctctctccccccgatttccctcgccgctgctcgatttgatccgttcgccggccgccggccgccgttccctcggtcggcgttcgttgcgcgttgaggcggaagctatgtattcccccaaattccaagcgacggcaaccccgacgacgacgccgagggagccctagctacacgccctcaccgccggccatcaaccgcctcctccgctgctacttccctcgccgtgttcgccgtcgccaagttgatcgaccgcgtcacctccaccgctcttgtcgatccccgactcgccctcgccctcgccctcgcgatctgccagcggattcaggtgagcgccctcttcttcctctcgtgtgaatgtgtccttggagtgattgatatctcttctcggtggactgtaaatatatatacatactgacctgcttgcgttttgtgaaggaacgatcagtcacggtgtatgtgaccctcgattcatcatgccgtcgcaagcactgtgatttcaggtatgcgaccatttttatttttctttttgtttcgagaacacgcacaaggcttgcgtatctttgtattacttcattcgtttcatattataagattttctagcattgcccacatatatatatatatatatatagattcattaatatctatataaacatgaacaatgctaaaaagtcttataatataaaacagaaggagtataaaattgagaaataattacatccagctagttacaacacgaggcaaggcgaaacaaagttgttgacaaaaggtttatatctcgcggcatagtttgtgcgaccctattagaacccagaatcttaattcgtcgttgggttaaataatctgatgctctatggtctgtgctacctgtaaggctgtaaccataggttcctgatgagatgagatttattagatctacctccacccccttgtcagttttaaacgaaattagagaggcaactagaatattttttttctttttagttatagatggacatagactgacaagtgcttccctgaaccaaactttccacagaatggatgccaggaaattcctaaaaaatccctatacaaaaaattcctatttgaagcccacctcacatgcatcaatgttgacactaggatttcaaccatagtgagtggagtcatacacccacaactctactactacaccaaaggataaactactactacaccgaaggagtttaaccttcaagatagggatagctagacagtgatggaagcagtgggtattccctttataatcgggaatacccaaaaatttcacaaaagaacttaatatatgtaggtatttacatgtatatatactcgattgtctaatattttttctcaacaaatatactcctgcactcctagctcacaacacttagttagtcaactgcttcaaatcttctaaccctagtccaccaaacatcaggcacaagatgcttgcaattgtttgagtgaatacctgaccaataaatcctgcgtccgccactgtagatagacatggattgaaggctttcctcacgcagggactgatgcttattcaaaagtataacttagataattgtagacatgaggcctatgcaataatgcaaggtgataaaaatattggttagtcaaagtcttattgagcttagggtggtagtttccccgttgaggctggtgcagaccccagttttgcacccggtgatctatcggagcagcgcgggtatgcaatttgacccgcaggtagggaagggcattcggtgacaccaagcaattcagtctcggtctaattattgtgagtaagatgaaattgagccaatcatttttttaactggtgttccaaaacaacaaattagataaatgaataggcctagccttagaaatatattatattcacagcctgcttagttgattttagaagcaagaaccaccttaaaggtttatggaaatataatcgatgctcactatatcattcgagtcatgagattttcacatgcattttggggatgattatgctttcatatcttttcacatgcagtgaaggtgattttgcgggactacagatagaggatgatcccactcctagactacttagtcgatatatatctgacacgggactgtatgttactttaatggctacttacaagagcggtgtgttcccctcgtcatacgagattttatttcctgaacaagaagaggaggcatgcaagatggtggaaatagcactgcacgcatatgccaagcaaaaagatatgccggtatggatccacgaaaataacattgatgatacattttggctagacatcctcgaatttctgaatttgtacttttatatctgtataagttttagttttgcctaggctgggtaagagttggaatatttgtttgtggattggaagttggaaatgaatttacctatctggactaatatcattatgtttcagcctgccaagttagaaattatgaaagtgaaagaaaggagtctttttgaagaatgtgggaaagtatatgcacactttaactttctggtgatcaatgattcagatggcactcgtactttgttctttgctgaggtggattttctcaactgcaaagaggagaaggacgtctacctgtgctgtcctttggaagagaatgacaatggtaaataagatttctctttttgtgaaaaattgtagttttcattcatcttgtttaattaaatatgtactaatattaacttattttctttttctttttatataaggttattgttttgggtgccgagtgcagcatataaaacttaggcgtcctacttctgctgactatttgggtggccacaaggatatctgttctgaatatatagatgtagagtattgttttgatgactattgactaatattaatgtacctacttataacagattagtttcagaatcacccgcaagtagaaaggttgtgttgctgaacgttttctcggatgggctttagcaaagcggcatgtaatttatgttctgtgtaggttctactctggaacggtgctacaatattgtgatgtacactgtatgcttttgtataacaattaataactcattaattaacttatagtactataaatcataggtcgatttctaatagttgccgcgagtaccagagcatccaggtgtggacgccaaatgtccagacctggacgctatattcaacgatgtacaatatagcatctggttcgatacgaagaaaagcaaacagcatagttaaaaaaaaaagctattgcggtaaattatgttggttgttaatcagtttttaattttttagaaataaaattattatgggacggaggtagtatagaacgttcccacgagacgcattctctacgtcacgtctgactataaatcctggtttatactaaggtcatatttatttcagcttaggattattataatctgaaacaaacaagtagattataattataaactataagccatattactataatctggtaatctcctctaatgtgttttttttcatattattggatagctaaagccccactacccttaaaagttttatgcaaattacccaacattgtcatcgaacccaacagatcggccacaacgcatttgctttctctcttcctagtcgtgcacgaattcggcgtctcccccggccgcgcgtgcatccgctttctctctccctagtcacgtgtgaatccttccccaagcccgcacccagcgcgtggatccttccctcaaaccctaaccttgcgcgtgaatccttctccaagcccccaccaatgccctggctccttccccaggtcgtcgccgtctcatcctccacctattccacaatagctgagagcattagagcattcacaatgtgcatataaagtgggtggtaagaaataaaatactactactgcccggttgtatacactgtgggagtagtaagcaacaaataccaggtaatatgcttactacctagccataagaaataaacaaataatttctctcctccctctctcatgtctagtggttgtgggacccagcttaccacccacttttgttcatttaatattgtagctacaacaataactaatacccactgaaacaagacctaccattattcacaaagtaggtatttcctccgtttcacaatgtaaatcattttagcattttccacattcatatcgatgttaatgaatctaaacatatatatctatctagattcattaacatcgatatgaatgtgggaaatgatagaatgacttacattgggtaacggagaaagtagtaaacattggtgatgcccttatagacattagctttttaaacctaataatccagagaaacaaataactcatgacttattctactatagcttatccaagggatccccttagttcatcgatcgccttctcaggcctgtatctaggatgcaggtcgttggtctgaccgcttccgaagtaacgattgctttgtggtctccatctggaaggctattttctcgcttccgctgcatttgctgaaacttagtctgtgcccgtttttgggtcttcttcttcttttgctgcctgttgtggttttttttttctggggcgcctgtgcccctttctttgttttcagctcttgtacagtatttggttttggttaatcttattcaggtggggagtctttcccccgtgagcgttcaaaaaaggaaggcctagtttatagtaatttgattcgataatcagattattacaagaatcttaagtcgaaaccgacttaaatgaggggaaagtcaggaggctgaaataacccttgttccggacgaggtaaatatcaaacagtttgggggacacgcaactcctcggcgcggcgccgctcgattcgttccagccctccaccacctccgctgctgctgctcatcccctcgcgatctccgctcttgattcccaactcgcgatctgcgcgcgatttcagtttagggctgattttgtttgccttttgtgaaggaacgagcaatctcgatcgatctcgatgtatatcaggtatgtatgtggcctacttcgatcgattttaggttaaagattgcattgcacgcttcccggattggtgggtggagtaaaacaattatgaatatgatgcttgggagaaacatatgccatagagaaagatgcaaataatttgtaggatgcgtccaagggagtatatccattatacagctttgtgcttttcacttgaagctatttttacattcgaaagtatatctattatatacagctttgtgggtttcacttaaagctattctattcttttagctatntggttgcttctcctttaataatacatgtgaattcttccactggttcctcataagagagggagagagattcatgacccccttgagattatttgcaaagaaaacaaataaggtttcgctagaatatatggaccaaaacaacaaatctgcaaaatgaatagcctagtgttagaaacataatctattcactacctgattttgtttaatagcagcaagaacaccacccttagattatgttttcatattttcacatgcagtgaggacgaattcaacaaactacgtgatgcttttgttgctgcatccaaacgccatatgaggccactcacgttgcctaaagagatggaagtactcaaagggaagcgtgatgtcaagatcgcgaaaatagcactgcacgcttatgctaagcaaaacaatattccggtatggagccacaaaaataatgatgatacattttggctagtcaacctcataaattactaattcagcggtattttgtaagtgttaggcgaaagttggcaaagtttgaatgttcgtttgtggattggaagttggaaatgcaatttacacatctggactgatctcatttatgttgcaggctgctgagttagaatttgtggaattgaaaggaagcagtttttttcatgaaggtaggaaagaataccgacactacaactttttggtgaaatgttcagatggcacaactactttgttctttgctgagacatgtccctgctgcaaagaggacagtggcatttacctgtgctgccctttggaagagaatgacaatggtagcatctatgcttttttgtgaaaacatggcaggataattatattctctttcgtcgtcttctttttttcttcataagacatgcactaatgccttctccttttccccctttttcaggtaaatgctttggttgccaaaagtgtggcgtggaacttaggcatcccacttttgctgactatttcggtggccatagggatatctgtattatattctcagatatagatgatgaagttgcatgttatatttaaggcatccaggatatctgtgctgcagaccgcttatatttaaggctgtgtttagtttacgccaaaattaaaagtttggttaaaattggaacgatgtgacggaaaagttggaagtttgtgtgtaggaaaattttgatgtgatgaaaaagttagaagtttgaagaaaaactttggatctaaacacggtctaaataaaggggctgcaactccacaggacttgggctgtgttcgccatttatggttgccagccggaacagtatccacggaaaacggagcggtccattaacgcgtgattaattaagtattactgtagctattttttttcaaaaatggattaatttgattttttaagcaactttcgtatagaaactttttacaaaaaacgcacccgtttaacagtttgaaaaacgtgttcgcggaaaacgagataggtgggttagaaaaaggggttgcgaacacacccttggtccattcattttatactcgttaaatttatgttatagtattatgtactagttctgttatggaggctatactgtgccatatgtgatgaacacagtaggggaccttatccacctgtatttttaagttcatagtaaaatgtccatgtgttgcaagtgcaaagagcgaatgtaattctaattacgggaatgtaaggggatggcattcgttccgagcggtggaactggaacctacgggatgtgactagctctccaccatgtatgagcgacaagggcgagccaccccctggcgtgcctcgtccgaccaattcgaccggatgcacccattcagtatctaaatagaatgttctctatctggtgatcatatgctacccttgcgcttcaaccaaacacctaaaaaaatgagtggacaacttctaccaaacacctaaaaaaaatgagcggacaactcctatcaagacaaatccgaagtttaaaacgggaagtctattaccatatgattaattaattaagtcttaattattacaaacttgacaatagatatatttgatattttaaaacaactgtatatataaaatttatacataaatcgtaccgttcagtagttgaaaaaacatgctaactaaagataaaatctgtatcttaccgagaaaggtaaaatctgtatcttaccaaaaggtgtagtaatcctgatcggatacacttgaaggaaacctactcaaatgtgggggaaaatcaggcaggaggctgaaataaatacttcttccgaggaaaatatccgtcactcctccgcccgattcgatcccctcctcgccctgccgttctccgtccaaagtgtaagcgaccgagccctagcactgcacgccctcgccgccacatccgctgctgctgctgctgatcccctcgcgccaacgcgattgcccgccccaaacgagttgttgatccccaactcgcccggagccgcggactatatctatctctgcattgcagactgccaacacttactgattgggtttttttttttcgttttgtgaaggaacaagcaatcttgatggatttgaactcggtgccgggcagcgattcggatacttctatcccaaaaattgatgatgacaggtatgtggcctccttcaattttagcttaaagattgcaggctctacgcagctgtgctcgctgtaacctggtccatgatgagattaaagaggcacccaattttgtttgttacacggaataggcgaactcacacaccctgacgagtttcatacccttagcaaacgttctaggctttctagcattcagattcttggaaaattccataatattaaaatattcaatagcttattgaagcgcgcactgtgcgtgcataaatatttgtacaggatttggatttgaaccacagtggctagagtaaaacactgaaagatggaaagactgtgcacgctccaaacatgtgaaaccataattattttagaactttgtggcattcgctgaaatctgatttttctttccctgcctttgtttgcttcttctttaatgatatatatgagtagttctactatttcctcgataaaaactaggaccataagcttccttgaattcctaaaaggaaaaaagttaaggtttttgctcgatgtgtaactagccaattcctccttagcttgaattccatctttcaattggtaagctaagccaagtttttattgtgtaccaaaacaacaaaatagttaaatgaacaggcctagtattagaaatataatctattcactgcatgctttagttgaagtaggagaatagcaagctataggaatgcttctgtttacatttatttatatccacttgcagtgggggagaatatgtgggattacagcccctggacaatcgtgattccactcgatcatcgccatataaaaatgaccaggaactggccgatgcttttattgctgcctgcgaacgctatgctaagcccttcgcagagaaagtggcgattgcctgaagatttggaaaaacgcaaacgacaggatgaatgcaagatgttgaaaataccactacgcatgtatgccaagcaaaaaaatatgccggtatggaaccacgaaattaatggcgatatattttggttcgatcatcaatccaaaaattctaaatctgtcttgttctagaagtgttagttttgcctaggctaattgggcaaagttgaaaattttttttatgggttgggagttggaaatgatttacatatctggactaatatcattatgtttatttcagcctgccgagttagagattatggaactgaaagaatatactctttttgatgaacatgggaaagtatatgcacactacaactttgtggtgaaagattcagatggcactcttacattgttctttgctgaggtggatctcaactgtttctctcttttgtgaacacatgacatgataattttctttcgttggtttaaatatgtactaataactcttcttcttttcctttttaaagttcattgttttgggtgccaagtttgggagttggaacttaggcatcccacttgtgctcaatatttgggtggccacagtgatgtctgctttccatacgtaggtctagatgatgaatatgaatattttatgtaatggatctattattacaagttccttgatggtagtttcagcctttcagggaaaaaaaacacatgagacattcacatcccaagaccatcgctgccttttattttccatctgtttttctttttaagggattctactcgtagtggtcgtgctatgtgttgaaaacagacagatatgagatattaataccactaggagtatgagtgaatgaacttcaaaaatcgattaggtactgcctttgttccataaaaaatcagcctatgttcagattcgaaatattaggatatgtcacatccagtattagcttagttttctatgaggtcgaagggagtagctggctgctacattgaccgacggcgcctgcctcaccaaggcggtggcaagggctgcagagcggaccacggtcgacagcgagacgtttatattgacgctcatttttatgatactaggtgattcctcacgcttcgctacgagaattctcaatatattttgttagtaaaacatcagggtttattagtacttatcatgaagtatatgttaaatattataaaaataatagatatatttgttaaaatattgtgcaaatgatgtgagtgtggttattggatatgcttgcatattgatttatggaattaaataaattgtagataatgttatatgcttacatgagattatatatatatatatatatatatatatatatatatatatatatatatatatatatatatatatatatatatatatatattgctaatagatgatgatgtggcatggttgcatgttgagatttagaattagtgggctgtaactttatagaaagtatagatatcggttcagtgatccagtgactcagttttaagatgtactggcaaaaatgctcatgcgttgcaacaggtaaaaataatttatctattttcattataatgatttttactattaacttgttagatcatagcaagctcaaatataataatagtataaattgactgaatatggtggtttttgcgtggggaagcgatgcgggtgagaaaaaaaatgtgtcctaagcgcactcagttgcgttcttgtgcacgcacgatgctttattaagttggactcggacgaccgcgttatcatgcacacatgacacgcctattttctagtagataaaaaaaaccagcctctacattaataagtggatatacactgttttcaaatgaaaaagttgtttttgacaacgcacccctaaaccacgtccaacgtgaatgatgataggatacactctaccgaagtacctacggagtactcttacatctaaaaagtataaaaccttttattttatcatcaaaattaaggaggaattaactcatccaccatttaacaaaaccaataaactatatgtatgcatgcaaccaatgaattatgatggcttctagggtttagattaacaattaatttagtacataaaaactacaaatatgatcaattttttttagaaaaaaatatgcttaacacttgtttgatgatgggagtacattttaaaaaggctgaaataatccttctccggacactaagaaaagattaggccattggggacattcgttcgtcggttttgttggagtttcaccaatcgtccggagagctaggcccaatacctagacaaccgaggcccagtatgcccttaccggccctccacctacactgctgcatctttttccttgggagcctctgcgcgtgctcttattcagacaaaaaaggaaaatccggcaaaatgatgaatgaagaaactaaccatacgaacgttaagtagtaatatacccatttctaatacatgatgtcgttgatttttgacacatgtttaatcatcatgttattcaaagaattatgtaattatcatttattttcttatgagttattttatgactaaaaactactttaagtatgatttatattttatgtatttgcgcaaaaaaaattaataagacaaatggagtggtcaaaggtatgttcaaaattccacgacgtcatctattgaaaaacaataggagtatttatatagttcatggatttttttcccaatcattgtttgttctcaaattaatgaattacagagtctacggtctaattcccgtggatcggtaatttcggtgcctcaacgtggctggccacggtcatttctttcttttgctagaaaatgaattaattacaccatttacactctttcatctcaacatgctgttcctagctattacggtatcaaaatagaaaaatagatgagtttccttactaatatagcgtagatcgtagaaaaaggcttaaatatgacgcactcaaagtagaaatagatatgggtccaactgtctgaggctagctagcgaaggtgttctgtcacgattccctgttattatcaaatcaggtcatagctaggtccacggtacaatgctttactatgacgctttatactagttttgtgtgcctgtttgcaacaattttctctccaaaatttataaacacgccgatggtagatgtgtttcgtcgtacacgtacacattgatcccgtatgctatttatacattgattgtcttcacacgaaaagaaagaaagaaattaattcaaaagattttgatatcgatgatgttcttgccttcttggccctggatttggacccctccgaaaaattgaagtagatcgatcaaattgcaacgtgatcgcatcccgagcttgccattgccataggaggccttaattggtcagcaaacaactaggcctattctactttgttggattattaccgtagattatttagcccattttttcaaaatatattttctctaaaaaaagttgtttcaaatgtgttgtttagaccaattattctaacctatttattgagtttatttttaaatacttaatttatctatattatcagatagatattagttgtaataatctatggattatactccctgcggttctattataagtttttctttaccttttttctggttaattttttaatctaaccaaatttatagaaaaatttatcaacatctaaaacaccaaattaatttcatgaaatctagcattgaatatattttcataatatatttgttttatattgaaaatgtattattaatttgattaaaaaattaaaacaacttataacaagaatcagagtgactggtatcttttttaaatcggccatacatatagtagcagtagatgctgctgatagtcaatatattccttccatcccatctctccccttctactacagcgaatcaggcatttaacaaagaaactcactgtctcaccaacccacaccacccacgggcccacaccccagatcacagctcacaactgatccgatttatattcgttatgccttaatgcattgttgacgaccctacgctcttgtcattgtgtgacctgtgctcggcaaaatgcgtacatgcagccggtcagaaacttatgataaaaagacagggacagacagagacgctagctctactcaacgccaagattacggtatcgcatcacttcagtatagtatagtgctgacagctagcgatcgaccatactgcatgaacacatagtatattgcaagctaagcacacaaaagcactgtcagtattataattactcggtactacgctttgctttaacaatcgttttattaggatcttaccgaacctgatgactatgcgtctaagccattgcgtttcacggcccccatttaacaaagacggatgagacataaaggcaggggagaaaggaccagggggattcaacgaacagatgaattaataggagttcataggctggggttcatcagatttaacaggagtgtgtaggcttcgccctgaatgtgaccccatgcacgagcccctgtcgacacttgttgtaagccagcacgacgattctttgctttgcagattgatcacaagaaagaagtgatcattatacaaagagtgccatcatcttaaagttttgttgtacctggagatagtggcaatgtggcatcaatagccactcagcctacctcttttgtaatcaggatcttcagatggcaaaccacatcctcctcggctgtgtgttcgctcgacaggtctggcactgtgtgctgtcacctcctggttaggcttaccctctctcccccctgacagctggcttcaggtctggtgtacatcttctagggcctgcttacctgagcatattcgcgccggcttcgactccttggtcctcctggtctcttagcagttgtggaaggaacataacttcagggtttttgactctgcgctctcttcggtctcagttgttatggtgtccatcctctcggagggtcatctatggtttttagctagcattgttatttttggcgtttcttgggaatgtagtatggctctgctcccttcgtgctaatcggagttacgtttagccacagtagtagtttttctctttttctagctgcaatttttgttttgctttttctctcttcccctggcaaaagcctgtctggctaattacattgtggaacaactattttccttctattgacgtgcaatctttttgcatgttcgtgaaaaaggatagtgcatgtatttttttttttattatcgttttctgtatgattgaaaaccacatgatggggaaaatgaaggaattataggattgtgcatgcaaaagatatcatgtattataaacgttggaagaaaggagggttttgatatagctaatttgctcaagtttttgctatttaattggattcggagccatgtagcttagacttctgaaaggaagagaaaagaggtacgggcaaatagttaaatagcttattgacttgtgataattattcaacagtacaaataaatgagttaattataaagttcaaaacggatttaaaaccatttcttaagaaattcatataaagttttcacagaattgtaaagtttaggagctcaagaagcatgtgtaattgcattcatccattcattcgttaagcagaagagaaatcctgtgtaggaaaaaaattacactatttttcctttgctcgatcgtcctcccatacagggttgtatcaaaatttcccaaggacaaatagtagcgtatcgtaagcaacacaaataattctcacttttcctgaaagaaatactgtaccaagaaaagttggcagatgactgtacaggactcaatgagagattgtcgaaaacagttttgcaaaggtgttgtctcatccagagtgtgtttccatgatcagccaagctacagcatactttaaagtcgaaacctcgatccaggcaggcatgatgccccgctcacaatcgaatccaatgatacacaaagaagccccttttcttctgggacaagaatttatcgagtggtgcatggggacgagatggtcataatttagagagacttatcaattgatgaagggcagacagctatgatgttgtctactactatctgctacatgctcacagattatgcctggcctagattttcatgtagtatgatgtgattcttctaacaaaaatattttggaggtacccattataaatctagggtctgaaatctctacaaaagaactaaagaaattccttcttacaagaacaatattggagtggacggccacaacttgatttcctaagtacacccaactttgattggcaaagatagggaatatctcatgtagctgtaggagtagtttgcaggtacagtacaatgccacccaaccaaccaaagtaatatcttaatcaaatcaccaccaacatcagtacagtctttccctctcttaatataaaaccagcggtagatggcttaggtttcaaaaagaaaaaaaatcaccaccaacacacacctcaatactgcatcgcattgagctaacatattattgctactattcagtaggagaaatctgatggctgatttggtccccaaagtaggagttaataattaattaattaacggatttggttactactatttggtttggtggcgtacgtgaggccaaccaaaccggagggaaggtgatgacaaaaaggctccggtgatccgtcaggccaccgctgtctccgtgtcctgcatcacacctcacaaacacacgatccatgtcacaacagcagccttccgtggaacgcaagggtagtaggagtactgtattatttagggttaagtccctacactaacctaagccctgttggaatagtggatgggagtcgctgacaggtggggtccaggttgccttttgaatcggattccaggtgtaaagcgaggatagaaaactgcaggatttggcccaccagatagatcccatctaaaccactaactcctgtctgagagctgaaataagtaatgcatcttgcaaaaattagctgtatatcaaacaaactgatcttggaagagcatattttcttagcatactgttacttttttactcctacctgattgtttaacttgtagacttatctggaatattgttaagcacaaggcagagtacacaacactacactgtgtatagaacgtgtaggcagaaacagatattgcaagttctttttttccttaaaactagtgctctctgaaaatcggaggtgaggtatagcatctctctctcggatggacaggtaacaaactatcaatcgcccctgcagattgtcgctgggcaattaaagtctgtgtcgtattgggcatctagcaaagtagcactcaatcgccatctcaatatttgacatgtaacacgcgctcctctttttggcttttcctcagcaagggccttagaaacaaaaatgtcaatattatccaaagttttaaatctctggctatagctgccgctatagccggagatagctgctgggaacggacggagctaaaagatgcagtttttagcgctaagaatagcgggacgctaatagcgccatttagccggcaatagccgctaaactggccgtaatttagcgtagctaaattgtaaaacacggccggtctggcccaagaggaaaccggcccaactagaccagagtcgagaggtgggtaaagtgctgcaaaccctagctcgtaagctcccagcagcacactatccattccaacttcgaagcgctcactctccagctgcaagaaaagtggaggtggccggcggcggcggcgcaaaggcgtccggcggcggcggtggcttcaagcggatcgaccaacgcaggtggctcgtggaggcgaccggcgccggctgctgcttcgagcgggcgtccaaccagcggcggcggctttgaaggcagctgagcagcggcgcaagtccgacgaggaggtccgtcagtgcaacgtctccgaagcactgaagcagcagcaccaaaggtgacggcatggcacaacaatccggtcagttctcacatcctcctctcttttttgcttgtatgttgcagatcttacaatatgtgaacaagttgtccatatttgttacctctaatttcagatacttgccttatgatgtagatcttactatatgtgaattattttcttactccctgagatctctcgtttgcttgtttcgcctgtttaggtggtaatgataatacgtgctatatcagtttgcattattttgatgcttaggcagctttgacgctagcattaatgtgggctaagtttgctttttgtataggtaatccgtccagtgctgcctctgtctcagtagaagctggaccaaaacaagctggtatcaactcagatgatcctgcatgggctcactgtttctgcccagacataaccaagaaacatcacctacggtgcaagtattgtgacaaggtctgcactgctggaattacaagaattaagtaccatcttgctggaattaaaggtttcaatactactaagtgtcagaaagttccaagtccagtgcagcaagagatgtttgatttgcttaccaagaagactagtaaaaaggaacagaaaaccaaagaaaaggaagtggccagagctgaagttgacatagaaaattcagattgtgaaagtggcagtgaaggttcagatcatggcaataatgttcttgtggtgaagccaaaggagacaacaggatctagtagctctagatctgtagcaggtggtcatactattgacaagtactacaagcctccttctatagaagaatctgccagtatgacacaaagagtaattaagctaagcaataaggttcaaacagcattgacaactcagaaaagagaagaggaggaatagaacttgtgagtacatatgtcagtggttctatgaagctagtattccacacaacacagtaacccttcctagctttgctcatatgttagaggccattggacaatttggtagaagtctgaaagggcctagtccctatgagatgagtggatcgttcttacagaaaaggaaggaaaaggtgatggatggattcaaggagcacaaggaatcatgggagctcacaggttgttctatcatgacagatgcatggacagataggaagggtaggggagtgatgaatttagttgtgcatagtgctcatggggtactcttcttagattcagtggaatgctcaggtgacaggaaagatggcaaatatatctttgaacttgtggacaggtacatagaagagataggggaacaacatgttgtccaagtggtgactgataatgctagcgtcaacacaactgcagcaagtctattgacagcaaaaagaccatcaatattttggaatggatgtgctgctcattgcttggatctcatgctcgaggatattgggaagcttggaccagttgaggaaaccattgctaatgcaagacaagtgactgttttcttgtatgctcatactagggtgttggatttgatgagaaagtttcttaacagagacttggttcgctctggggttacacgatttgccacagcttatttgaatctaaaaagcttgttagccaacaaaaaaagagttagtaagactatttaaatcagatgagatggagcaattgggttacttgaagcaggccaagggaaagaaagccagcaaagtgatcagatctgaaaccttttggaaaaatgttgacattgcagttaattactttgagccattggctaacgtgttgagaagaatggacagcgatgtaccatcaatgggattcttccatggtttaatgcttgaggcgaagaaagaaatttctcagagattcgataatgataagagccgcttcatagaagtttgggatatcattgataaaagatgggacaacaagctcaagactccactacacctggctgggtactatttgaacccctactactactacccaaataagcaagagatcgagagtgatggatcatttagagcaggtgtgatttcctgtattgataagttggttgatgatgaagatatccaagacaaaataattgaagaactcaacttgtatcaagatcagcatgggagttttggacacgaaattgccgtaaggcagcgaaagaacaaaaatttcaatccaggttcagatctcaacatgtgaacttaattttattgctgaatatcatttttgttgtaatttgtgtaatgtttatgcaacaaaatggtggctgaaccatggcacaagcacaccaaatcttaggaagttggctgcaaggattttgagtttgacctgcagctcctcagcttgtgagaggaactggtcagtttttgaacaggtaaaaagaaatttgtgacctgtagctttatgtgcatgctgtctattttgaattataatgcttatttatggaatttagatctgacctgcagctttgtgttcactacttggcttataggttcatacaaagaagcgcaacaggctacttcatgaaaggatgcgagatctggtgtttgttaaatttaactccaagttaagaaataagagagagaacaagggtagagatcctatagagaaggaagtggatgatgttgtggcagatggtgacaatgaattcattactggtgttgtgccttcatcaagtgaaatggatcaacaatgtgcaaaagagtcagcaccagctaaaaggaaaaggcctgtgcacgctaagaagaggaaagtcagaagcctacagtctttgatgcgcaatgccccagtgcatcttgaagctccatcatccgactcagaagattgtgatgatggtattccaatgcagactctgattctgataagtcaccctctccctctccctatgtctctgagaccgatgattgatgactagaagaaatgaagattgcaatattgcctcatattagtaatttagtatccactatccagaattcttgatgacctttgtgtcggactgttgtctttattccagaatgttgcacttttgtgaaactgatgtttcagtattctgttaaccacttagcttgggatgtaatgtactcctatgaacctgtaatgtactcatttgaactggttatgtatcaattggtaatggttatgaagttatgccaagatcatgtcttttatttatttatttatttgcaaaaacagctaaatggcttagctgcagctatctccagctatagctgtgcttagctgttgagaaggtcagcagctaagaggcttagccggagatttaaaactttgatattatctcaaaccaatttatttatttatttttcttttcaaaggaaagatttctattgcctagtattacacgattccatccatggtagtggtgtcaatctttttcatcggtgtgcccccacaggattcattgtactactacttaccattagtccattattattaccacagggattaaccacacagccattaatcagagttaggtccagcaattgtaacttgcttgcagctattgtctactgccactttttctgcactggaaagcggtggcgcacttgccgaaagtccattctacttgagaaatggcatgtggtgggctgctgtggtgccgtagctagcgtgctgcgctcattccacaaagcaaagcaaagcgaaggaaaacaaagggaagagaagactgaagaagaagagagggagagtaaagctgatagcctgatactgaccaggaattggattaggctagctaacagcgcaagaaaagcctccgattcctttcgtcgtcgccggattgccgaaaggatggacagctcaaggttgcgggtcccaacgcctgttcacatggtcaagaacatgttctgagtaatctgttggctcttcttgtatgtgacttgctgagtgagagagaggagaggaggggagaaagagagggccggttgctggagcttctcttcatgatctctgcattcccaggtaggttttgcatgaagccctgctcttggatgtgcttcttgttggttttgtactgtaaggctgttttgtttctgctttgtttgaaacctttgaaagtttggagttctgttttaatccatgaagtggggagtttgatgagctcccatgcttggaaaggggggaaacttatgaaatattatgcacctaattgtttggattagttggattggttgtacagaaatttaactgaaactttcggtttcttttttcttttttgacatcaggtttctctttaccatggttctgtattgattattcagtcaagcattcaggggttctccctagtccttaccatgttttcttttaattaattggattggtttaacagcttgtacaaacgattagcttttttaatataagaaaaacaagaacagtacattgataccttggatggcaggtttccatggccagccatctcccttatgctgctgaacaaagcacagttcttctgttttggcttctccagagatatttgccattttccatcaatatatgtccggttgctgatcttgatctgcatgcagtgtttctgaaatccggctagcggtgaactccctgatgaactgaacaatcaatagaagatacaagaaaagttatttccactacagaaagaacgctgattatctgaaatgggaaggcgaagccacaagcggtccactgaacaagaggaaaacaatgtaggctgcgtgtggggcctcatgcgcatgctttatttccggcgtgatgcaaaattcttattggatacaaagcaagtgagcaggaggcatacgttccgggagctggcaggtaatttcttcagtaatcatagttgctatgaagttgtagtttcttatagcagtacggaaaaagctacgtgttttgcttcaagtttctattacttcaaaaaatgctgtcatttgacccaatgctcactatcttttcaataaaaacaagaaaaaaaatgctaatgttatcaaaattt

SEQ ID NO: 15355 - DNA, 7519 bp, Oryza sativa
catcaaagaagacacccaagaaggtaactttagtattcacaattatcatcagagtggtctgcgtagtgctcttttgttctttaaatagaaataactctgaatattgagcaggtatcatatatgctactgatgaggtagacaccgtgcctgttgaaggagttggcaaattggattgttccaaaacaatttgcaacatacagtgcatcccagcagaacaatacacagacagccccttgccagtaagctcaaatgaatgcctagccttattccatcttttgttagtgtattttaagatgtacatgttcatacttctatttataggaaatattagaaggaactgaaggaaaagaacctgttcaaatgttcatgagctctcctgagagcatggttgaaaatttggagcaacaagatccaaaaacacctgaaccaaaatcatcaccaaaattaccagatggttgtcctgagcaaagcaatgagaagaaagaacagccaagtcctgtatcggttcttgattcattcgatgaagatgacagctctcctgaatgcaaaacaatgaaaaaatgtaagtccaattaatacaattgtttgcaagaacaatggtttaaattagtttatcttctttccctgcacagataaaaaatattatgtactctagtatctgtattactcaccattttatgacatacagatgagctgcacgaagtttcctgtgggaccctgtacttcccagataatgaatcaggtgtaaaggtcttttgggaggataagaatgccaggttagattatataatgctggtgctagagctctcagaattatgtgcagagcaaaatttagaggtgtggtatctagaggatgaattaatcagcccttgcatgttcgaagaactacagaatcaaggggaccgaatagatgatatgaagattttgtttgattgcatctgtgaagcactaacagagatccaagagagatattttagactctcttcttggttatcttttgtcaaacatgacatacggacacctccggtaggagaaaaactcatctcagaagttgacaaatatgttgatggttatctcaagtgtagtttcccaagtacattggaacagataattaaaagggatttggaggttcaggcatggatggacattagatcaaagacagaaggaattgtcgtggagatatgggagtttgtgttagatgaattgatagatgaggcggtttttgatttgtggatttgaagttctgatcagatcccttatcagtgttgctttgtgacgagtataggcagtatgtagatgaactgtagaggttttgattttgatgctgacaataacccattttatgcggaagaataacaagggcactatgttctggcggcccaaggaaagtatcatgtgattggggagacatttactggtccaaatgtctgactggagtggacagtttcttgtgaatgacagctgaagttacaatgctgtgaatatctgacttgttcagtttgtttggatgaaattggccagtctgtaacagccatgcctctaggcacccaggcatacagcagtccgaatttttctcttgtccattgtgtgcatgtttgtgaaccttaccccgatacgcttgtcaacaaagagggctagatcacttcaatgtacatgtttgtatttgtaagtacatgtgtaaaaggctttctaaacaaatcacacaatatacatttccactgaggttttttcttttcctgaacaacactcagtaagcttacagttttcatgcattcagttatttgaattatgcttcaaaatacatgtaaacctccaagaagcatgagcatgccaaatccaaacagcacaaataacagaatcacttgcgcgctaaatttgtgcaactgaaaggatgagaaataagcatccctactaaatcaattgccaacatgcacaccaaccggtaaaacaagtagatccaaaatccaactcctaatgtgagtgaaagtgcaaactacattagttgcaacgcggctcagctgtcaaaaccacccaatccagaagttccgggaggcgggagcttgggattaaccagttcactacacaccacccaagcactcggcagtcggcacaggacgcagttcatccgttgttcaaaattccagacaccgtgagatccccatgtatgccgcattgggtttaaactgcccccaaacccaacaacccagcaaaaaataaaataaaataaaatgaagcgattcaaattattcctacaaaatggaccaatcggtgcttaattcgaaaaaattgataatttgacactttcttcgttgtccaattactttaattgacatttgtgaggataatatatgggaccatctgagtgaatgaaagtgggctaggatgtcaaataatagaaacccattgaaaagagtgttaaattatcaaatctctcgcgtaattcacccaaattttacgcattcgaacggcaaatcggtcactccaaacaccaatccctccctccaatcggcacgtacgagggcagccgcagctactactcccaaatgccgctgccgattttcgacatccccaaccgaataaaccccgaaaagagaacgcggattcattgggattttggggatcgatccactcacctagtcggctggtctgcagctggaggctggagcggactcctctcctcggtgggcgacgagacgaacacgatcctctcactttgtccgccatggttggttcgtcgagagcgcgagaacgaaaatggtggagcgaaaaaatggcggagaagaggttaataattaataaagctggcggattctgcggcaagatgggcctaaaccactagccctgccggatatttatgggcttgtgaggatgggctactgggcctattttattttcagtctgctgcaagatgggcctaaaccactagtcactggacctctcgcgttcgcagttgtgcttgtgcaaaacagcaacaggcttttcttcttcttcttcttttcttaaaaaaaaaactgcagttaacaaggtactccctccattccagaatatatgaagttttatagttagacacggttattaagaaattaggtagaattaaatggtggagggttgtgattgaatgagtaatggaggtatgtgggaaaagtgaatggtggaaggttgtgattggttgggaatagaatgttggtggataagttgttatattttgggacaaacccagagggctaaaagttgttatattttaggaaggatggagtaagagtctgagagatttgaaatgtccctagcaaaaaaaaatgtcctaagagattaaaagtatgggcacttcaaattattttgatcattatgtaatctattcaacaaattcacaaggagttagcaaagatgaaagatataaggatatattagattaccaaagtcgaaagaaaagggagttagcatgttgcactttaaataaaaaaattgacgatgttgagctctttttatatatagagagagcacattacaaatgtgtaatgagggatgcaattccactctcatatgcgccacgtgaaagttgccatcatgacatacttatcatatctaatgggacgattgtcaaggtgagtcatcaaccttagaaatgttttaacatgaacggtgcgcttgatgacggagaagcttggcttagcatgatgagagggtgtcaatatgagtcaccggtagaggatatggcaaacgtgaacgatgcatatgacgtcagagcaacatatatgatagcaggcgacaatacatgcttagcactagcaacaacaataaatacacccctccttggtcccttgaggtatctatcttcctctctctctctctcactgtcactccatcttctattcgctattcatctcaaatttctcgcatcagttcctctttctctcctctggtacatcgtcaaagcctcttccaccaagatgtctgactaaaaggtatagtttttcaagccctctactccgtaattgaaccgaaatagattggagatctatccgaactcatattggtttctcttagaggagacaggcttttgcttttaatctaatttctcaagtttgttgcattgatccatctagtttgttattgatgctgttaagattcatatgaacttggattggtttatctttttttatggatttttccttttctccatgttatttttaccctggcaatcgctaatctttaagcttgtttccaatggtgttgagatctatccaaaatagtattgatttcttgttttgacggttgacttttcgcttacttcctactactttcttattgagttggttcctatagatctataatcttggtttggtgtgtacgctataaagatccccacaaacttggattagtttatctattgataacaagcatttcactttctcacatctatttacaacacggttgctccaatctatctagattgttgtgtgtgctatagagacccacatgaattgaaactagtttgttgtgcgtgctacggagatccatgtgaattcaaacgggcctctctctcgttgcgtgatagactcttcatttttctcaatatctctacgccaactattatactttactaatttgtttttagcccaaagcacctaatacaaacaaataaagaaaacaagaaaacaaaaccaagacgtgtaaaggggccattttttgtcaaataaataacccaaaaagaaaccaatttaaaatcaattatcacaatttcaaagagattggatttttgtttctctccactccaatacctctctccatctcccttgtgcgttttccgatcggcagtgccggaggcacacgcccccgcccttttttgtttccgccgccgccgccgccttcgccgccggcgagtaggcccggagtcacggcgagaaaaccggctcgccctcttctttccgcccgcgccgcccgcccgcccgccctagccgcctcctccccaccctgtgcggcctcgtcgcgcgcgccgccggcgaacaggttcggagggggcggcgcggcgcggcgcgggcctcggctcgaatcggattcaaggtcattctcctcctcctcctcctccttccttcctcttcgcccgcaacgcttccatgaagcgggcgtggatggaatggagatcaatccgacatggattgatttcttcgccctccattccaaacacagcacatgcagttctcttcccccggattgcttcgatgcttggagttactaataccaatttgtttttattttcttttaataaaaatgggagttcagttgggacaggcatggcctgcgttagctctgtcgccatggctgggccagtgttgtggtgattgcgagggaagatgcaaaggtacacgggcgctgggcacaatgctgggtttggcggcggcgtgccaggcaggggggtggtggcaggagggagggagaagggcaggctggagccttcttcgttccatggtgccaattaccccgcgaacttgaggtggttgctgtttttcttcccctctcaagttgtcttgtttccaatgcattcggctttgtagactgtgatatttgctgatagtgattgctgtgaagttattaactcgttacggtagaagaaacgatgatgtgacgataatgtggcaacgttagcaaccagtaggtgaccacgccaatggttactgtgatttgtcgttactcgtgatgacctaacctgaagaaagccatctcatatcaagaagacaagaacttcatactgatatttttttaagtatattattcagtaatactttggccactgccatgtagtctgttacaaaaccttgttcttacagaagttaaaaggaacatctcaaaatataaaaaggaattcagaaaaccaatagcaaacttttggaccattgttgttgcttcaaaagtcttgccagtgttcatcctggtgaatttattgactgttcagtgtttggtcagtttaacagctcaactgttggtttaatgaaaagatggaaaaatgatacttgattgttatttggtagaaacagtcacaattttcctggtatgaataagtagttaattcaagctcattgtcccagtttcgaaacccatgttgcatgtaaaccctttgatgtgatttgtgaagtagtcggtccaattgattccttcaatacagtggtggatccagaaattttcttgagcctgagcatgcttaggctgtgtttgagatgacatctatgatgagattatggtccacatgcaaaacgagacgagtgattagggtatggttaattaggtattaattatccatagttttaaaaaaatataacaaagcagaagagagatagtgacctctgacaataatctatcagcatcaggagtccaataacatgttctgcttgtttgccatttttttctacctgtcttaaactagtgcacaattaaaagcctgctttggtgctcaaatagtcgtgcaggacaccatactaactacaaactgcaccgtatagaagcatgacgcctggtgccgtttgttgcccgggagcaaatgccattggctagcagaggaacagcaccgaagtccattgcggcaaagactgggagcccgggcagctgcccatgctggctgggccctgaatccgccgctgcttcaatatatcatgaaactagctcatcgaattgtattttcaccagttcagagttgcttacttgcttcgattatcttgtgtccaacttggatgagtcactgtctgctgatcaggtccatttttaaaattatggcactagagatggttgtgttctgaacaaaaattcaatcaaaatcagtcgcagtctactctagtgggatttgtcctttgaatcagatggacatttttttaattcaaaaactagatgaatatcataaaaattgcctttttaatttttatggtgtgatatcatttgaaaacgtatcactgttagttatggtaaatgaaagagaaaacattttgttctttagtaggtcaaacaatcttcactgtacagtgctcttttttatggttgttactccctccatcacattttgatcatcctctaagtaaatgacaccaagaccaaagacaccaaaatattcatcattctcaaattaatcctcatcgattaaagtgtttcatcgcttcgtgtcccgtggattgctcatgttttaaatattgcatgccattgcaccaatagaaattaatcttggttggttgcatgtaacacattcaacgatgcacatgtactctttgcacaaataaacaaaaagacacttgttagatgatgatcattttaggaagacttcaaaaactttaggaaatgatcaaaatgggatggagggagtactttttaccttattctggctgatggaggcttcttactagcagtttgagaggtcggcaaacggaacagacaaaaaacctgtttgcataatgtaactatcagcttatacctattgatcaatagataatgctttttccatgagggtaactccccacgttccattatcaaagataacaaa

SEQ ID NO: 15356 - DNA, 1613 bp, Oryza sativa
ttattttctctctttcaggaagaatgggggtattagttgtaggagtagcactttcaaatgtatgatcttccacatttaatttttttcaaaggacttttctacattttgttcagactaaggttctacctatgtttgttaagacattaacttagtgctgactgatgagcatatgaacctcctaatatgcttatgattctatttttcaggcggcaaccactggtagctccttacaagctgaagtgtgacaaggaatcactcaatgccaggcatgttttactcaacaactgatttgttcctattgtcttattgactatgtacataaatgttttccattttctcatatctagcttttctattcttcaatattcttacttttttttcatttgcatggagaagttgcatatttgtattcgaaaacaactaaaagttagtgtttcctttgtactatggattttgtaggcttggtgcacctgacttctatccccagacattgagttgtgcagaagagaccttaaccaaagaatatgtgcaatctgggtacaaggataccgttgaaggaattgaggtgtgctccagaaaccaaaagtttcaaatcctatcccttttttgtgacactgcttatctagggttaatcttgtttcatatattgtttgtctcattttcacgagtctcatgccattaaaatcttgagtccataattttgtgtacattaggaccgcaatttctttgttttgttttgactgaaatttgttcctggtggtgtttttacaggaagccagagagattgtactcagtcagattccatacttgagcaaaccagatattgctacaaaatgcaaggaggtaaaaaggcaaccaacatcaacctaactagctttatttttcatgcaatcttatgttgttagaacatttcttcctgtcagagtgaagtgagaagtaggttggtatgcggcatgattgaatgctgctggagatcaggaactaagatgggtagaattatgggaatcacatcttttatatataagctgagatatgcatcacagggggttaacagccaaaactctacagcctacttggtgctaattttggataattgccacctttggattgttactggctgcatagtctgtcagaaacttaggattaatattatgtgaatacgtagatccatatggaagatgctgaagaattgcttcttttccctaaggttgatggattgaactgaatggttgaatggattgaatctaatatttttcttccccctttgacctacccgattattgtgttttccttctctaactgatatgtcttgtgaaaaaacttatactttgactaacaattttattttttatttatcaaggcactaaagaagcggttcagagcgatcaatgaatctcgtgctcagaagaggaaggtattttgatttgttgtagttactatgattaggatctctgctgtaaataaggatattttttgttaaaccatttcacaacttcaaaatgtttgtattgaaaatttgacaaatggggacttaactgcattaattagatttttaccacctaattctagatagctagcatctatttacatttttcctgcaaaactttgatctt

SEQ ID NO: 15357 - DNA, 2187 bp, Oryza sativa
tggctgtgtaattcattcctttgcaggcccttgtgcaaccaaacaggcgtctatggtcattagcagagcaagttcctcgtggttttcggaggaagttactctttaattatcttatccgatataatgtcccactgttaagagcatcatggcttgtgaaggttacttaccttaatcaggtccgttatttctgtgccaaactgccactgctcactagaatttagttctgttatttcatgcttattagaaaattatatgatgttcgcttgatgatgcctctttaattgcaggttcaaacatcatccaataatgtttcatctgctgctcctgatagtttgcgatctcagcactggacaaaggatgttattgaatacttgcagctgcttttggacgaattgtgttctaaaaatggcttttttggacttccatcttctcaagaacagtcattgccatgccttgttgctggagacagcccaattaagttaaaaaccggggcatcacctgctagtgcagatgttgaggagccttcgctacactttaaatggtcgtatatgattcgtattgttcaatgtcatctcatggaacaattacttgttccgtcgttacttatcgaatgggtatttaatcagctccaggtacagagtgcattgataaagtaggttcatgcttagtgatgtttctcaagtgctatgttgatcttctaataccaattttttttctaacccacttcctttcaggagagagactcaactgaggttttagaattactcttgcctattgtactttctttggttgataccataaccctctcacagacatatatccacatgctggtggaaatattaattaaaggtctcagtgatctttctcgtgccagtttaattgttaagaatagcccaaaaaggtcatccattacctctgcttaagttgagttactcaagaacttaatacttgctgttcccaatacatttgtttctttggattgcttcacacttccatcagttgtggctcgtgatgtatacggtaaaggtgctcttctgaaaatagcaggtggtggtaaaattgctagctctaggagacagaatgcatctcgacacctctcttgtggttatgccatttgttcagttcaaagacgtgcatctgatctttctttagttgctaatcctaatcttcaagttcgtggggcagccaacgtagtgcaagctttggacaaagcacttgtaactggaaacttgacagcagcatatacatcaggattcaattatctatcagataccctgatgtaagaaacatggattaaagaagtcagcccttgcttgcgatcttctctgatgtggatgggagctgttgagttatcccttgtctgctctgtgtttttcatttgtgagtgggcaacatgtactttccgtgattgccgtacatcacaatgccaaaatgtaaaattttcaggaagcaaagatttctctcaggtctatatggcagtttccctgtgaaggataaaatgaatgagataaataatttatcttcttccaagagcagcagtcagcttgcaatgaaggatcaccttaaaagtgctactctgaatcattcttctatcaaggtgacagcaatggagactgcttctggatttagagacagtacaggtagcattgatgagaataacaaaaaggatatcttcagcagcccaggtccactgcatgacattattgtatgctggttggatcaacatgagattagtgatgcttcgggatttaaaagtgtggatgttttcatgactgaacttattcgcagtggtatattttatcctcagacatatgtgagacaactaattgttagtggaatcaccatttggaatgatagcttgtttgatctggaaaagaaaacgaggcattacaaaattctgaagcacctgccagggttttgcttatttaatatccttgaggaagctaagattgctgaagatcaagtcctttatgaaattgtgtcaacatattctagtgagcgtcgacttgtgctttttgagctttcaagtggtctggctactgatgcaaatgttgaaggcagggtccctttgagttcctgccttcagaaacagcctgatcttctaatggattcaacagatgataatcatggcagagtggcagttcaagtagaagaggtaaaacttatgatatcaggtctgttgaattt

SEQ ID NO: 15358 - DNA, 32572 bp, Oryza sativa
  unsure (1)..(32572): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagatgccctgaaaggtctgtctaacagaacttgtactatcagccataaacagctttgccttgatgattgtggctgtcatgtgcctgctatatatcttccatgaacagattggattaattggtgcaattaagtcttacatttgttgattgtatgcacaatttaaaccagtgacgctccttcgatccgtgatctgcaaattttcacttgtaaattaactggtaattttgaagaaaatcctgaataacctcagattctaagattcgaacgtgtggcttttaccagaattggccaagctaattctgtttcgaaagcaggatcgggaattttatgttttgttcttgtataatttctttgagatccgaagcaattgtttaatggatgttcgtcgaaagcattcacatctgcatataagtttgacattgatgaaactacacgagcaagataacccatgcattgcagttaagcactacagaaatggtaccttcagacttaattcagtacatctgtatagataaataatattctcaggccctgtttagttcacaaaaataaaaatttttggatatcacatcggatgttttaccggatgtcgaaagggttttccggacacgaatgaaaaaactaatttcataactcgcgtgaaaaccacaagaagaatcttttgagcctaattaagccgtcattagcacatatgggttactgtagcactcatagctaatcatgaactaattaggcttaaaagattagcacttatagtttttgtttttatctatatttaatgcttcatacatgtgtcaaagattcgagaggtttttacctgtgtgccattaaaatagatgacccctgcctctatgccactaaaaagttcgagccaccctctatgccattgtcgaactttatcgcgcccttcacaccattccgtctatttttggctctaacggtgtcaaacaacgcagccaaatgacattgttgcccttaggcttgagagagaagagagaatagagaagagagaagagagaagagagagaaggaaagagagatagagagagagccgagacggcggccgcagatgccacggcccccatggcggtgagctggagggcttccggcgcctgtccggcctcgccttcgacgagctctcccggcgggaccactctcctccgcctccggcccgccacctatcgacctccccacgctcctccgcctctgctttgccgccgcgcccctccttcttcctccgggcttgtcccgcacgccgcagctcctcggctggccgccgcgccgccgagcgctaccccgcccctcggctttcccgccacgcccctccttcctcttcctcctcctcctcctcctccgccgccaccgccgctgccgccgccaccgggcttgtcccgcacgccgcggcgccgccgagcgctgcctcggctggccgccgcgctagtcgcctgcctcatcgccggcctagccgcaccggctggcctctctttacaaggaagcagacactggaagggcaagagcgacattttttgtgcccaggcccacatgtcagaggtgccaaacagttgaatccactcagaatagcgacggaatggcgtggagggcgcgataaagttcgacgatggcatagagggaggctcgaacttttagtgccattgaggcaggggtcatcttttttaatggcacacaggtaaaacctcaagattcgatgtgacgttttgaggaaagaaaatttgggaactaaaccaggcctaagagtgttcttggaaaaagcatttctgtgccaggtagatatattaaaagttgtactaaaattgtattaatttcccctaggcttccagctatttaagcaacaaagcaacgaaaatgacaatgaagtacaacattgtggacaaaccgttgtgcataagctctatttctctgaaaacaatcacgccccttttctatcattttgcccaactacaaatcatcctatattttaaaacaatatcttaaaagcttaaatatagcaaacagccattcggccattccctcgtcttcatttcattccttcaattcctagtcatgcgatgctactaattttcacaatcagttcccatggccgaaacaaccattcccaaaagtttagctctggttgcactcaattaatcagtgtgaaacattttacaaaagccaagcatatatattttcttcacttgttaggagtgggtgtcatcagggagcagcgctagagcatatagaaaaggatgaatacaaaagggtaagaagggctatagtcagcaataacaggcgaccgtataagcctaccaagaggcaataagaacagactagattttgaacgaagaggacgatgctgattgcaaaatactccattaatttcaatctaattacatctgtatcttcctgctgtgtgagagcagagatgcacaaacttgaaataattttccaggataataccacataacgcaaaaactaagtattgttggtttcctgaaataatattattgaaagttgcaatagcagaacaattgcaaggcaagatcatgaggcgctgttttaatcctcaacctctgctaccgttgtgctcagttctctcgatggtcaccactttaatccattactacctttacggtggtttcaattaatttcttatagagcataccacaagtattatcaccagtaaaagtgatctaattcattgatttataagatctagtagataacgtgatagtataaattaatagacatattccatttaattagaaaaataaaatgccaatattattctagtacgaagagattaatcgtaaaaattagttgtttcatttctcccttcttgcaacttaagtcaatttttttactagcctctaattaacaaacatgcttaccacagaatgaatcatgctatgtttgaagaccatctcacacacactccccagtgtacgtagtttcggcattttcaagcatccaagaagaaaataaatagtggtcaaccacctcaacagtagtatacaaaattgagcacattaaaagatcattagaagtgatgatatgaaaattgatttaatttcctttggatgaaaatgaccccaaactaaacctctcagtatataaagcatcgatcgtcccacgagtcgatcaatatttgtacatccagtgaagactaccaaaatagaagtacgacttccaaaacgaagataaataaagcatgttttccagtatgatgacctttcagcattaaattgattattgtgttattattgttggtatgctggtctgcatgcatgactcatcaaaatagaagggtctatccaggattaaattacgattgggaggagttgggaaatacttggtgtcttggtgatgggggtgccgaaagtggtgttccataggtaaaatcaaagttgtttttgattattattgtatgatgaacaattgggcattggagattattggttttgttatttggaatttattcacgaagtggttttggagatgattggatttacaggtgaatcgcaggtttattatttcatgtggaccggtcagaccgggccggtgcggccggtcagaccggcgcagcccgcggtctgaccggccgacgctgtgtcggtttcggtttcaggttgtttatttggatatccgtgattatttcatgattatggcttctagatggatactgttgttcgctaacaataagtaaagttggagatagcttggtctcagaatatggtttctttgtttgtttcatgtgtatgtgagtcgatgcctcgggagagtatttgcggtgatggaccgggagtcgacttggggataagacgacgtccgtggtggtcagagatcatgcgggatacttaggctagagttgatacacgtggttgatggagattccatatggcatacgatggagttattgtgtgcgtatgggatgcggaatcgaatttggaaggagtccaaatttggtacgattggttatgtaaagtttctttctggtactagagggtttccaaaggtgtttaggactcctagtatgagtttggttcgtggctttaggctgcctacctcgagtataaatagagggggagcgtgaggcttcccggtatcgcttttgagagcaattgagttgagttttgagttagggtttcgagtttagtcgaaatttttgtaaggagtgctgtttgtgtactttctaaacatagagagaagtaataaagttgtcatccactttaagagttcttcgatttgtgtttcaccgggtttcggcggtccaaccggcgatataccggcggttagaccggtggcaaggcggcggtcagaccggcgggagtgaggcggtcagaccggcggcatccactcggtcagaccggcagatcaatctcggtcagaccgatctccgttgatttcgagggtaacttttatttctgctaaaagttttaggtttttgggtatatcaacttgtcacaccctaaaaatcctagatatataaattgttgtttaattggaattattagaatttattttaaaagcctagaagagaagatctagttttaattaataaattccaatataaaatggggccagataaaatttcatgaaatactttgcttaattctataattccgagatttttctgggatttatttgagctaagaaagtatttttaataaatggaattgcatttcatgaataatttaaattgacaaaggtttttaaaagtcttcttttggctttgggccgaaagtcggcccaaaacctctctctctccctcggcccagtcggcccagtccggcagcagccgcccgcgcacgcgtccgcccgctgacaagtggggcccacctgtcaggcctgtcgtctacctccggccggccgccgcccgaaccccagcgccgcgccgccgtcgtctctttccaaattcggccgcccctttccttttccggtgaaatcaatagaggggaaatgatcttcgggatctcctctaccttttgtcttttggaatcgtcggctaaaatcgtttggaaatccgtgaattcgatctcgaatcggattcgtctctctccccgaaccctagaccttccttcgccatcgccggtcgccgtgagccttcgccgccgcctccttgcccctataaaaggacccccatgcccgccgctacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgccggagcaccgccgtcatcgtcaagccgaaggttgccaccgcttcttcctcgacgccgtcgccgtccgttgatcttctgccgccgttttggtcaccggtgagttcgccgcgtcgttctctacgtgctggtgccctccgttcgcgtcgtcgtgccgtcgttcgccggcgagcttgtgcgcccgagccgccgccggtggtgacgtcaccgctgacgtcatcgttgccgtccgtcgtggtccagccgtggaccggtcgatctcggccgttcgttttggttaggatcgatctcggccgttcgtttccgtgagccgccgccgtgcacccggtccaccgcaaaccctagccgctgacgcaataaacccctttttccttttcaaaaataattcattattgcgtcataattcaattaaaatccacataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgtttttgctcttttttgtttaggttccgacgtttccggagagttcgttttcgcaggagaagaatttgaagagttccaagggcagcaaggcaagtcacacagatcccaaataaccctttgaacatgttgatcccgtttaaagctattgtttctattcaactattgcatttattctcgaatgtcattgggtggaattaacctattgtttattatagtccttttgttcttgattactttattccttgataccttggattattataacttgactagttgagctttatatattggttcagctagatattagatataattacttagccatgcttagaaacattagcacacaattgggataactaatgtttcactattacttaatgatggatatttaatggtagctcatgatggttaatcatgattggttaattaattaaattgccaactaaaacttgataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatctaggaatggtgcactgtggtggattgtgttgtgtgaggggtactgtcacagctcctttccgaggtaccgtggtggtattaaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgtttagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgagcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgattatttattagagtaataattgtactctattatcaatttgttattgtgtgcctcggctgattcctggacgagggttcacacacatgtaagcgtttggaattttggatagaaattccgggcgtgacacaactgttgtcgaaatgacaactgcatacgtcgaaagacgtggttactcaacagtggttggaaggaaacgaagtgtattgaatcttgaatttcttcctttttctcctcctcccattacatggccctaggggactatttatagtctcattacgggttcttactactagggtttaggttatacaggggaatttacatgattacccttacgaaagggacatttacaggggtacataatgttataggggctcatgggcccctgatgggccgtccggcgatcgccggccctatagcccctaggcttgatgggccggaaaggcttcttcggccctcgcgggtgcgaacttgctatggcgaagtcgtcttccttcggcagatagtcttcaccttgcacccttcgcctgagacgcctctgacctggcaaggcactagtacgactcttcgcctcacgccgttcttgctccatagcctttgccacgggtttcggcagatgtggtcgcagggcctcatgccatccgccaacaagctcctcacgggcaagggtgagattggagcttcggccgagaccgtgcaaaccatgtggtatggtatgcggcaccacctttcgactgatgctcctgccgaaacctacattattcccgcgcttcgcctcctgcgattggtggttatatattttcttttcccgggccgaacggaacagtattgggctttcccttcgtgggctttttactgtgccgctcggtcggtgggaatttaccgtttcgcctacccttgcgacacgtggcgctttattactggtgggtaggcgaacagtcgcccgggtgagctatatattcccaccgctctttccttttcaccgccacacttgccattttaccgcgtgcactctcttcctccgtttctttcttccacagcatctctccacccctcaagcgtttcgcccattctctttcttcgccaccgcaaacgcaccattctccatggcccctcgcaagccaaaccctgcttcggcgaaagggccggatcccggccgagtcgatgacgacagcaccgcctttttaggggtctctcttgtggatgacgtcgagctggcgaagctggacagctctggggcgttggttgaggggtaggctttcaccccagggaaagccatggtgccgaaacctatcgacaatcggacggtggtattcgccgtcttttttgaggcagggctacggtttccctgcaacgtgttgttgccggagatccttcgcctcttccaggtggaacttccacagctaagcccgtcggcgcttgttcggatcgctatcttcgactgggcgtgccggacttccgggtttgagcctaacgccgagctcttcggcgccatatttttcgccaccgtgaactcgaagacggtgattaccccggcttcaacgaagaagacagtgttcgggagcgtgaactttaacattcgtcccgagcggtccgatctctggccggtgaatgctgccatgtcgaagtgggaccgccattggatggctaggtggttctatcacaccatcccttcgaggctggcactgactcggcgaaagccctccattgccggcgtagggcgatcgcgcctaaccggaaacccaagatcgtcgtggacggctctatggaggtgcggttcgttctgctgcggaaggtttgctctcgccttagctgccgtgacttggtggaggaattctgtatgcttcgcatctttctcctctcccagtcatggcaagtcagagttgatcaaggcgaagaggttgacggtttgccgaacctggttcttcctgaggggacgaacagtaagactgttctcttgctatacactgctgtgctttgttatcttgccttctctgactgttaacatagctacacactttacttttgcagcgttgaccctcgaccaggctaaaaacgaggcccgcaggatgatcggcgatgtgtcggtcctcgagtatagccagttgctaacacgacaagcggctgggcgggcgaaccgggtttacaacggcgaattgcctcctcgggcaaacccccacaaagctgaccacggtgcagggccttcacgaaagcgaatgcgcggacaagtgaagcttgcccctaggaagcgaagggttcctgcttcatcggactccgacgccgatgacgaggacgatgtcgaagaacgcgacggcgaggaggaaggagaggaggaagaggaggaggccgtggccgataaggccgcgaacgaggcgatcgaagatcgcgtcgacacccccggctacaatgagaccggggtggagtcgaacactccccccttcgacggaaggatttggaaggggtgaaggccctagttgcgttctcctcgggcaaggcggcgaagggaggtccggtgcagaaggtctaaaaagaaaggacttgtcgacatcgcccgcgttttcagcgatgacaaatcttctgacgggactccaacttcgcccgctggccgcagtttggtcctttcgactcaaggggaaagaggccagggccgaggttgatcgcctcaaggccgaactggagaaggagaaggcccattcggcggtgctcatcgattactacaaccttactgagccaaagatggaggctctttgccagaaggctagcagggccgaagcgagcgccgcggaggagtcgcagcgtttttcgcgggagatggcgaagaccaccgaatccacgagaatggcttgcgaaacgctccgcctcgcccttaccgacatgggcgcgaaggtgcggggggtccctgccgtggatgcctcagccttcgacttctccgagtggacccagcaggctggcggatcggtttcggactgcgccaccgcgtacgacgattgctgtgcgagtgtatcggcggccttcacattaggccttttgcaacagttcggctgcgagcacatcgccgagttccttacctatgcgaagggggactgggagattagtgcgcagaacatttcgcccgctcttcgcgcatggcgaaaacagttctggcagaaagatggccggtccgctgccaaagcgcaccttctggagcaactggcgaaggcggaggcggcagatcggggcgaaggagagggcgcggcaggcgaagaggttggaggcgatgcccaggttcacccagaggtgtgaggccctccgccctttccttagatatttgtagttttccaccctcttttgcgtttgcctggagaggcgaatgatgtacattcggcaggctaccgccaaaccttaaaaaaggctttttttgtacatttggaatgtatgacacaatcttaactactttttgatgatcaaagtctttggcatattattatttcgctcatctcacattatgccatacctcccccttcttctgcctattcttactatgttagctgtgttttgcttttactgcactatccatcagggggttcgccgaaagtcgtgcatccggcccccttccgggagctggcgaagtcaaaacgagaaatttgtggcaatgaagggtctgccgaaggtgcgatgtccatttcggcctatttatcgcgaaatggagataaacggtcgcagctataaggttttcaaggttgccgactggctgcgggcgcaccccgggcgaaccttagaagattacattcttgttcattcaagacgtctggaggatatggctcgcttttggcgaatccatcagaagactaaacgtcaggaaacgatctttcagcgtcgttacagtttagtctgtttttcgccccctactcctcttaaggttgtgtatgatattagtagtgatgacgaacctagttcgcctgatcatgccttagggagggatagtgattatggggacaaagatgtaatttacttgtaaggtgaattgtatcgtgttgtgaattgtatcattttcgatctgtagcgttctatgtcgagagaaacacttttgcttttatgctgatcgaacgtaacgtcgttcggctatttattttccgagacaagctgttgcggtttcaacgttcagcgagcgatgcttcggccgattcgtttcgcccccctggcctttttcgctgatcaggcgtttgccttggggtttttccacaaattatcaatcacacgagaaataaaaagaaggcggaggacacagagattttatactggttcgggcctccatggtggataatagccctacatccagttttttttttctttttcctctctttcttctttttttttcttgccgaaaggctttcatagtgctgaagggcttacatagtgccgaagggcttacatgacagtatgtacatttttacaagttggcaatttgggtgccacccattctaggcatagaagcgcttgagagagacggtgttccaggaatggtcgaactcctcgccttcgagtgtcgctaggcgaaaagatcccgtcctggacttgtgtttgatgaggtacggtccttcccactttgattcaagcttaccaatcactagtgggttcgccttcttccttagaacaagatgaccaggcatcagctccgcgagttgaacttttttgttgtaagttgccgaagtgcttgtggcgtatttgtgcatgtgctcgagcgcttcgactcttactccttccaagagttcgagcgatactccgcgtccctcttcgcccccagagaacatcacccttggtgagttagcccctagctctgctggggtcattgcctcatcaccataaagaagcataaacgggctaaacttggttggtcttgtgggggtcgtccgaagggcccagagaaccaatagcaattcctctggccatttgactttcgctgccccctcgagacttttctttagtgcttctaggatcttgccatttgtatgttcggccgccccatttgactgcgggtgtgcgaccgacgcgaactgatttccaggttaagcccttcgcacatttctttgaacttatcagagtcaaactacttgccgttgtcagtaatgaactcttttggcaccccgaaacggcaaacaatgtttttccatacaaacttctgtactgctgccgaagtgattgccccaaggggttcggcttcaatccatcaagagaaatattccacagctacaattgcgaatttatacccgtttcgcgaaaccgggaacggcccaatgatgtcctgtccccatctggcaaagggccatattggcgcaatgggctgcaaatcatactggggcgtggcttggcttcggccatgacgctggcaactttcgcacttcttgatttgctcaacacagactttcaacatagtgggccaataaactccttgtctaaatactttggaggccactgttcttgcagcctggtgcacgccacatagcccctggtgtatctccttttccatttcttcgccttcggcaaaagagatgcaacgaagtaagggttaaagtaccccggagcagtaaagctaacccgagaccatcttatacttcgtggctctgagttgcaaacgcttcgcttctacttcgtctaccggaagccagccagtttgaaggtgtttcacaaatggggctcgccagtcatatgggtcttcgcccagtttctcctggtcgattgccatgacttccgagctgtccatgggcacacttggagcatgtaggacttcgaaaaagatgccaggcgaatatgggccaccacaagcaacggatttcgccaaggcgtctacttcctcgttctggtctctaggcaagtgttcgaccgttatgccggtgaagcatttttcatggatcgaatagcctccagatacctctttattccctcttcttttgcctcgaagaatttttcaacatggcctgctaccaacttggagtcagttcgaattagcaggcgccggactccctttcttaggcccaggagaacggcttcgtattctgctgcattgttggttgtgtcgaactgcagtcttgctgcgtaccgcattggcacaccatttggtgaaaataggactgccgcaatgcctgctcccctgtgcgaccacgagccgtcagagcacatcacccagaattgttcggcgggctcggggtcgggggcaagtaccggtgtccattcagctacgaagtcggctagcgcttgagacttgatagcagagcgtgcaacaaaatgtaagtcgaacggggatagctctgcagcccacttgctgagccggccagtgacttccttgcctcggagtatttcgcacaaggggtactgtgatggcattatgactttgtgggcctagaagtagtgcttaagcttgcgcgaagccatcactagggcgtaagcgagcttttccatttcaatgtaccttgtcttcactccttgcagtgcttcggagacgaagtagaccgatttttgtctgaactctgtttcttggacgagggcagcactgactgccaccggcaaagctgctaagtataatagcagttcgcttcctgggggtgggcttatcagagctggcgggctttgcaagtattgctttagctcgtcgaatgctgcttggcactctggtgtccaattaaactttcctgcgccccggagggtcttgaagaagggcaaacctctttcggctgcctttgagaggaatcgactgagtgccgcaattcggcctgcaagcttttgtacttcatgtacgcttgacggaggcttcatttgctggatggcatcgattttctcgggattcgcctcgatgcctctttcggaaacaaggaaacccaacaacttgcctgcgcggacgctgaaaacgcacttctccagattcagccttatgcctgctgtgcgcaagctgtcgaatgtctcctgcaggtcgatcgcatggtcgaaagccttgcggctttttacgactatgtcgtcgacgtaagcttccacattccgccccaactgcttgccaaggaccttgtacaccaacctggcgaaagttgctcctgcgttccttaagccaaaaggcatcctaaggtgacaaaatgtgccgaatggagtgatgaaggatgttttggggatgtcgagcgggttcatgtggatctggtggtaaccggaatatgcatccaggaaactgatgagctcgcatccagctattgaatccacgagctggtcgattcgcagcaaggggaagtcgtctttcggacacgctttgttcaggtctgtgaaatcgacacacatgcgccatttgccgtttgacttccgcaccagcactggattcgccaaccactccggatggttaatctcttggataacccccgccctgagcaatttttgtacttcggctttcgccgcttcttagcgatcggcagacatcttgcgcaacttttgttttcttggcttaatgtccggcttgactgctaggtgatgcatgatgagatccgccgggacaccccccacctcgtcagggctccaagcgaagatatcgatgttctttttgagcacctctaggatactctcaacttcttcttcgcccatgtcgccccctagtgatatgagctttgtggggttagcatcatcaatctgcacttttgttatcttgccatgaggggtaggctttggcgtgtgcttcggccgttcatgcggttcggtctcaatactgtgcactgctctgttgattatggctagatcgccttttgaaacagccgaaggatgaagccccttgactactatcacccctatcgggccggacatcttgagcttgagataattgtggtgggaaatagcttcgaacttgttcagggttgcacggccgaagatggcgttgtagttgtacgggatgtcgacgacgtcgaacagtatttgctcttcgcgtttgttctcccccgagccaaaggctatcagcaaaagtgcttggccgagaacttgaactgcttctccgtcgaaaccgtggagcgatgctggtgctggggtaagggcttgggtaggcaaccccatcttggcatatgcttcggcgaagataacatcggccgaactccctccgtcgaccaggattcgttggacttcggaaccagctatctcagctgagattaccaggggatcttgatgcgggaacataactccttctgcgtcttccggcccaaaagaaattaactagttcagatattgcggcgccacttcgcccgccgaagtgatgctgtggaccatacggttctgcatcttcttctgccgtttggacaactggcttggcgggtcggcccttgtaatcacttggattatccttcgttgtgcatcttggcgttgttcggctggaggtgtttactcctgaactgcttcgcggggtgcttccacagttgttccctgctgcggccttgggtcttgcgcgttgccacgttgcctaatgtttcggcattgctccgtggtgtgcgaagagctttcgtgaaaggcgcaatagaggtcttttcggaccttcttgcgggctggctgctgatggttgcttgcttgctgggcgtcgaactccttgcgaagggcttgcacttctttgacagccatcacagtcttgcccgcacggtctgttctgaactttctccaagtcatgggggcttggccttgccttggctgctgtccttggatcgccggctgagactggcgaacagagaggggaggtggttcggcaacttgaacttgtgcttgagcttgagcagcggcgacagaggctttgtcgtactcagcttgtatagcttgtcatcgcttggaatcctcctcgccccttgcgaacccgtcaatgatgcgaagtaggtgctcgagcgtctgtggctccttgttggcgatttttcttgtgagttcgccctcgagcagaccggccgaagcggcgtttataaccgacacctcagttatgtcttgaacttggcaccgggcttgcgagaagcgaggcatgtactcccttatcaactcccccggcctttggcgaatgccgagaaggtgttgctgcgtcttcggctcctcataggtgcctcgaaagttaaggacaaaaacatcgcgcaattgctcccatgagtaaatgctattggctggtaaattgaaataccaagaacgggcgatgccgtctagagcgagatgtattacctttgccttggtattttcgtcaccatgagccgcttcgatcactgactcgtagatggagaggaactccttcgggtcagtttcgcctgaatagcgcgggacgggtgggaacttgaactggggtgggattggacgagtcttgattcccccactcagcggttgccccttttctcctcccgccctgtttaccgcactttgcggcgggtacggtgtggcgaagggcaaaatcgcagcttgtgcgtgaggttgggccctggcattcgactgcccggctccaactggaggtacttgctgagccgccatggacaggtcaaaaattggctgcgaccacgtcgtggcagcttggattggtgcttggtttgttccgaagcctggagttggagcttgctgccgaacggttggtgcctgagcagcgttgacgaagtcggactgcggtccttgattccatggcgaaactcccaggcccggctgaatcggtggcaaccaattaggcgcaccttgacttgtattcccctccgggtgggccgatggggttgtacttgaaatgcagtggggttggttgagttgctgaaggaaagcttggagttgcgcctgcagagccgaagccccttccgccattgtttgtggtgcttggccaggtggttgatggtgtacttgggcagcgactggttgagcttgcagttgcacgtgaggggccggatgcactgctgcggccgattgctgcccggcgaagtacactggcacctgtgcagcttgtggcggaatgggctgggtcgtcacttgcggatggacttgaggtgggacaaaacctaccgaatactgaaggattggagccgacgtggccttggtccgccttgccgcctcgtatgcttgttgttgttcttgcatttggcgaagcatgtcttggagccgtgtcatcttctgtcgcatggcttccatgtcagcttcggcttgagtttcggggtcagggctgacttgggcctgcacaacggcgagcgcagttggggctgctgccggctgcgatggagcggcttggggcaccaccagtcggcttgttgaaaggatctccgccctggtctggagtgcccttgccgccacagccgcctttgccacgtcggccgcgttcggcacttgcacagaggttgcaggggccaaaggcggttgtgatggcgctggtcctcctccatcttcggccacgggcgccgaaggctctgctccgtcctcggcggccatgtccggtccggcgtcgctttccttccgcctggcaaccttctccttcacgaccctcttcggtggcattcgctctcagtggtttcactcggaggtccccacggtcggcgccagctgttgtcgaaatgacaactgcatacgtcgaaagatgtggttactcaacagtggttggaaggaaacgaagtgtgttgaatcttgaatttctttctttttctcccccccattacatggccctaggggactatttatagccccattacgagttcttactactagggtttaggttatacaggggaatttacataattacccttacgaaagggacatttacaggggtacataatgttataggggctcataggcctctgatgggccgtctggcgatcgccggccctatagcccctaggcttgatgggccggaaaggcttcttcggccctcgcgggggcgaactagccatggcgaagtcgtcttccttcggcagatagtcttcgccttgcatccttcgcctgagacgcctctggcctggcaaggcactcgtacgactcttcgcctcacgccgttcttgctccatagacttcgccacgggtttcggcagatttggtcgaagggcctcatgccattttattaggaaacttatgggcttgggcccttgatggcccagcacatatacatttattgggcccacatctaaattttccatatatgaaatacggctatataaggagaaggggagctacttattgtacacttggtcctatgggaatgaatgagaagagagcctcaccccatatcttgtttctccaacttatgtagatattatgcaaccctttttggactacgcgtgtagcacaggggttgcataatatgtatagaactagaaatattatgacctttcctagcagcagcagttgaatttattggcctagaaagtgccacgctcatattacctatggaacagttatgcactttatagaaacatctattgtataccccttgaactctctaaaagtatgatgatttgggccacactaccttttatcaacggattgtccatattcgtcttagatttataagaataaacattagaacttgtatgatcatagcacatatatgcatcattttcctaagagaaaatcccttgtatacccctcaaattttacctaatcccttctatacccctgaattttgcttacttccttgtatacccctaaaatttgattttgatctcttccatacccctcccgtcagttgaccgttagttgaccgtctattttccataaaaatgaccattttactcttggatgaacaaagaaattcatgagttacattattaaaaatataaaagcttctcgcatgagactattatagttatgagtttgttgttcgatgcattatttatcccaaaaaatattgttagataatgaaataaaaaatacatatttatttttttaaaaaaagtcataaaaatgaggagcattcatataaaaatagaactaccaatgttcacaacattcttttaatgaatgctcctgataaaaaaaaatccattgtcctattaaaatttcaaataaaaattttaatttattacatttattttattttcaaaatttatgtcaaaattttctgcactaattatttagtctctttagttttataaaatgcacatactgtacactcaaacaaaatttttaattgtttttcaagcttatatttgaacctaaagcatcaagggcaaaaaggacatttgcaaccaaatgtaacagtgaaatgatggaaaatgtaacggtaggggcatggaagggatcaaattgaaatttcaggggtatagaagggatcagataaatttcaggggtatgaaagagattgagtgagctttcaggggtacacaggaaatttactcttttcctaaatctcgaagatgatataaagtttgggagatgcagtgatggtgattatacggttagtcgtgaaatcaaagagggagctcatgggaatggggatacaaatgtatattcataacttgactccttagcgggttgaatccgattccatcatggatctgattgccaaggacacctcttcggtccccgcctcccccctccccccccaacctaggtcggtcgttcatgaggtgggctatgggagggcaacatgtgtctccatctcgctcgatctcccgatccctgtctacacaaatgtggaatgatacattagtatcatgtatccctggccatgttgtataaaatggttctcccaagtaaaggttaaaacggcaacagttttgaatgttcaggttacacaatgcctattctttatagaaataaatatttgtttccgaaccattacttttacatcgtacaaactacatttgtgatccacgaatctatctatctattatatgtacgaagtccattaaactttctataaatgctcctaagccaccacatggcatcctataaacgcttataagctgccacatggcattctaataaatcggtagacccactatttttaactactatattagatttcttttagaaaacaataaagccccataatcaatctctctcctttttccgttgggccatatggtacatacaatcctccagttctcctgccggtggccccgagagaaaaaaagccaagaaaaataatatgcacgtatgtatatatgtacacgtattcacggcaaaaaaaaggaaaataagatatttacgtacgtacatatgcacctatcatcaaaaacaagaacaaaagcaagcacagtatcgatgggaaaaaaaaaagaacatctacgtacatatgcacctaccatcaagaaaaacaagcatcaataaaacatagcacatctatgttatctataataacagaagaaaaatactacatcacatattaaagatattttcaaaagatcatttttaatacatttttatgcctttttgtcaccaaatagtgttaataaaaactgaacaccacattgatttacaaacatttcgatcaacttcatcctcctgtgaacccaataaacatatctcagagaaaacaaaggtccttcatctccacttcacctccccttcccctcacatacgtatatcactgtctgcttctccctctgtctcgaattggcaatattcattcctctccccattcctaatatttagtaatccaactaaaagagaaataattagtaattgtaattttcaaatgatgataatttttaagccacatgctacacatcttatgtctaatattaaaatttctctatttataattaaaaaaacaaattaacatatatatacctacatttttatatataagattagtcgatccatgttttctatatggcagtcaaatagcaaaaaaaaatatgataataaataacaacaaatattacatcattatatagatcattttataaatatgcatagataaactaaatcagtagaatccaaaaaatatataaattcaagtatgaaaaatatttttatcgatagagaacacttgcctttttgcatgttgtctgaattgctataaaatgctataaaataattcaacaacacatgttgcgccatcatatatcatatgtagatattcttctacaacttttaggtatgaacacaatttcatttatttttttgtccatgaaccattaaaaacaattgtcatatataagacacacacaaattataataaatttattcagactttggaaaccaaacattttcttgcgcaaacgagtgcatgggagagaaagagaagtacagagagagttagcagaccagtcttaacgagctaagaacaatgtatcaatattaagtgggacatggcacaacgagcgtatttttaaggcatggaacatatttactaggaattattcctacgagaggatcctatagcaaccaaataattttcatgctagaaatgaaaaaaaatgaaatattttttttggtcttgggaaaacagggattttctatggtctttgatacgatacaacataattatagcaactggataggtattataggctttatataataatctaaatgcacttgataaatgccaggtacaagctagctaaataaaaatttaaattacaaagtagtcgatctcaagtaaaaaaattcctaatattaaattattttttatggaaaaatatttaaatcatgtaaacaatcatagtgtaccacattttaaaaataatgatgcatgcacaattatataattttagttgttcgattgtgttcacgctaggttgcatgaagcctctcacaccacgcaaatagtgttcataaatagattgtgtgtcacaccacataatcatattggactctacaaacccatgtatatagtgtagtcttatgtcctatccaatccactaattattgaccaatgagaatatatatcggccttaccaacttatataaaatgtcattgaaagttccatgaaagttgaaaaaaaagtgtaatgctctgttactatttatcatatcacaaattttatacttaaaataagacttgtataaaataaaatataaaatacaaaaatatcaacagggagtaaatttaaccaattggagaaattttgcttcttacttcacacctaaattgaaacgactattgcaataaccatttcataataattgccttagataattagaacaattctaacaggttaaaaaaaatatctaagcaatgccaagaacaaaatttatgaagaaataatacttttgaagcatatggcatacaaatattatccagttaatataatgaatcttatgatgcaagcccgcgtatttgcgtgggctttctagttgctaggaacatgtatgattgtaccatcatcccagcttcgaatttcttggcttgctcatcacggatgtaactaaggtcacaagaggccactatatgatgaagacgaagagctccgaaatagttttacaggatgggagatatgggcttggaatacaacggtggcatgcattatttgtctagaactttgattttagtttcttggatgaattacacgtcacccgctctttctgtgcaaaatatgttttgcagatagagattttattggcgttatgtcctacagtgagatagtatgatccatgttctcttcaatgattttttatctactgccttattctttattttgttcagatataaagctagctccagctcataaaaccatgtccggcatgaagggaacactacactacactataagggctcttttgatttgtaggaaaagtgtaggaaatttgaaagattttaatcgtatggaaaaatttccgatgaaatcctttgaaacaaaggattgaatcctatactatcctttaaaattcctatgaaatgagtaatcctatagagattttagaggaaagttagcaagaggtccaacctcttgaaaaattcctttgagtctctctctcatccgattcctacatttttcctgtggtccaatcaaatagtcattcatgtgttttccaatcctctgttttacacctgcattcctgttagaatactgcgtttttcctattcctccgtttttacattcatgctattcaaaggggccctaaaagaagggtttatgatctgtaaagtggatatatagtccaatattacgcctataccttgttgttgctagccattaattcttcagatatgcctttcatcgccatgaacactacgctctgtttttgaatgaaaggttccctcatgattgcagagttgagagttgagaccttgagcacaatagtgcatagcagtccagcccaacacccccatttgctcaatgcatgttttcctggaaggtcgtctgcgatggcatataaagtagtatcatttttgtttcacacaaacattttcttcatatatacctcccaagcccaaatagtaatatgtaaccagaatcaggttcactgctccctggttggcagagtggcgattgaatctcgtccaactttctatgctggcaacgtacgttcaactgctttgaagtggaaggcattaggaaaatggtggaaacaaggtctgcaatcctaggttggagatatgtgcaggtcacataatagctccgagttgcgatggcatggaaaatccattgaaacaagtcgagtaaatcaaagtatgccgctgctatcttattctgcaatttaaaagacgaaaaggccttgaatcgatcgaaaccaacagattttgtgtactatgatactatctcgcatatataaccattggtagagccaaggcccggccagcatgggcaggtgtccatgctccgacgcatgcagccttgcattagagctaaatacggtgcttagccattagcatagctgcacatacaccattagattagcactaattattgtacttagccattagccagcagcccaagtttgcttttgtccatgataaaatgctatatgtatctgtgtttacttataatttgttatctatcgttaggtttgcctaggctaaaaaaatttttagatccgctactgtatataactacagaatggcgctaaaagtaaagagggacttaaatgtatttcctatcgttcccaatctattattgctttgatccatctagtttagcttagaacaaaagacatctgtaatggcagactaatgtttcatctaatggaagatgttcatctttatattgagagatttcgaaaggagtctttttggacagggaggtatcaggttgcaccatagagttctaggcaatctctgtagaacttcctcttgcaatatctggggaatggtgatcatgatatttttccagaaagtccttcatgaccatcgcccgtacgttatggctttaatttggtgcttgttgttagttttcagtagagcagaggagctctgcgctgcaaaattttggcaccgatactgttgtgatcatatgctcagagaacttgagaacttagtggtgtcctggtctaatgcagtacaaactctagtactctctccttctctaaatgtttgacgccgttgacttttttaaatatgtttgaccgttcgtcttattcaaaaacttttgtgaaatatgtcatactatatgtatacataaaagtatatttaacaataaatcaaatgataagaaaagaatcaaatgaacggtcaaacatctatctattatatactaaaagttaattaaacttcctataaacgctcctaaaccgccacatggcatgctacaaacgctcataggctgccacttggcattatcaaatctcaccgtcgattttcacttaaattggtggacccgttattttataccattggattatatctattattaaaaaatttcaactttctctgtatatgatttaagagctactactgttgtcatgtacgtacaggtttatacgatgtcttctcccgtacgtacttatgtgcacaaaaacaaaacaatagtttacgtactattcgctggaaagaaaagaaaaaaaccatgcgcatgtacataaaaaagatgacaaaaaaatacatcataaaaatcgatgatctttaaataaaatatgattttctaaaatatattacatcacaaatataaatatatatagttaaactaagatctataataataatataaaatatccaaccaatgttccttgaaccatcttccaaattatttttaaattatatatctaatttctgattccgttgttttcctttaattaaattataagttatattgtggtcttaaatatatcacgacacatggggctgatatataatagttagtttttgataatctattatatactaaaaggctattaagcatccttaaaacattctcaaaccgttatatggcattctacaaacactctcatctcaccatgtatcactctagaaaaattatagaaaaaacaaaacatctagccatcgattttcactaatatacggtgcacccgtattttctaccctcggatttccttaaagaaaaaaaaaagaaagacccacaccccaccgcttccatccattacgttacattaggtatatgtacgtagttacgtactccctctgtttcacaatgtaattcattctatcatttctcacattcatattgatgttaatgaatttagacatatatatttatctagattcattaacatcaatatgaatgtgaaaaatgctagaatgacttacattgtgaaacggaggaagtatcatatatccctgccctcaccctaatatataagggcaacatgccctcctattttcaagcattttcttaattaatattggaaaacatactttgtaataaattattttaaacaactatatcatctaaatagctattttttattcgtgcatgggacgagattatttacaataaaatttagaattcaatacctacattaaatatattttaaaagtaaaataaatgtatttctttgggtcatataatgctagagactacctattggtcactcgatatatattaagaaaaatcacatagatcagtgcacgatacatgcccgcgcattcgcgcgggctaccttcctagtttttaaaaaagtcaacggcgttaaatattttaggatggaggaagtatatatgtttgtcacagagaacttgacctgctatgcaggtggctagctatgggaagagccccagcatgaacagcattgttgtacttccgagacctatgtggtatgcacgatgcgttggaacttgacggccttatctcgattatacttatggttagcaaccaaaatttaaattttcaatcttcgagttgattttagagttttcctcatcatacagcctttgcttttagaacatatatatatatatatatatattttatttataaattattttttgtttacaaatatattgtttggattttcgtcgaagaagccgaacgatgaggctgttagtgcgataggcaaggttttttcttaacgaatatccatgcgtcaggcatgtcatggtgacatcaaagcagtttaatttatttttttttgtctaggaattaaagtacgacttaacatggccatctgaattctgaaaatatggtcctgttttgataccaccctataattttttatccagtcacattaaacgtttgagcacctacatgaagcattagatgtaggcaaaaaaaaataacacttgtacagattgcgactaatttgcgagattaatcttttaagcctaattgctccatgatttgacaatgttgtgctacagtaaatatttactaatgatggattaattagacttaataaattcgtctcactgattactgacagattctgtaattagttttttagtttgtgtccgaacacctcatgcgataccctatataataccagatgtgacagacccaaactttacacccctggatcgaaacaccccatatgtcgaggaaatgctaagattgcttcttagaagtgcagtttgtaatttatatctatttaaagtggttctggtgttacatatgaagatctgtcgtacgtctgtatctactcaatataacagctagtcccagctgcaagtatttgtaaagccataacctttcgatgtttacaaaggaaaacactatttttaccaggtgtaaagagtgcagatgcctacatgtacacagcttcgtgaaatccgacacctatgcatgcaattcgatgatccaacctacataatgttcagtccaatgagcttttggagctccggtttttggcttggaaggcgtcaggaaagggaagatcatagtaaagatgaacatcctcactgcatgcctatcagcatctcctattggaaggctggagacggtagtctacattgcaaatagaaggccaggttatgacgcttccaccaactggaacgtaacaatagtcaagaacaccatcattttatagactgatctgttaccagcttgtagtgaaacaagggccaaactcaaaaaacctaatatttgtttgaccgggctcaaaacctagttaatatttagtggttatagatgtgcaagcactattattaatttgtaatagttttgaaaataaatattgtaccttgtatatatattagtatgcacaggttggtatcacaaaagatttagatttgaggataattagttgtatattccattttaattgcctttagacttataatatgttcagttggtatccattgtaatgcatggatttctgatgctaggtatatattgaaaacattattcgaaaaatatgtagcttgtcattcaagcttttatttacactagggtggtagcccacgcatatgcgcgggcatgtgcgtgaaattttattgtgaatgtccatgtgtgggtggttttctataaaaaatattcttttgattcatcataaactaaaaatgaatttatttaacatgctttgtgtaaaatcaaaggtgtttttgattattattctgtaatgaacaattggcattggagattatcggttttgttatttggaatttattctcgaagtggttttgaagataattggatttcacaggtgatatacaggatactgctagatttgtgtccggtcagaccgggctctggtagccggtcagactgttggtatatgcgcggtcagaccggcgcagtccgcggtctgaccggccgacgctatgtcggtttcgatttcgggttgtttctttggatatccgtgattatttcatgattatgacttctagatggatactatacgtatgtaatactgttgtttgctactaatgagtcaagttggagatagcttcgtctcggaatatggtttcagagatcatacaggatacttaggctagagttgatgtacgtggttgatggagattccatattgcatacgatggaggtattgtgtacgtatgggatgcggagtcgaatttggaaggagtccaaatttggtacgattggttatataaagtttctttcttgtactagagggtttcctaaggtgtttaggactcttagtatgagtttggttcgtggctttaggcttcctacctcgggtataaatagagggggagcgtgaggcttcccggtatcgcttttgagagcaattgagttgagttttgagttagggtttcgagtttaatcgaaatttttgtaaggagtgttgttggtgcactttgtaaacacagagagaatcaataaagtcgtcatccactttaagagttcttcgatttgtgtttaccgggtttcggcggtctaaccggcgatataccggcggtcagaccggcggcacgcggcggtcagaccggcggcatacgggcggtccgaccggcggcggcggcaggcgacttcggcggttcgaccgatcgatctacatcggtcagaccgacattcatctagcggtcagaccggcaatacaacttcggtcagaccgcgatccgtcgaatttgagggtaacttttattccagctaaaagttttcggtttttgggtatactaaccattcaccccccctctggttggcttagttcttgtatttcgatcctacaagtggtatcagagccttgttttcttctttggatttttatcgatctagagtttttgccatggctactcctgctaggtttttaactaagcctcatgttttcgatggaacagatttttctcattggtgtagtgggatgcaatattatattatggctgaagattatgatatttggagaaaagtttcttatccttatgtgattcatgaagctattaatactgctgctaaaaaaactgcgtttgaacaaaattgcaaagctcgcaacattcttttgagtggtatttctcgttcggattatgatcgtgttgcgcattttcgaactgctcatgagatttggaatgctttgagtaactttcatcaaggaacaaataacatttaagaacttcgtcatgatattttcaaaaaggagtatattgaatttgagatgaaacctagagaagctttggatgactatcttcctaggtttaataaaattttgtgtgatcttagatctgttgattcttcttatgatactaattatccacaatctgagatttctcaacactttttaaatggccttgatatgtcaatttgggggatgaaagttacatctattcaggagtctgttaacatgtctactttgactttggattcactttacacaaaattgaaaacacatgagatgaacgttctttctcgtaaagttgattctaagtcgagtgctttgatttctttttcttcttctttggatgttgatgctctttcatcgaagccttcctttcttgctgtttttaatgccacatccgatgatcaactcaaacagattgaggaggaggatttggctttggttgttaacagaattgcttgagctatgaataatgccaggaacaggaaaagaggtggtccaaatcgttgctttgaatatggttgaattgatcatcttcattcgcattatcctaagcttggaagaggcaaaagagaagacaaagatggtgagaagaccaacaacaacaagccgaagggttcatgccaagggaggaagatgaaggagaatctcaggaaggcttttgaacaagccgaagggttcatcccaaatgatgtagatggtgagagtggagatgatgataagggaaagaacatctctggtgtttgcttcatggcgcgtggtgaatcggatatagagtatgaagatcatgaggtaagtgcttttgaggaagttactaatatcttaagtgcaaaaaataagaagtgtgagaagatgtatagaaaacaggaatttatcattgaatctcttaattctgaaattgctagattaaaatctcttattcctaatgatgatgattggaaaaattgtgaggttttaatgaatgagatttcaaaaattagagatgttaatgctgcacataatttgaaaaatagatcttctcttgcttgtagttttgctttgcacacacgcactttggatgagttgtttttaactaaaaagttgttgcaaaaatatcaaattgcttttcatgctagtttgatgtttaacatgatttctgctaaaaagttaaaacaacctcatgatgttttggattgctcaacatgtaatttgaataagatgaaactgaaagatgctttaggtcgtgttgagtacatggaagatgttgtgaaaaacaatgaagtgctttcttgccctaaatgtcataaaagcaaaggtgtcatggtagattgtgaaaattgtgctaatttggaaaaagaggtctcttattgaaaaattctttgctaagattttctgatggtaaaaagaatctcaacatgattttagatcaatctaaggttagcacacataaccatggtttaggttttaatcctaatactcataattctatacatccacctgttgtgttaggtgctggtgctagagatggtgagattttggttaaacctgatactaactaaactgtgtttaaatctgctagtatcatgtctaccttgagtgcatcttcttcaaaatccaatattgtgcatgcaaaacctcctgttgttgcttgtgttgctaaatcttctagttctaccaatgtgtctaatcatcgtgaaatatatacttgttctttttgtggcaaagatggacatcttgtcggtttttgttttagattagctcataaacagaaaaaggagagagagattgcttttgcaaaatcaaagtggcaaaaattgggttttccctcgaggaaaccgatcagaccgcagtgggtcccgcggtcggaccggcgaccggtcagaccggctactgagcatcagtcagaccggcggtgcagcggcggtcagaccggaccccggtcagaccggccactgtacctcggtcagaccggcctcggaggaatttttctgaaaattctaatattgattttgcacgtggatatatgcctattggatcttctggtcatgtgtctcagtactggattcctaaatttttattatcatctaaccccagtactgaggcttcgacttctgcttgtgtgtaggctttggtggcaaggaaggagaacgtgtagatcgtggattccggttgttcgcggcacatgaccagtgataaaaattggttctcctctctcaagaaggcatccaagactgaatcgattatctttggtgatgcttctacaagtgccgttctcgctacaggtttggttaaggtaaatgaaaattttgaattgaagaatgtagctttggttgaggacttaaagtacaatttgctttcggtttcacaaattgttgatgaaaattttgaggttcactttaagaaaactggaagtaaagtttttgattcttgtggtgattctgtgttgaatatttctcgctatggaagagtgtttaaagctgattttgaaaatcctatttcacctgtgataacatgtttggttgctaagtttgataaagatgtgatgttttggtatcgtagacttggacatgttggttttgatcatctcacttggttaagtcatttggatcttgttcgtggtttgcctaagcttaagaaagatcttgatttggtttgta

SEQ ID NO: 15359 - DNA, 397 bp, Oryza sativa
tgaatataaaactcctagaaaattttgggctgaggcaattaacactgcttgttatatttcaaatcgtgttttcttgagatcaaaacttggaaaaacttcctatgaactccgatttggatgtcaacccaaagtttcaaatttgcgtgtttttggttgcaagtgctttatcttgaaatctagaaatttgggtaagtttgagtcacgttctaccaatggattgtttcttggttaccccgcacatactcatggctatcgtgtacttattttggagactaacaaaattgttgagacttgcgaaatttcttttgatgaggctagtccaggtactagacccgacattgcaggtacactgtcacaggttcagggggaggatggtcgtatttttgaagatgagagc

SEQ ID NO: 15360 - DNA, 31876 bp, Oryza sativa
  unsure (1)..(31876): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctcatgcttcacatcgtcaagcggtcaagcgaataataaggtatttaaatcatatacttgagtttggaatttggtattctacttcattttctatatgcttgagtggatattctgatgctgattttgttggttgtaaaattgataggaaaagtactagtggaacatgtcattttcttggtacatcattgattgcatggtcttctacgaaacaatttagtgttgctcaatcaactgctgaatcagaataagttgctgctgctagttgttgttcttagattctttggcttatatcaactttgaaagattatggtcttacttttgagaaagtttctctcttttgtgataatactaggaaagaaatttgaaaatatactttattttttcatattttgcgtttatatacctgactgtaattaatttgcaaaaatatacccaatccgcggaacggttgtgcgggagcgaggataaaccaaccggtcccgctagccggggacgcggtaccgcgccggtcgcgcgggctgggtgagtgcggcaatgctcccgcatgccggatgtgcgggaccggcgctcccacatgccgcccctcatctcggttcccaaattggatccgatgtcctatgcacgaaaaacggagcaggccattagcacataattaattaagtattaggtaattttttttaagaaaatagattaatatgatttttttaaacaactttcgtatagaaactttttacaaaaaatacaccgtttaggagtttgaaaagcgtgcgcgcggatgagttggtaatattaggggaagaacacatctccaacaacacgcggcctgctcggttccgcgcgttggaacctcgggacagcctcggtcccgcgccgctgttatgcggcaccgactcgctatcccgtgggctccatcgctcccgctcaatggcatcgccgtaccgactcggtcccgcagtccagtcgtgcgggaccggctcggtcgcgcatcccggttccgcgtgactggctcgggtttcgctcccgcatccccagtctgcgatttgtcctcgctcctacgcacccgtttcgcggattgggtatagttttgcaaattaatcacagccaggtatataaacgcaaaatatgaaaaaataaactatattttcaaatttcttccataatactagtgctatcaatattgctaagaatcatgtacaatactcacgcataaagcacattgatattcactttcactctttgagggatcatgttgagaaaggatatgttcaattgacgtttttggatacaagttgcaacttgcagatattttcactaaacctttggattctaatcgctttgcttttcttcgtggagaattgggaataattcatccttttggcatgatttgagggggagtttttgtacctcatggttttattaagcaaaatttcataataagaaaaattgagaaaagagtgttttgttttatacatatagtatatttttgtgcatgctagcaatactatgaaggtttatttgtctctagcatagcttgtatgtattttagtctttttatgaggcttagatattggttttaagggagatgatgcatgacacttaaactctatacttgaattaagaaaatatgcaatattaatgttagtatatggtttgatttataaatgcttatatgtatatgctttattgattttttattcctcaaatagcttcgtaatttctcattgtacaagagaataaaatatctatgagagaaaaaaatgaataccgaatccttggaaacagtcttgatgacaaggacgtattcgatgtgggcaaaaattatggctgccgaatcctcggaaacagtctcgacgacaaggatgtacccggaataattgagagaaaaaaatatgagcaaaaaggttcaaataaaagataaaaattctcttggttgttttgtgctaaagctaatttgagaaagaatgctaaatgcaataggtatatatatatagtgtttatttttcaacctatgtgcttgtaaagatgttgcattataaatcgtatgaaatcttaaattttgattgttgaattgatcttatttgtaatatatttgattcatgattgtactttaatgcatgcttgctatattacagatgggttcatcttctttttattacaacacatgacttgatgtgctatatgtatgctaagctcttaaatattaatgaatataatttctatgcttgatgaattcattgttaaaagggggagaagagaagtttttcagaagagcatgtttttctgtttttcggacaagggagaatttctttctcttcaaaagtgagagaagttttcttttagattttgagcacgacgtgtacttttgtacgaagtgtgctttttactatttttgtttttattttttcaaacaacaaaacatttttgatgagtttgccaatgtgttcatgaagggggagattgtaaaatcaaagtattttttattcttattttgtgatgaataattggcatatgagattattggttttggagatgattgattttcaggtgatgaacagtgttgctgtttttgtcaggaccggtcaaaccgggctgtgcttgccggtcagaccggatttatgtgcatggcgcggtctgaccggccgactctgtgtcagttttggtttcaggttgtttgtttggatatccgtgattgttccatgtttatggcttctagatagatactatgcatatgtaatactgttgtttgcaaataatgagtcaagttggagatagcttggtcttggaatatggtttcttggtttgattcatgtgtaggtgacttgatgcctcgggagagtattgccggtgatggatcaggagtcgacttggggataaggcgatgtccgtgatggtcagatatcatgcgggatacttaggctacagttcaatgcacgtggttggtgaagattccatatggcatacgatggaggtattgtctgcgtatgggatgcggagtcgaatttggaaggagtccaaatttggtatgattgttgtttgtaaagtttgtttcttgtacgagaagatttcctaggtggattaggacttctagtatgagtttggttcgtgactttaggctgcctacctcatgtataaatagagagggagtgtgaggcttcccggtatcgcttttgagagcatcgaattgtgaagaagttaggatttcgagtttagtcgagattttcatgaggagtgctgttgttgcactttataaacacagagagaagtaataaagttgtgatctattttgagagtgcggcggtcagaccagcggatcaacggtgatcagaccggcagcggcgacaggaggtggcgacaggttttggtggttagaccgagtgatctataccggtcagaccgacggcttccaggcagtcagaccggcgcatctactttggtcagaccgcgatccgtcgaatttgagggtaacttttaattccgaaaaaattgggtttttgggtatagcaaccattcacccggccctctggttggcttatttcttgtgtttcgattctacacttacatggatttgtaactaaccctggcagggtgctatctttgggctattaagttgcaggtctctcaaccaattaatactagttaatcaaagtataacaatactttgctgaaagtagtagtttagccattctacggagctgcctggtacaaattgcatgatctatacatgaccccaggaaaacaaacatccccacaaacttgttaaagcaccaactgaagaaagttagattgaaagtctagttatcctttatcatcgacatcctaatgatgttgatgtagtgtcgcacagccagaagtaagccaaccaagggagtacccaaaaacaaaacttttagcgcaattaaaagttaccccataaatcgatagggatcggtctgaccggagtagccgatctaaccgctcgaagagcttcggtctgtccggtgtagtcactcgggtctgaccgcacgatgcaccgatgtaaacgtcgttgctgccggtctgaccatcggtgtcctaccggtggactgccgaacccgagcaaacacaaattaaagttctctcatagtagattgaaaatttattatttttgttcatgtttataaagtgcaacaacatcactcttcacaaaaaatctcgattaaactcaaaacctaacttcactctaaactcaactatctctaaaatcgatatcgggaggctacaccctccctttatatttataaccgaggtaggcagccaaaagctatgaaccaaacttgcacaaaagtcctaatcccctaggaaaccttcccgtacaagaagcaatatttactaactccaatgataccaaattcggactccttcgaaattcgactccgcatccaatacgcacacaatatctccatcgtatgccatatggaatcttcacgaaccatgtgcattgatttttagcctaagcatcccgcatgttatcctgatcgtccggacgtcatcttctcccaagttgactctccatccatcaccgacaacgctctcccgaagcatcaagactcacctacatatgaaccaacaaagaaaccatatccgagcacaagttatctccaacttgactcaacattaatacacaatactattacatacgcatagtatccatttggaaatcataaacatgatttaatcacggatatccaaagaaacaatccaaaatcgaaaccgagacaaaatcggatggttagaccgtcgggttggccagtctgaccgcacaacatatgccggtcttaccggcaacacctgcccatttgactagactacactgtcaacaatctctttttcgtcatctgaaagtcacacatctctaaaactgtgaagtgtttcacgttggttgtgtaagggtaaaggtcctaatatataagtgggagagcccctcacctcatttgttagcttttggggtgggaaaagccctttacgattctacaattggtatcagagtctggcttgttcaaccttcgacccgagggcaaagtgtgtgatgcccttatggaccgaccgtgtgtgcttgcggagcctgtatgcttgaggaaccatggggatacgatgaaggggcggggaatagctaaggaacaccaatgtgaagggggagattgtttaatagtcctacattggttaaggaagggtaaatgacctaatatataagtgggggagcccctcacctcgttggctaggttttggggtgggaaatgtcctttactatccttaaaaaaccacttcgtcaataatttctgaatatcaaaaccaataatttcatatgccaattattcatcacaaaataacaatcaaacattttgatgttacagctgacaatgtgggaagctcttggccatggttagaacgcaatgttgcctttcagcagccatctgacaaccattcactagttgacatacagtgtcttaagaatttgccgtcacttcttaacaccagggttacatttggtcttggcacagtactacctatgctttcctaatgcctcgtacgcccagagagaggatacattcagcctcctcccttcgtctgtaaaaaaactgtattttcagctagtcaaaggcagattaaggaggtaaaacactactatgctcttcattaatgtccaaggagaggatgtattgccgttttgatatagcccctcgtcacattccctagtttgttttcttggacggagtgggatgtagacagaggtaatgagcagtactgttggaggagatgaatgatataaagactgagaggtggaaactcctaacattcatgaatgatcaacgattcgttatttaatgtagcaacaggtgtgaatggtaactctgatcctgggaatggggatgatgatgttgatgacttgggtgatgataagaaggatgataagcaaaaggataagaagggggatgatagcgcaggtgataaaaaaaaaacccaagaaaatgcctcctggtcagagctatactggtagtgaaaagatgaaaggggcgcaatctgcacccccacctaccagaccagggaaaggttgtgttggtagtagcactatctctgctatggattgcaaaggggttgctagagtttgtgttgaatatgtgtacgtagtcggttacagtttaggacttggagttgtaataggtattaggactagagtatgagtcagactctatcctaggatctctcataaatagagaggcgtgcctgttgtaaccgcatggtgacttagcatagcgtccggccgtaagtagttgtaacactgatacgatgtatatgctggatcggggaggagcgcccataatcagtgcttccgagatgtaggctacggcggaactccgttatcaaatatcatgcctcggtgtcgtcatcgtgtttggatcgcctatggcatttctttcgcgtttggtttccgatgtgatttcggggccggttttgtaacaggggttgtaaccaaagaccaagggacaaaaaagctgagggagatctaaataaagctatagttgggtggaaaggagagagtgagttctctcaacctgagctgtttgagtctgaatctcaggagtctgattataaagagggtgaactgatgactctcatggatcttgacctcaaacatggggagatggaggtgggagcccaggcaggaaaagaacagaagtgcggtattcccactgactctgacatcgagaatatgagatcagaggaagataaacacgttagtgtgctagaaaggacaatcatcttttgtgctagaaaagaaacgttatgaacaacaaacttgcatattgatttgatagtaaggatgtgtcactagaacggataccctcatctcaattgggcggtaagccccatctcaatcaggcatggcgtccgtcacaggctagaagtcactgatgtgaagacctatctcaatcgggcaaacggtcgtcacggatgatcctatctcaatcgggccctaagtaaagcccgtcaccgatagctttgacccagacgaccagtcaaactatagcccgtcacagatgacctatctcaatcgggccacaactagcgcctgtcacagataacccttatctttgacgggcattaactatagcccgtcacagataagtcatctgtgacgggcattaattatagcccgtcacagatgagtcatctgtgatgagtattaacttatgcataagttaatgcccgtcacatatgagtgtaatccaaaaataaataaattttattttttggctagccctcactcgtgtgcacccacgcccgaaattgctccagaccaagcacacttaatgtcaaagttctttggagattggcttctagaaaagtagtagtaacatgttggtatgagtattctattaatcctattatgccctaggccaggatgtcaaattagggttattaaatgatttcaaatggaaaagtcaccagaaccaaagttgtagaactcatcgaggtgcaaaatttttattttggtcatttctccatctgactctatttaaacaattcgaaatttgaaattcgaagtttgaaaagttcaaatagaattttagaacagtgaacgacatcaactgaaaaaatcatcaacaacaaagttgtataactcatcaaaatctataacttttattttggtcatttttctatataacattttttgaaccgtttgagtttgaatttgaaaatatgacaaattcaaacaacattttcaaatactaaatgatataaactaaaaaagtcatcaacaacaaagttgaataactcatcaatatctaaaacttttattttggacatttcttcatacgacaaagtgatagtaacattgttcacaaaattgacatatctcttatctggttttataaactataacacctatatgtaaaatttgtgaataatattactaacatttcgtcggatgaagaaataacaaaaataaaagttttagatcttaatgagttattcaactttgctgttgatgactttttcaattgaaatcatttagtatttgaaaatattgtttgaagttgtcatatttttactttcaaattcaaattgttcaaaaaaaatgttatattgaaaaatgaccaaactaaaagttgtaaatattgataagttatacaactttgttgttgacattttttctatttgaaatcatttactatccgtaaaattattttgactcataaaatgaattattatactgcactaaattattttgctatagtcaacttacaaatataaacatttcatatgaaaaatggaaaagtagtcatcggtgacgggctttagttaatgtccgatagagattaagtatatagcccgtcaccgatgagtcatctgtgacgggcctaattgttatctcaaacgggcctcaagttggtgcacatcacagatgatggtcattgtgacgggccacaaattggagcccatttgagataccattccttatctcaaacgggtctaaagttgcggcccgtcacagatgatggtctaaagttgagatatggaatgttatctcaatcgggcctaaagttgtggcccgtcactgataggtgtcatccgtgacgggcttaagttttatgctcatctaacatgtctgtgcgaccatatctcaatcgggcacttttcagcccgattaagatgacttccttgtgacggcccgctatttctaaacatattagagcccgtcacagatagaaggatctgtactagtgtgtttagtttacgtcaaaatttgaagtttgattaaaattggaatgatgtgacggaaaagttggaagtttgtgtgtaggaaagttttgatgtgatggaaaagttgaaagtttgaagaaaaagttggaaactaaagcaagcctaagtagttcaatagaacatacaaaatataagtaaaaggaatgttgtgtctctgttatatactttgtccaaagctttgtcacgatttctagagctttgtgcatccgggggtgagtaatatggccctgaacctatccctccaacaaatgataatcactaatattccataatagaataattaaaacttatcacctaaagctacatttttccaaatatattgtcaccttatgcttcactagaagataaaatcaaaatttacacctacttgctcacaactaaattaactgtaattgaaacacacttccctccccaagttccccctccagattaattgcctcatccattgagcacacttccctaccgaagcactccagattaattgcatgtttgtaatttaaacttcattccattaattttttaaacgaagaaatctacttcacaacccatgcaatcctttacgtttaaccttggtttgtgatctgtaaagaaaatataacatctaatatcaaatgacagtgaagtatcatctaatattatttaacagtgatgaatttttaatcctaaagttaaagattatgattttttaatgttgatgaaatataattaattcatgatttctaaatacaaaagtttgtaagtttgtctctttgggaatatgtatatgtaaaacatcatattcatatgagtggtgtaagcaatcacattcttgaagtcatgtcgtacggtgtatcccatataacgagctagttgctatattagggagcatgattgcttacaccacttatactagtaatatgtccgtgctaaacgctacggtgtaattatatttgcttttaataatttttaaaatttcatgttagcaaaaatttatttttatatggtctgtgctgtgcatgtgagcaaaatcaattaatgccgaacatcaaatatattaacatatttacatccaactcaccgccagtaatccaactcatatttacaatacttccagatgcaccatttaggtacaaatatagatcaaaataaaggaactatacagcacaccggcaaccatgtaacagattcttaataaaatatgcatagataagcccacctcacaattgcttattaacatgtgctctatattaaacaccatcgtaatatctaacaccatatagtttatttacatattggagtgcagaaaacactaaatatgcatccatggtgctgaaaaatattgattatacaaacaaattggaaatatgagctctgagtcttgtatgttcagaagctaggaaggaatcaatttggaagtacttgaatgttaaatgacactgaaaaatgtaccatcaacagaagaaatggcaagtacatgacatgctctttataagtggtcatgacatcaaaatagcaaaattcttaatgacagtacctatctcactaatttatctctcgatacaactggagagaaggtgacacagcttcagctccccaatcaccctatcccttgtatatgagaaacaactaaacgaatcagtatagaaaatcacaagcatctttcataacagtaaatccacatgcagagatgcgtaaattacagtgaaattcccagattaattcccatatcccgttaagctgcattgccagtggcaatgtaatataggatgtgtggcaatgtaatacagcccacctcataggatccgtggccatgtaatataggccatgacgtggattactaacagatcaaagaccttgacggctgggatattacttgtgacacaaaagagagatcatgctattttgtctaaatagcaaatatagggtaaataaatgaataaatttcagaagtgaaataaccctaccaaaggtagctaaacaacagaagaaatttctattaaacagagtctagttagcaataccaacagcaagtaacatgaacattgacggaggaaaatcatgatgtttattgctcagaaagtgatcacctgtacataaatagaattgaaaaccaccacgaacctcatgagatggtacctgccaagtcataaaaggagtggagcaagcagtgaagcatgggaataggacaaaacgtgggctgagaaaatattatctaattgtttgctcatgaaatctcagccccttctgattatgtcaagacatatcttctcattgattatgtcaaaaataataaaggtaaagagaatgttagtaaggtaatatatccactaattaatcaataggaaagttttttttttaaaaaataatcaatagatcagttggcatttttaattacagaagcactacaaaattttgctcagttttcatcttggggagacacctattataagtccctcatattgtcgaactcagccattgcccatgaatcctacactaagtttccccatcaaacaatatatgattaattacatacagaaaatgtaaatttagttgctactgactatatgcagattgatttcatttcgttcttgagtaagttctttcatgaaaaggacctgcaattagcatgaggagatgtattccgtttattagttgactatgaatacttgtacctagctacagccagccaagtcaggcactgaactgcaactgtcccctccagttgccaattctggtttagtcaacatgccatgcaagttaagcgaacagttaccaaaatgaccaaatacatactccctccgttttttaatagatgacaccgttgactttttctcacatgttttaccattcgtcttattcaaatattttatgcaaatgtataagatataaatcacacttaaagtactatgagtgataaaacaactcataacaaaataaattataattacgtaatttttctgaataagacaaatggtcaaacatgtgagaaaaagttaacggcgtcatctattaaaaacggaggtagtatttagtttctttcacatagaaacataattgttatgtaaatcaaaatgtatcttaagagcatatgagatggtatacaacagaaaaatctcttttcattaccaaagggacataaaaatcatttagttcagccagcctgatgcaaaaactcactgtttttcctttttttccacttactgtcatgttaagtcctaagggctgagtgcacgctaccaaatcctatacaggttaaagaatcaaatatccccaacctagctcgacaactcgagcattgaagtttcctggaatgatggaggtataccaaaatgaactatcatttagatagagaaaccaacaggcacatgaatcatgtatgcagattacctcgtaatgtggaagcctgtgtactcctcactcctaccggccatgagcaacggatcaggccaagacccccctcgacactgtcacattagctggtttaataaaaagcatgagattttcttcagtagttgtttgtctacaagcagacgaagacgatatggaaaatgtaaagttttgatggtaaaaaagccataatttaagaatgttcaatgaatccaaattccaaccaaccaaatctaaaactgcatggataagccttcaacttctggaattttagcatctaaaactactaaaatgtattgaaagatttttctaaccctcaagaacagtagagatacgcggacggcggtggaggcagcgacagcgacgttcggacggaggatcggcagcggcggcggcggcgcgtggacgatggaccagcagcgtgggcagcgtggggtcggtgcagacggaggttgtggcatcgtcgcggatggaggtggtggtggcgacgtcttcctagccgcggagggggcagcgtcgaggatggagggggccaagtgaggagagcgcgaggaacgggccggtctgcagcgggacgacggcgcccctcccctcccctcccatgctctgcttgcgagttgcccgactcgcaatatggggatcggagcggaggcggcgatgggggcgatggcgccggtctacagcggcctggaaggggtggcagccttgtgggatttgagcggagatcgcgggcgcgatgattagggctgcgacgcggttaagggagggagcgaggaaggtgagagggcgcgcgggttgcgggatgagggggagatcgatgtgcgtggggctgggggatgcagaggtggggagttggagatgatctgatgcgttggattttacacggatgatctaaacccttgagtgatgaatgaaataatgaaagaatgagtgaaagtatttgttgaactatagggtagattactccccccttgtttctacattgcaaaaattactggcacactgtttatatggctagttgctatctatttcgccatacagacattgaagtccctgagtcgtatgctctgttttaaaggaaaaaaattccctcagtgcttttagaattgagaccctcggccctataatgcacacgagggcagcctaacaccattcatcccatgttctgaatccagagactcttagatactccttactcctccatgctggatggcactggaaacactatagagcaggtagcatttttatctatcacaaaccttttcctcgtcttttccaagacaaaatcattcctcatcaacatcacttggcgctcctctttgtcttttattcatggttgcaagagaggtgagtgaatctcatctaactttataagatggcagtggtcttaaggtttggagtggaaagcattaggaaaaggtaggaaatagggtctgcaatccttccatatcgaagtgatgagcaggtggtaatgtagccctgagttgcagttgcatagaagggcctttgcggcaagccttgtacgggccagtgagtagagattgtgatcagcagcaccacagaatatgaaggttgcatgacatgatgcatctcctccattagctagcaataatattacttccaataatgttataaagtgtggaataaaataagatatacactcatgaattcatgattatccgaagtgtacatcaaacgatgtagctgctgttgtcttggcttgaacttaaatgatgaagaaggccggcctgaagccaattagccaaagcagctgttattgagtgctcaaatacatcctcctattcaactacatcaaccgttgaaagaaaagagactaacatatgtattttttctgcctagtattgttttaatgactctagtcaagtacaaacaacatctctattggcagtttacaaataagtacattttgcattatctgtgcaagtttatatattaacttcatcttaagaaatatgaagttaacaatgcgcctccgtggcgttcagccccagcatgagaaacgggcacattgtatgccacgtccaccacaagcggagtccaatgacgaacgcgtagcaaatgttggtcactagttcttcccactgaaaagcctgaaaaagctgggcacagcggctgggaagaggggagagagagtgtgaacgctgtcgatctgcagccaccgtcgtcgaggccccccactccatggagggggcgcgggatggatgtcgttgagctgttcctgcagtcgagccgccgccgccgcctttgagttgatgctcctgcagtcgagcctccaccaccgccgccacccaaggccagatctggcgaccttaaggccggatttggccaggaggggcacgaagtggccgtcgtcgagccgccgccggtgttgtcgagctgtagatgggaagggagagtggcaaagttggggagggagatagcggtgaaaatggagctttgggcgctggtagccagcgtagagggggcggcacggaggaaggcccacccgacgtcgtcatcgctgtccttcgctcgggcctccccgtcacctagcgccgtcgcctccactcgacccacctctggcgccgctgccgctcgagccgggcggctgccgccctttggggtgccctgttgcccggcgtcgtcgcctccactcgacccacctccgccgccgccgccgctcgagccgggtggcctccgccgtttgcgccgctccgtcgcccgatgccgtcccctccgctcgacctgcctctagcgtcgccgccgctctagccgggcggcagccgctgtttaggccctcctcccccgtctcctggcgccatcgccaccgctccttggctacctgtgggagacgcagagagcagagagagaggggaaagaagcagataggaaagaaaggagattgaaaatactggtgggacccattataaaatagtatgcactgtgggacgcactataaaggactacgagctggatggcccatttagaagaaacaaagcactgcacggcagatcggacggcaatgaacacaaaagaggccacgttttgacgggaaaaacaataggtttattactccgtccatttcgaagacactgttgactttttaacgactgtttgtcttattaaaaaacttttgtgaaatatgtaaaattatatgcctacataaaaatatatttaatcatgagttaaatgatagaaaaagaattaataaatacttaaattttttaaataagacaaatggtcaagtatataataaaaagtcaacggcgttaaatatttcgaaacagagagagtacgatgcaacgaggtggcggggacgcatgcatggccggacgttggaaaaaggctatatgtacagatgggcggacggcggtaacgggagagcgtacgagatggcaccagcacaagaaaaaggctacatggagccagaagggagcacgccggcggaggttcagcggcgacgtcggcgtgaaggaggcgccgtcgatcacatccgacttttggaaagaaatatgtaatgtgcatagctatagataaaatagctttatacccttttaaatcaacggttcatcttatttatactggtagtagtatactacagctcttacaagaataaatataagttgtgaaaaacattataggaactatactttttatcttatttgtttaagttcaccccttcttgttatctaattaggttgtcaaacatgaccatgaagatatggcgatcaactgtctctggtgagcaatgagcaatgtagcagaagctcttcacgacatcgaggaatgttctattggacaatctgtcagcagcattataattctgaagaacaagcagggctagtttttgcatctccatgtccacttgtcggtctagctcctcagctttctgcagatctggaccctcctattttgatcattaacgaagaaaaaacttttgttagaccaccagtattaaatagcacatagaaattaattgaaaacattgtacactgggtaataaatgtgtgataacgtgtgatgctatttgttactccctccatctacttttgatagtcatattttccaaatctaaaaattttatttttgataggcatatttcaattcaacaacctatcatcttaatgactttctcggatttaatacatgactctccattctttcacacaagattggctacatgggcatcgagaaatgtaaatattaatgaatcgcttgtttacgaagaatgattagtagcatgtttaaatggatggtaagtagaattacttatccttagtctgtgtgccaagatgaaatttgactataaaaagtagatggagggagtattacttgtgcaattactctggccgcgagtctgcagcagattgaagatgtgatctgctcaagctgagaatactcgagattcagcgtatgatcgtctggatcatatctggtggagacaatctctaccgtccgaactatcagaagtgctgtattctcttcaggaagtgcattatggcatcccatgtgattcatgggtattcacctgaatacccatataatttaaaaaaaaataactatatatataggtatgttatgcatatatacatgagaaattagaaggaagtacagcatgtatatcccaaatgaaaagaagcccatttattcgcagcagaccatacattcctctccatcttggccaaacgaataggcccactggcccaaaaacgaacaaaaccctagtccctatcccccggtcagccagtccccaccccttctctcgtcccagccccaatccgccgcgcctctagtcatccccaccgacgggcgacggggcatcgagagctcgacgctcggcggcgccggccgccggctcggcgcgtcgccagaatcgccactgcggaggcggcgtggcttgcgacgacgccgccgcctcctcggggacgggcgacgctgagcagctgaggttcgcacggacggcggcggcgctgcggcgcacggtggcagccggttccggcgacgcacccccgcgtcggcgcgtccccttggtccctagacagctggatagtggactggcactggtaaaataaatcctcttgtcaaattccccaagcgattggccattgcttaattgctattgcttagaagttaaattagtcagaaatttgaactggaggtcttgaaatttgaaaaatgaagaagaagaagacaatagatttgaagtctttgtgggaaaggtcaaccaagtctcagaaagtagcttccacctctgatccaaaaccattaaccattgagagtgaagttcagatcccagaaaataccccttctagtcctattcagctactacttgaagcacccaatgcccatgatagtgatatgtccccaagtatacagttggagatagacatcttgactattgtgctactgtttgtacctttaaggctttaaacatgtcattaccactcctgtatgattttcctagtccaattttttgagttctgtatgatttttttttcaactttgaatacccttcgctcaaatcctggatccgccactggagacgctcatctgctcggtttggttcgaagatgtttgctgccgctaggaagaaggccgttaacgcgctcttgtgagtcacaccatatacctcaagatcgttctcggcataccacctgcatgcacatatatattgcaattaattattacgcactctgaatgtactctctctatcccataatataagacgcggtcaaataagacgcggtcaaataaagttgtagttgcacaatctctaaaactaatttttagcttataactagaaaggtagcccacgcacatgcacgggcacgttgctgatgccttgtttaatgttgcttaaatttttatgaataatattaacatgtgggtgattttttttggtaatatttttttattatattctaaatctgtttttgtccatgatttgtttaggattgctttgaatgttggtcatgattttcttctaactaccatatcaacatataaattctacactaaaattatttgaattcataaaatcttgagtttatgagaaaatatcgtatcgtggaaatggagttgattcacatggacctatcatttgtactatacgtgtttttaatatttagtataacttatttttggagtttctaaactttaagtaatagcttttcttgtgtactatagatatctttattgaatttaggatattttaatggaacaaacgttcaattaagatatatggtaagaggaaaattgtatccaattatgacaaatttatagttacttctactgcctcctttttttcatatgcttactatgttcttggaaaaatgaatttaaaattgaaataagagagcaattatataaataaaattagtatatgtagagtatttataaataaaattgttgatgacatttgttgaaattgggcattggtcaatagcatttttggattttgtcatcctatttggtcgtaaatatttgtcaactgataatatatataatgatatactttctactgtcatttgttatataattttcatgtatgtttggattacatgaaaagaatcaaaatgcgacctaaaatataattttattttataagttgaaatatattcaaaacagatagtaaaatataatttaatggtaaataatatgatggtctaaacttcattttcaattgtagagagaatttagttatgcatgtttgtaaaagtgatatatgataaaataatatatgtcgccatttgtttgtcatatatgatgaaaggggtcaatatacgacccaaaaaacatttatttatttattataatttaaaatatgtcagcaccagtttaatcctgtctcaactattacattatatgtatgtaaaaattgtatgcgtaattttgaatttatagttgtttagaatttattatgataaataacaaatattatctcagctactataaaaaagattaaaggaaagggaagaaaacgtgaggagggtcggttgcgtgcatgcagtatgaagatattttataagggttaatgggatccatgccactacaaatatgccattttagaaaaatatcattattattcacgatattggctacgtgccattagaatttgagaaaattagaaccatgccactccatcacgttatccgtcaaaaatctccgttagccccaactgcttttgggacctaactgtctgtttcatcttcacctccctcccatcttttctctttcctcttcctctctctccaccattgtcgtcgaccaccactgacgctgccgccgtcatcgaccacctccgtgaaggcctccggagccactgccgtcgccgatatcatcggccctatccacggtgggaggcttggtagctgtcgccgccgctaccatctgtagtaggaggctcgggagcagccgtcctcaacgccatccacgtgggagggctcaggagcccccgccgttgttactatcctcgaccctatccacgacgggaggactcggaacatgcagccgccgccgccgccgctatcctttacgccatccgcgtgggagggctcgggagccaccaccaccgtcnnnnnnnnnnnnnnnnnnnnnnnngggaggtcttgggtgccgtcgccgccaccatccttgacgccatctgcaatatcgtgaatagtagtggcatttttctaaaatgacatatttgtagtggcacaaaatataagtgattttggttgaatgggatatcatattactacgaatctaaatctatgtccatgcatccaacaaaaatgtcttatattttgggacgggggaatatgtattttctaattaagttcttattattttaatcttattaatttgttttatgtgttttatattgtctagtgtaaactacgtgttgttaatcacatggtttaaaaatctatgtgttaaaaatctatgtgtttttccattcaaaatgtgtattgagtggccaataggtggtccaaagcaatgtatttcttttacttgttaaatacagttaatttgggatttgaattataagttttgttataaatgatctaatagtatacatggataaaaaaaattagctatatagaaaaattttatagttattcaagaaaaattttacaacaaaaatatgtttcaatgtaataaggcatgaaaatagaaaagaggagatgcaccggccggttatgggtgtacgtatgtacagtttgcagcacacgtacatgtacaggccccatgggccttttcttttattattaaagtaaatgcaacgaaggaaaatagtgggtcctttgttaaataaaaaaaattggtgggtccaccttatttaaaagtgtcacgtgtcgaatcaagagcgtttgtaggaagacatatggcggcttaggagtgtttataggaagtttgatgcacttttaggatataatagatagatagatagatagatttctcatgtacacaaaattataaccatatgaaattaaattcaaatcttaatctaataatataatttttaacaaataaaattcattttatattatactaagtgtcagtcaaatgctttattggatggagtagtatatttgacccggtaattattacgcactttggatgtagtacatatgacccggtacttctttcgtccctaatagttgtccttttgtttagcatagattaatatttaagaagagaactctatataacacccatcattattgagtatggtttgggagtagaaggtggtttgggttaaaaagaagagaaatttgaatataatgtaattaatgagacaatagtttaaaaaattgcaaagtagatttaaactattttaggacaattttaatcctataaacacaactattttaggagggggtagtacgtagtaattctttgtttatttccattccaaattaaagtagatcagtcggatggagaggcaggaggcagctcacttgttgatgccatgccactcaagttggcagcgcctctggaaacacttgaaatcagcttttgccatgttgtgatagagatcattgttcacgagtggcagcctgcagaaaggtttaagaccgtgtacgtccagtatatatgaggatgatgacatgataaagagagagtatttcacaattgttggttaattaccgtgcttttacctgtaaagcgacttaccgatccacacatctctgccggcgccatattgctccagatacattcttgtttcaacacgtggcagacttgctttccaggggaagtctagggcgtaaccaatctacgtgtcgacattgatcaatacaatcaatcgacagacattaaattactaattttacacatagtttttggtctctataaatacgtacgtttgtcgtagtgttaattagttgtatacaacctcaatcaaacagtacctctaaagatagattcccatcgctttatgctatagtaagaaggaggcattcctcggttgcaaatgttatgtcttctgttctactgaatgtctcttttgaaagagctttagtaggttagaatttgtttaattggcataatttgagtgctttaattgttcatattcatttgacagaggataatgacgtattttgatggaatttcttcaaaatggtcaattttcagtccattatatgtatttagccttaattaataatagctacattgaaaggaataagtttttatggaaacttaaaatgtctcttaaaattaagatttttatgtggtacttgcttaaaggggtcgtgttaacaaaggacaatttagcaaggaggaattggtatggtagtttgaaatgttgtttctgcatgaaaaacgagtctattcaacatatatttgtgaaatgtcactatgcaagatttctttggagaactctacaattttcttctggtttaaatactccgcttagtatatctcatatgtttgagaattggctgatgggggttgataaaaaaaactagcaaacttatttttgttgtagcatccgctatttgttgggctatatggttgtgtagaaatgatatggtttttgacaagtcaccatctatatcttatatgcagattcttttcagagcaacataccggctccggtcttgggctcaactactaaagtgtgatgaagatataaagttagtgaagactgcatgtcgcaatcttgagtcgacgattatgcagtttttcaccaactttagatcgagattcacaaatagaatttaataattttgttaacttctcatgttgtgtgcgtttttagtagttagtgtgttcctgttttttttaagactgtttttttattctgttgaattgttgtaataattggctgtagctctctgagcaacggctggaattctattccattataaaaaaatcaaaccgtcacattccgagacaactttagtggtaaattaagaggagaaataatacgatgttcctaacagaaatctaatctagttttcacggatggatagataaaacttttcgaatcgtggacagaggataggtattctaatgaaatgttagttcaagtttttttaaaaaaaaacttttaccgtacttctgtgtataaattgtgatggtagtttcagccttcatataccatttttcgtacttttactgtatttgatatatgtgtggttatgggcaattttagatttcactgactctgccactggagcaatatatatgtatagtgtaactttaccattcaacatttggtacctcgaaatacctgatactactctctctccacctcatccatgcacacatgcatgtattttagcaagcttcaaaataatttttcttttaaattatttattcaatccatgatccgatcacaccattatattcgttttaattaaatctttacaataagatatcgcatgattatattttgttaaaagaaaaacacatgtttcaatccgttaatacttgttgtttcatacgtgacagtgacatgtttcaacgtgtatcttcaccatgtttcataaaatatttaaatgtttcagttgctgatttttttatttcaccatatataacttaatgttttacttgttggtgaactgcaatatttgatcgttcaattttttttaggcatcggacgtccgataggtagcttcctccatacactactacagaaatggatatacaagtcagcactataagtgtcgaaaatagcataactagcacctatagtattttttccacctccacaggctgaaaacacacacaaaaaaaactaacaccttcaagcgactataggtgccggttctttagaaaaaccaacacctatacaatagatgctgctttttttaaaaccggaacctctagtgtattataggtgttggttctttaaaaacctggcacccttaaaatcaggtcgagctgaactggtagcctcctgtccttagcttctccttctcctcatctctctattattacgctccaccacaccctttcctctctctcggctctcactctctctctcgtctctctctcttggcgccagcgggaggggaggagcaggcaacgtcgtgcagcagcgggggggggggggaggtgatggcagtggtgggaatggcttcggcagtggtgagaacggcttcggcagtggtgggaacggaggcaacggcagccggtgacgtcctctcctccgccagaccggcagtaggggagatggtgacagcagcgttcggtgatgggaaggagctagcaacaacgacgtgcggcagcgggatggaggtggccgcagcggcggacgacggcagcaggcagcttcgccctaccctgtgccagatctggcaggaggataggcggcgggagtgatgtgcaacagcgggaggtaggaggtggcaacggcgagcggtgccctcccctccgctagatcaggcgggagggaagctggcgggagcgacttgctatggtgggcggctcccctccaccaaatccggcgagagaggaagcagtggcgccctccgcgatgtcggtcagcccattcttaatgttttactgttccttttgttcttgagttgttgaatgttcttgtgttcttgtattttcttggattggtcgggggtgagggtacgaaggggagctgctcgatgcattggctcgtctacttttttttttatattcgtggaacctcaaagatgcgctatggtatgatcgctcatacacatgaagcgtgggtgtacgttgccgccgtcgccgccatcgtcgccactggagtgtgtcgtccatgactacgagacctcactagtgacggatgtaatgagatgatcctcaaagatgggagcactcatctgtgactgggtcattattactagcattgatggagaacattatcggtgaagcttggtagttacaaaacgttatgaatgagggaaaatttaaatttttgaatttttcaagcaacctcgtatagagatatacttcacatgaaagttgtaaatctcaacgagctgagctctgcagcgcatcaccttgttctgttcagtcaccggtgccaatcacagcaattcttcgccatatggccatatcccagtgtgtccttccatatcttgcatctgcatatatcttaattacctagaccatagctccgatttcactatccaacatccatactccacataccaagtctgttggttcaaaactaggagacattggtctaactaggagaaagctttactacacccaaaaactagctcaagagataaagaaactcttctacttttaagttggttcaatccctaatcaacaaatatgagactattcccgacataggaaagcttgcatgctgacaagaccgagcacgatggccaaccacttcgcctgtttcctgttgtgtaacaaggctttgaaatggatcatgtacttggaccttccaacatcacaaatttaacccaaccaccacacccagctgccaggctccatccatccaaaatctgcaaataacgctgcctccctcttacttaattattcatcatgtgaacgttcttatctgtgtttatgttatggatgtgtggctagctgtagataacgggactatatgatatacactcgagcagggacgaattgaacatcggtgcagggcggctcgagccacacctaccccattatattggatccccatggagaggagagaggggatgggtaagtaaagtatatgggctcgacgaggaagcagatgatgagctttcctcctaacttattctagatccacccctgcactcgattattcgggaattcagtcccaaagtgccaatgacgatcaaagtcagatatcaaaagaattaaagaaccaacagcatcagttgagaaataacagaaacatcagttgcctgttgcttacttggagagacactatagccatgcaaccggagtagacgaaaagccattgacccggtatcaatatccttcacagagctgtgccagttgtatgtcacgccttccttagtccaatgcctgttccattagatttataacattaatttgacaagtcaaaatacgtattttggtacacaatgtggtcaaatgatcacctgaaggtgtattctaagcagtactcatcaatttcagttttgaagtagtaagatatgcctagccgctccaaccggtcgactgcccatacgcgctcaaatatttcgataggatagagaaatggtactcaaaacattgaacagagaaacaaacaatactctattaacgactgtttgggtggatcataataccgtcatttggtcgattcacagaaaggttaatgctacaataatttttttcatatctggggcagtatgaattgaatgcatatctggacaaatccgattgaataatgttacggctatcaaaaatgatatccatttttttcaattctggaactgtacagaaacgaactttgcatcaaataggttctattcaactagaaattaaatgaagtctcgaatgagaatttatttataattgaaagatcattatttacctcccccatggaatttgctaacaattccatcaaggaactcgagacatttcttgtcgcccgtttgcatcaaaacataggccgttgcagcgggtgaggataggaaggatccatctgaaagttggagcttgaggagcctcttccagtccaagcctcgcagtccctctatgctaagaagcaaacttgttggtagggagtgaagtatttctcttgggatcctacgcaaatgtaacaaaattattaatgtgtgtgtgtaaattaaatacatatgaataaattggagcctttccctattagaaacaggtatgcagattacttcttaagctttagctccctttgggcatatatcttgtgcaaagcagggtcatcataagggatgtcaagagccaagtccttggctatctctaaaagtgaggggaaggtgatctcaaaaccaactggcatccatgcctcttcctcttgggccagcctccatatattttcccgaataaacgacaaacctaaaatcaaatggaacagtcttaaactctctgaaaattaagatcacaatacagttacaccgaaaacctcaaaaagcctctcatcgtaaacagattgatctgccaacactatggtacctttctcacgcttgtcaccatgaaccttccactccatcagcgcaatcacacaagctagggtgttgaggagcctatcatgaactagaaagcacaagtcatcaccccatgaaccatctggcagctgattgtgagagatccaatcaatggtcgaggggaattgtgggctgtcgctgccgttatgattcttcacaagtgcgacccacgcggtgtcataggcagaagcacttatctccccatcgcccattgtccttagcattactctgatggtattgaccatttcttccatgtcccgcggttcgtcctggataaatatgcaaatcatttctttttcttaattttctatatttttatgactatataattagaacaaacaattaatgatcaaatatatgtataggtaactatgttaatgttctaaacttcatgaaaaaaatccaagggtctatatttatttttaataatagaaaacaatataatccagcctactccatcggccaaaaaaaactcaaccaacccctcctaggataatgaatctagactagttagctctaggttaagtttttttgggacggagggagtacatcaaccaaccttcattttttataatcaagaatattaagttgagaactgaaaaaagaatcaagaaataccattaacatttgtgtacgcctgcactaatcctattacaaaacagaaaggaagtataacatagagctgtaaaggaaaaaaagatgggaaaagtagtctgtgcaacattaatatattacttttccaccgctcctcctgtcaactgtttcttgtgtttctttggctttgcaatatactattccctttgattgctctttatctacgtatatatatagagacaaaaatgttagaataccaatagtagtttagaaaattaagtaaacgaaaccactagctatattgatcggattcactatcccttggtatatcttctactgagacaaaacaagggatgagtgttgttaaagacaatgtcgtcctcgttaaaacgatttagttaattaaactccatttatatagtggtagagcatgtagtgcgaattgcatgactgcatacaccctttatgaacaaaaacaaacattaaagagccgtctcatctaatcaattttccaatgaactaaattgacttcctactacacccagaatgcctagagctaccttgaatgaatcaatgaatgaaaacatcacaaatcacagaaaccgaatcataagttttggcacgatacacaattgcgtcactcctcaagttagaattaatctactacccaattaccacttttccatacacacaaatcatttacaagcatcaaccactagtacagaaacctctatagttatcgattgggaactggctataggtgctggtttcccaaccgacacttattgatcggcgcctatacctcaatcttattagtgccggttaacaatggcacctatacttccgctggctgccaccttgcccatacgctgcactgaaggagggggaggtcccccaggagaggggaggccagcgagatccggcgactgcgccggccgccaccacacgttgtactagaggaggagaagggaaggggggaggtccccctggagagaggaggccagcttgtcaaaattactgataaaactaaatatattcagtcatcagctgcccgtgtcgccgtcggctgccgctacacgcgtcctacgtggcgctctccgccccaccagcccacctgcctgcgtggtttccccgccggccgccaccacaactcgtggtcgcaagccatggccgagccaagtcctgccgcctagtaccagccctagccgaacgagctattaggattgggctaaaacagatggcccaactgctgttggagtgagcttgtgttatgtcccatgtcgtccccatctccccaatcagcgtccttactgttcttccccgaccactcaacgttgccatgactgattttgctttgctatgagtatgggatattctttttttaaaaaaaaatcagaggataggctagagcctgatggagcctacctactagattcatccctgcttagtaggttccatgacgacccaacatcatcatttatccgctttgctacgtggcatgtccagaacggttcagacttctgcactgccaccatggattcagactccatggatccatctggagtcggtaggactgctgattcggcaacttggaacagcatgactgttgcacgatcaagatgaagtggcgcctgtgccttatagttagcgagtggcacttgtgaatcggcgggaatcttaccggggagcgggagtggggagtgcgtcaagggaggacgagttggattctcatgttagagcatagccccaatcacaatcagtccaaaacatagcaagcaccacaagaaaatacctaaaaaagtcccaaaatccagaacacctagacgaaccctagacctaaaaaacagatcaagaaatctttcgccttaaatcaagggttaatagatcaggcaagatatatctattgcataaatacaattggcaaatatcaaattatttaagtgggatctacgggatggcacattaaaaccaccggattgcaggaggaaggcggcctgtgattttcctgtgcggttcttttattttgttttctttccgtgcggcaaaaattccgaatttgctcgcgttgactgggctgaaaaccaccctaccgtggacggggatggatcgcgtggattgggccggctgcaagttagcagaggacggacgaaagtctgataatgcgtgcgcgatcacgatgagacggacgaaaaagatgtgtgacgaacaattttgctatatatttatcgataaattttctctcaaaaaattaatagatgtaaccacagtacaattatattataattatactgtaacttatatgtaattacactataatttacatgtaactttcacataattttgaaccgtttgatttgttttaatatttgtgtaagtgaagaaggaaaaaaatcactgcacgcatatatgtgagagaatttgttcccacgacctccatttcatgaaaataatatgttatggaaagatttttggaacttacgtgcaagttacatataagttacaatgtaattacatcatgattatactataattatatctgtcaaatttttaggataaaatttatcgataaatgtaaaagtgatcccattttttaattagttaagattgcggggcatcacaactgataagcatggtatgttgtcggatgcagaggggttaaattggcgacccatgtataaacatttttgatacaaactttgctatagattgaatttcagtcgttcactttgcaatcaagataaataagattggacaatggtagcggtgaagaaaataccttatacgaatctctatctctactattataaaaattaaaaatgtttctgccggtactttggtatgtcatccgtgtatggatcggtttttaaattcattcgcttttagaaatacagaaggagtcgtataagaaaactcgcatactaaccttagacgaatggactcctaactgcagctggtgatttttaaaaaatatatgtatccaagtgaattcccacagtaaatttcatcttaactaaaccatataaaaataataagattaaaatgattttcatccgttgcaacgaacgggcttctttttagtaattctaaaatcgaattcttacaaaaaaaaacataagtaaaaatccttttagaaaacgtagtgccaagccttaaaagtttgcaaggatgttttggttaccacgtggacgcggagcgtgcatacgcgtatgatgatctggtcgccggcgatcccacgccggggaccaccgccggcggtcgagcaacgccaagtgcggcggtgcatttgcacaaattagtatctgcatgggcaatatccgagaaagtccgtatggtcgtaagtttagtgagcaggatccgtcaactggagggcccgtacttaaaaaggcaatcgtccaagctactaggcaaattgatcaacccaccagtgaacgtaagagactacgagccacacgtatggcccactagcgaacgtacgacacacgtatgtcggcccactggtgaacgtacgacgcacttatgggtcttttcatcgcgacgtacataactttgactgaggactagagcgtccaacggataagttccaagagctatatatattgtcgtttgttgattactttgatatactccctctgttttagcttataaaacatttcgactttagttaaaatcaaagtgctttaagtttaactaaatttgtagaaaaaaatagtaacattttcaacctaaagacaaatttattatgaaaatatatttaattatgattcgatgaaactaatttagtattataaatattaactatatttgtctataaacatagttaaacttagaaacaatttgtctataacctgaaacacggaaggagttgattttttaagataatggaatagaacatccctacatttgctcaaaagagctacaatcacaacctaacacatgtagttcaaataaatataaaaagacaccaaacataaataagaaacaaaccaaaacaaccaatcaagataaggagtgcacatttattgaattctatttgtgacactccatttgaaattggcaaacagttatataactgttatctcaaggttacgacagtcaacttttagaaactctcgatattcatcacactatgatatagatatgctacctcggtcccaaaataagtatagccgtgggtatccatgtccaacgtttggaccgtccgtcgatggtgatgatgtcagcgacgatggc

SEQ ID NO: 15361 - DNA, 4395 bp, Oryza sativa
gcggccgctccgccctaaccctcccaccgccgccggacctcacctgccgccatcgttgctgacatgttggatagagagagaagagatgagagagagaagaggaggggatagagagaagagagataggaaagctaacatgtgggccgaaggctatttttgacatttcacacgatttctctctccaattcaaccataaattattatattaatggttgcgatgtccaccagcaaatatcaaacttttgggagtgttttcccccaaaagtcaattcatgccatatcctgtagcaaatttgtcaaatatttaacggagtcgctaacagggctgatttaaagatcacagcagtgtcaaatttgacttagattgatttggagataacctccatcttgtgggagaatcacaaggtttacgtaacaaacttacgaatgatttacaactcaaagcgacaaaattgggagagctaaggtaaagtagaaaacatggctaaaaagtaaaaagtaaaggtaaaagaacttgattggagtgcaaactattcaattgggtatcaagaacaaaattgaccagttgaccaaggaagtaaacatgcaaactagctgatttggactcggtccgatgttcggaccggccccatatggaaggctcaaattctttccaaatatgaccaaactttgccatattttgttcttgatacccaattttattgttaacactaactttagcgcactaatctgaatagttttatttaaaatatagatgggggcagagaacaaagatgttcactcaataagaacaatcaaacacaacacatattgcatttatagttcaatcacataactgcgattgttattgtttacagtatgcgtgtgttgtaaagagacggtctaatctgttagacgttcacaccttgttattactaattttaatggtccatgactactttaagggtgtaatggggtcttggaggtatggtgttggaacaaattccaatagccccaacgagcatagcaggggctcccccatctatcagagagagccctagctttgtctccctgaggagaagatccgagaaggagagtccttgtataatggatggaatgggcgagatcctcctctcccttgcaagatggcaatgaggacccacgacccgatacccgatgggtttttaccctattaagagctaatcatgtcctaaatcttatacccatgggtctactaacgggtaaaaactcttacctattgggtccattctttacccacccgtacccactgttggtaattcttacgatcacaggaaaaatctgcaagcgcacggatataccgatgtagcacttcccccacggagtattccaagggtatcgaatcaaagggaacgtgtgtggtcagatcttcctccggttcatccaaggacaccaagcaaaggatatgacaggatggagaggatttactggtgagaaacagtgtctaggaaaagcttaagtttaatcctaacgcaatacttcaggcactggcaacccgctgtttccagatgtcgctctactacgtacccggacagcgagggcttaagtgatctcgatggctgtcaacatctctacacatatctcaaacgtactgtggaatacacaacaattattggataacaattacctaaacaccacgtctaagcaattaatatctactttagtttttataactcaccaaagcaatcactatattttagttgattatagtgaacaataatcctgtatgctatttacgaactaaccaagagataatcctcacaagataaatctaaattactcacgaagaatattatattgaaattagagtaataaacagaataaaagaaatgagagaagattaacgacaactccggaattcttccgacttcttctactctactctcttcctattatagtatataatatagtacagtaaaacatcttataattcagctcaagcttggaaatatgtgtgagtgaaggaatgaagctccttatatagaggtaggtatgacggttatccctatgtgaattgtctgaattgccccgcaaccgccatcaggagtgcattctggaccgtccctgccaaaccccaggatcaacggcgattagaggggttcggccgaacctgggctgggcccctctggcctggcttttggcccatctcctcccctggtctttttctatccatttctcagagttttgggctgattctctggtattttgatgaagtccacaacccatccctgtatggatacatattttctctcactttagtatgattttcctcccaactttggggttcattacctgcatacaaatatacaccaacatttgtggaatatgtgagattaaagttctatcactgtgttggatattttattatctgaactttatgcagatgttggcggtatagaatcggcatttaataaccgctaacacccaccgacccgtgggtgaaaaaaacccataagttgagcctaaaactatgagtaacacaagtctcaacgactactaaatcatagcataaaactcttttcacatcttaagcattgttctagtctagttatatgaaattattatttgatttattgattatgtagcgtggttctagaaatttttttactcgcctttgaatgctaatgttaacaacattgttgctagagaaaatattgatggtttacagttctaatatggctaattaaattacaaaattataaattctataagtcaattatatgggtaagagtactcgttggatacctattacccgcacaggtgtgggtatggggatgattttgcacccgcgatggatgtgggtatttaaatgggaatatttagccatcgcgggtgtgggtatggggtaagggaacccgatgggtatgcacccattgccatcttgcctttggagggctccttttattcatatgtagtaggaaattacagtattacccttaatcggttacattgaaagggtattgccttaggggtgtttttgtccattactatactagtttatacaacaccctagctatgagggtcttttccaacgatgcaccctaggcatggggttattccccaacatgtggggtgacacgggtcgtagtagggtcggtcaacccatcttgtcaaatgggtaggtccacccctgctcgaggaaacataattagagaccactcaaaaggattttccgttaggctcttcatcttatactgtcgtcatatactgtaatggttctgaactagctagcaatgcacgacatattccaacaatttttagcatgcaactttccaagtcttccgctttcagactctcaaactttagcaatacactaacagatttatcaaattctgaaagctttagaaacaggtttttttcttttactgtgatgattgttcattctacattgaattaagcatccgaggaaaataaacttatgaagataaatagagcaatgcgtaaatagacttgcgactagtctttgatatcagtcatcgctgctcaccccaagctattcaacttggactttcagttagattgtgtagttgatctcatcaacttccacatcaaagctttgttcatgatgaacatcgagattatcgatcgtcaacgtgcacattggtcctgagtagttcaagattgagttggattgaaccggttcaaagatctctagtcccttcttgagatccttcgatggtttagaggtcatgtctctttgtacccgatagccacttctctcctaatgcctcccatgccaacattgcagatatgtatgtattatgtaaacaaagtaagttcatgtttgggttaccattttgtatgtaagagatattaatagatgtgtggttcttcagatcaacatactaaaaagatgactgatatgcaactagctagaaataggtatatggctatatgccttgacagtaataaatgtgggatttcaatatttgtctagcatgtttatgttacagagattctagatgtttaagaatgagaggaaaaaataaaaaaaaggaagagaaggatggaggaggaaagagataggggactaggaagaaaaattgttgggggagctaggaagatatagtttcagcattttcttccagaacaaagaatacttgggttgtattatgtagcttgatagttaattacatctagttgggttggaaggaaggaccatgtttactgtgtaggtaactacacaagtgaacaggaaaaatgatatatacgagtataggctgatatggattaagtgtattcgtgaaaagggatgtagcctagtggttgcagtgaccttgagtagcagacaaggttctgagtccaaatgttgcagtatagtaattgtagtgcagtcaaattttttgtttaaaaaggcagcagtcaaaatttttgttt

SEQ ID NO: 15362 - DNA, 6401 bp, Oryza sativa
ccacgtgcacacttttcaaactgctaaacggtgcgttttttgtaaaaaaaaattctatacgaaagttgcttaaaaaattatattaatctatttttaaaaaaattagcaaatacttaattaatcacccgctataaaaaaattctatacgaaagttgcttaaaaaatcatattaatccatttttgaaaaaattctagcaaatacttaaaatcactcgctaatcgctgctccgttttccgtgctaggtagtgagagttcccacccctcactcccgaaagcagcctaattgtgtaaagtaatcgttcttaacaaaccagaactgtgcaacacactgcaacatttttatctgatttatcgaagtatcttccacttaatttgcagactaaaaaaataatgcaataaaaattatattatctgatttatcattattggaaacttttacaaatagatgatgtgtttatctggtacttgtgagtgcatgagacaatgagttatagtatcttcaaaggaccgtaaaaatgtggcacaatcactgccaagtgccaacaatctttctagatgccggacaagtgcagaatatatgcagcgtcattccaaccctcaaattttgatactgttatactactcccactactggaaaaagaatttttcccgatgtgcggtctttttttcatagacagacataacccttggagtcaaatgaccgcctacaaaaatataaattggggtgaagttcgttgaccacttaagcggcgcttgcgaaaataattttcgcaggcagacaatatattttcacaggcgcaccttatgtgatccgcctgcaaaaatcgtacctacccaaaaaaaataaaaaaaactttaatacttatctactcctccaacccctccccaccactcatttccccacacttatcttctcaactctctctctccctccctccactggattctcagctccccatcccctcccctcccttcccctctctccctccaccggcggcggcggcggtggcagcgcgtgcggacgaggcggcggcgacgacggagcgcgcggacgcggtggcggcagagcgcgcggacgcggcggcgacccggtgtggcggcggcggctccctggcctcccctcccagatccggctagagggtgaccgggggagggcggcggcgacgtgggcggctcctctcccctcccagatccggccggagggaggccgggggagggcggtggcggctcccagagcggcggcagcgatatgggcggctcccctcccctcccctcccagatccgaccggaggccgggggagggcggtggcggcgactcccggtgcggcggcgaggcaattttttttattttttcattggattttcgcgggcgggccattgccccgcctgcgaaaatggatgattttcaccgtcgttggtctgcaggcggttctcccctctacttgcaaaaattgcttttggcagcccgcgaaaatgctttttcagtagtgtccttcaacagacttgatgcgatcttctatacaatgattctactgcgcttcagtacatatcttcagcaaatgtacgcaatgcttgcttcgcacttgggccgatgcattatttatactagtttcatgcccgcgtgttgctgcaggattttgtggtaatgataaacaactttataaatatgtgcttataaacataattgaagaattgaacattctaaaattataaagcgtaaagttggcatgtgagtagtagatggacaagggacacagcagtggcttaatatgggggatgcatgcatgaccggagcacttaagtgggtcatccattgatgtgtttaattacccatgacagtttgcttacttaaagcctgcatggctgttcactatgctagatcctcacacctttgatgacatacctaggacgggcatatataagtgctggtcagtgatgagggtcacctttaacgagttctacgggatgccgtcatcggtgagccatccggctatggcccgttacaggtatctagtcactagtgacgggccatatagatccagcccgtcaaagatgttatgaaaccatctttaacgggtccgagaccacccaacccaatccttatctatcacccaccgacagtctgagaccactcatctctcgtttttttctttcttccttatccatccctctctctctcttttctttctttcttcctcctccgcacgcaccgagcttgcatgctccaagcaccgggtctggcggcggcctctgactccacgcgctaatagcggccacggccggccgcttcctcctccgcctcccgaccgccggccggcactgcctaccccgaccgcctcccgaccgccggccggcactgcatacccggccgcctttcgaccgccggccaccggatctggcttacgaggcgcggatccggccaccgcgggctctccccccaccgccagccacttcctcctctgtctcccgaccgccggccggcgctgcctcccccgccttccgaccgccagccgccggatctggcctatagggcgcagatctggccaccgcggcttctccctccacccccggccgcttcctcctacgcctcccgatcgcaggccggcgccgcctcccccccgccttgcggccgccggccgccggatctggcctacagggcgcgaatttggccaccgcggcctctgccccaaccgccggccacttcctcctccgcgtcctgaccgccggccgcagccacctcccccgcctaacgaccgatggcctcgacacgtttgggggacacagatccggcgcctctcccccgaccgccagtcgcctcctcctccgccaccccacctccacctgctagatccgacggcagcctcctccaccgcaccaccaaccgttggatccggcggcctctaccaccgaccgccggtgtcgtccaccgtctccttcacccgctagctccgccaccatttccaactcttgtaggttgagcaaattttcgttgccaaatttcagattgggttatactcatggttgcttgtgtggatttgtagtttattactaaatgttgtctggatttgtgatatatattacttgtgtggatgtgcttcatgtgtcaacatatctatcaataaaatgcaaagttattgtgtcatgagatcttgagatgttcttcatgtcatgagatatggcctgagggctgagagctgagagctagaggctgagggcttttgaattgtttttttggttgattttccacacctatgacggctggtaagttgaacctatcagaggtgtttgtcacctttgacgggctgaaaagatccactcgtcacaggtgagacagtctcacctgtgacgggttattttattcggtacatcagaggttccaatcatcattgacaagctttcacccgtttgagatgaggtgtagtcatcagtgaccactaatctgtgaccaaaaccaaatccgtcaaagctgagggttagagcccgtcacagatgacgggatctggcctagtggttgaaggaacaaatgcatgccagttaaacaaagaaagatgcacttgatctgacggctattggttattgatgacatggcttaacctagaggcttctttatagtgttaatgcttgtagtgggtaccaactatataggaagaatggatacacgggcgtgagaagttgtcatttggtttgtgcttctattttccttgttcttacccatacccgttatggcatggtcaaacatctccgatgacagggcattatggatccctggttcactgtgcctccccttcctagctagctgatgttctgatatgtacccttgttgtatgacgcgtccgtattgggacacggtctacaccaaagtgaagttgtatgcatctgccatgtaagttgtgagctgtctgtgcatggaccactaggagagatatgatttttaataccggttctcaacccctattaattctggttgtagcaattgagagaagaaaaccgagacaaacaagaaaatggagactaaagttgttgatttttagtaccggttgaaagaaccttttcaaccgatactaagatatatactaagtcaaaaaaatatgtaggatgtgggattccaactcacgatctcttatcattgcccttaagagcattaccatcgcacatactacacacatctgagttctctagtagtggacccttaagtaaggggtcattgtaacagtcctaattcatttaaagcccctgcagtagtggtgtggttttggcccaagtgaccgaggagtagatcgattagtcacatacttttgctagtttcatcagtcgtgtgggcatgaattctagcaaacattatcatcctgatcttttggcttatgcttatacttataagccaaaattttaatttttaaccttaaatttagagttgattttagggcttttttatcgtagtttatttgttagcctttgctttaaataactaataacatgtagataaaagtttcatttataaatcactttccgttgcaaatttgccgttttgcttattctgtcgataagcaaaacgatggagtcctaccaatatgtatatggtaacacacattccaaacaaatttctatgcatattgaggtttccgaggaaatgtttctaatttatcaaatgctaccagcctgcgagctttagatatcagactacgaaaatacgatgttttctatggttctttgggtgtgaaagtgatattatgtttgatgaaatgtagaaatgatgtaattaatggcattgctaataatcatgctaactaaaataatcgatatgcatagttcttgcacaacacaatatcatcaacacaagtacattgtacgaccctgtgccacagtattctcaaagccttctctatccgtcggtgccgatgcatgaccattttggccccatcgccttgtatttcctaggtccgcccagtcctagatcctattttttgtggcatgcatctagagcacatgtttattgatcttagttttgaaaaccgtagtactcattcttcatcattgtaccactcttgctcgactcttgggacaatgatttatatagctgaaaagtttagtccggctttatatttttgtgcaaatgaaaatcgatatcaatgtcatcacatgttaccttttaaagtgctcaattttgtatattacttgtagagttacttatatggacctttcattcaacagtgttttcgattaatataaagcatgacttattggtggctgactgctacttagttatctctataaattactagtgctttgagatttgtaaaactatacttggagaatatgagagcatcattaaagtcaataaagggccagccaagatatgtgtaaacatcgggtaaggattctctaacataatatcattatcattacagtcactagtatatatgtgaatctcaccctttgtggtgtgtgtagtttttacctttcctacacttttcgtatcaattcctccctctttccactttcaacattttgggagttttatcatataattgaattaaattgtcttagcattttgcatttgctctcttttgggacctaaaatccccgggctatcctactaaacatatattcccaccatacggaaaaccaactcaatcttcaatcaaaatgacccatcagatttgttaaggtggtcacgttagaactcactttttagtttcagtattttcttcagaataacatcctttattaatcttggtttaggaaaccgcactactgctttggcattcttcaccagtgaaaaaactattgctcaattattgggagttgggacaatgctttatatagctgaaaagtttagttttgtgccatttttctccaaacaaaaattaatattaatatcatcacctttctatgctttaaagagctcaattttgtatattgtttaaagacttgcttctatggtcctttaatttaaccatgctttggattaaattaaaacatgatttaggagtgactgagtgctacccttttctttagataatggaaataggttacatctctagcctctgcccgtaggcacacaacaaaaaagtctagaagtgaacagaaaagagctcaaaaaaggcgagatgggacaaacccccaatttcagccgattatatgatctacaaaaataatgttttttaaaatcacgtagattcaaacaaaattctgtaggtactacaccatccaaacaggaataaaagttccttggctaccaattccaagcgtgtagcaccattgcgcatagtatcctgttgttcctgtaaaagcatcatacaccaagaggtggagccaattggaatacatgaagataacctgcatgatgttagcctttttttatgtttaaaaactatatcattacggcaacaccaaattgact

SEQ ID NO: 15363 - DNA, 22277 bp, Oryza sativa
acaaaaacaacattgcttgtttcccctccattttctctttatgaggttatctttcgtcaagattacttttttgtgaagaaaccacataaaaacattgatttttagtggtacctttaccgcccataagatcgtcttgcggatccttacattaaaattgatgatcgcattaaacatggatttgaccgaaaaatagccatttttatgtagcgaccaaacaaagcaaaccttttcatttgacagggttatgttagctagtcgagaaatcaaatcattccactcaactaactttggtcctacaattgatcgtcggaatgaaacattcaacggtattgtgctcgtaacctctgccaaagtagaatgtctctttcgaaccacaatgtatagagaaggatattaatatttgacagattgcaagcccaaccatgtgtcttcccaaaatcttatgtccatcccattaccaagtttaaaagatccattttgaaaaaaatgatcttttactttcattaggccagcccaaaattgagatgttcctggtttgtgtgacatgtgggagaggggtttaccctttaagtacttgttgcgtaaaagatttttccataggccatcaccattaacaagcttgaatagccatttgctcaagaaaaatctattcatgatatcaagatttagtacacccagtccaccttgatcttttggtcggcatatataatcccattttgttaacctatatttcttttcctgcctatcactgctccagaaaaagctcgatcggtagtaatctagtctttgaagtacacctcaaggtatttcaaaaaaggataacataaacatgggaaggcttgaaagaactgagttaagaagaaccaatctccaaccataggagttatttttgcctatccatgtgctaagttttctttgaaacctatcctccacacatttccaatcagaatttctgagttttcgatagtgtatgggaattcctaagtatctgaatggaaaggaaccataattacaaccaaacagttgtctatattggtcctccatttccttagctccctcaaaacagaaaatttcgcttttatgaaagttgattttcagccccgagagatgttcaaacacacaaagaatggccttcatgttttttgcttgttaaaaatcatgttcaagaaatattattgtatcgtcggcatattggagaatggacaaaccatcatccactaagtgtggaattacccctctaatttggccatcggctttggctctttcaataagaatggctaacatatcagccactatgttaaaaagaaatggggacattggatccccttgtctcaagcctttgcatgttcggaaattttttcctacattatcattgactctgacacttacagttcctccttcaacctagttagaaatccaattgcaccacgattgtgagaaccctttcattcgtaatgtctgctgaaggaactgccatttaactttgtcataagcctttatgaagtcaattttgaatatgataccatcgatcttctttgtgtgtaactcatggacagtctcatgcaaaatcaccaccccttccatgatatttatatctggcaaaaacctcgtttgggttgggcgaattactttgtgagcaaccgttgtaatcctattggtgccaacttttgtacaaattttaaagctgacattcagtaggcaaataggcctatattgttgaatttgttttgcatcagccttttttggcagtagcacgatgatcccaaagtttaggcaataaaggggtaatgtccctttatgaaattctctgaatagagccatgagatcattcttaacgatctcccaaaagacctgataaaactctacaggaaagccatttggacctggggaggagttatgatccatttgaaaaattgcctctttgacttccttttatgaaaattcagcagtaaggatgttattttccaagtcagacacttgacgaatatcaccagtccatccctctgtcatggatacatgattatgatctggaggaccaaataaacctttataataattggttatatattctttgagattcccatcacccgttattatagtgtcctcttgttccaaccgactgctacttaagtacttatatcctaaaaatatagatgctttaatatggtatgatggacttccattcttttttacggaaaatggattaaaaatcccggcctctacatccatgattgacttccatgctttttcaatttcgattatgaggtaactagtaagaatgtctgatacttggacacataacctaactagaatctgataaaaaaaatgagttgtgcaagggagaaaggaaagaatatggagaatcacagcatggcataaccttaattaaatcagaacgtcgggaccttgctagagagtgatcaaatcaggatcttgctgtcttgtatgttgcgattattctattgtttataatgttaatcttttgattggttttattcttctcttcagtacttgttaacttagggatattttccccagtaaactaacaataaaataacacttaacgtaccagaattatcctattttagtatatatatatatttggatgaccaggatgtacaagcattaattaagacaagataaatcacatgagtagtcaagacagaaatttcacctgagtaatattgttattctatatgattcctctatgtgtgcaatactgttgtgtgctactgttgagtcaaattgggatgttggggtagaacttatgctcgaatatgatttgttgtttcattcatgtgtaggtgtgtcttgatgcatcgggagagagttgccagtgatggatcgggcgtcaactgagaagaagatatcatctaaacggtcaaagatatcatgtgggataattagattaaagaacaatgcatatgtgtcatggttatggataaggcatatcttctacctcacaacttacggaatatatggatacaacatacctctgtatgtacgatatgtttccgtatatgataagaaaatctacaagagattataaaaataatcctcgcaggcaagtgaataacagagtcccactcggtgaggattaggattgtactatatcgtgttgggttcggtatttacgagttctacttggagataaaggtaattcacggtataaatagcgccaacatcaccaccatagcctacaatccggaggacgtgaagtctactcgctaggagatctcgtcaaaaccatctcgacaaggatctcgctggtaatctcgggatcgccggtcttctattgtaatatgtggtttttccgtatcaatctcatataaactggattagggctattaccttatgatgggcctaaatcaatataatccttgccttcctatgtgcttgatattctatcgtgtagatcatcgtaccaacgtaccccaatatcctattcatccggtctacgggtactccccgtcgacaatatggttgatggagattccatgcttcatacgatgggagattgtgtgcatatgacatgagtcatgaaggagtccaaattttggaatactgaattttgaattgggaagagataagatagtttcttgtacgggaaggcttcctagtggactagaacttcttcaacaagttagatacatagttctagagatacatagttctagactgcttacttatctcggttacaaattgagggggttggggttgcactttctaaacacagatagaaacaataaagttaaatctacttttacaaaattattttacttttatttctattttttaccttattttatcctatttctgtttggtcctatgtacacaattaacctgagaagacaacaatgcaaatgttgcagaaacggctccggatgaccaggcctagagctgactggactatacaggccagcatgcatggtgtcaccagtgcacatgccaatgggggttgctagcgcgcgtgcgcgcgccaggaaaggagctggcgcagcgtccctacgtatttcttttgttaccttttttttcaatctcctattttggtgcatttcctttttttctctttttttttctcaatctcctattttgacgccaccgtttccttttttttgttttcttttcagatatttttaattgttagcatgcatatttttgaatgttttgaattttgttatgaaaattttcaaatttaagtaaaaaaatttgaaatttagggtgaaagtttataaatttgagttaaaagttttcgaacctgagttaagttttctaatcttgacttgaatttttaaaaatgtaagttgaaagttccaaatcttcagttgaaagttttcaaatccgagttgtaagtttttaaattcaagttgaaagttttcaaattcgagttgaaagtttttaaatccgtcctgaaaattttcaaatccgagttgaaagtttctaaatcttgaattgaaagcttttaaatccaagttgaaagttttcaaaaccgagttaaaagtttttaaatccgacttgaaattttttaaatccgagttaaaagtttttaaatatgagtttaaaatttcaaaaaatcttgagttgaaagttttaaatcttgacttctatacgcgtgcagtagtcaacagaaaaaaaaagaaacgcgacacttgcaagaaaaagaaaaaaaagaacacacgtgagagcgcgtgcgctcggaagatgggccgtgtgggccggcgcgtgcgcgccaattagcttttctgcatgccaatagccttttctttcttttgtttttctttcacggtgaaacgtctagactaatccagagagcaaagccatagcacattccctaaatcattaacaaactaatccagagttgccatgtggaccaatgaaacgctggcaaaatggccggctttggattgatacatagattaatacatgaaccaatgaattatacacatctgcaccaaatatatgtgtatagctgatatccaaggttttgggtgatacgacataatattgatgatcaaggagtaaacattattatgatctcagattgtacaagacacttcatccctctctatagaacatcgcccacactttcctcatgcttcccaaatcccaagccaaaattatttgtctcttcgactaagaaacagtgagaggtgggtgggtggggggtgggggggggttctgattgagctgtttttagtatgtagccgcatcagagatgacctaagcgagaattaagacagagcaagaatgcaaactaaagttgtaattggtgatactatgtttgttttattagtgtgttattactgtctttttcttactgatagttaggattgggttcgaagatagacagtcctagaagctagcagatggaagggcaaagaggaaagggcgaggctggagagaattgaagaccataagagacgcggtacacgtgagtgaaagggatcggttgttttggccatggattgtttacatcttatagctagctacaccatctatttatgcatggccttaagatgtatccataagagatagatactcctcctaaccatggttaatcatggtcttttcttgtaaaaataaaatcattgtgtctaccgatatggtgttaccatgcattcttagtttgtgtagaggatggaagttaaatatacttttatttttaaaaggaaaagataacatctaacaattaagatcgataaccctaagtataagcattaaaaaaactaaaccaatcgttcatgatattaacatcagtcaaaagtatactaatttcagcatacttattttcctgacacaaaaacagagttaattttcaatggtgcatgtgtaatttaaattcagtatgtgactgtacagtgtatgttggtcaattatccattacgttcctgatggctaaagtgcaaccgatggtgtgaacatgaagagaacaatattacagttaatacgagagctgtgctccaatattcataagctgataacagtgaattttctggaaacccaagtgtttcaagtggagcagaatgacctgatatcctttgtgtttttgttcgatgatcacgactgccaagcatctagctatctcccaatgtcgcccaatccaaaattttcatggtaccatagtgcgcagcaacggggaattcagaggtagtgcacataaactgcaaaactcagatgaattttacctttcgatatttggatgcatggcagtcaggaacaaacatatatgaaacattttgatctcactggaggctgacactagtcattgctgataaaggtgctccaagcgtggtacataaatagtagtggtgtaggaggatacaaaaggaaaaccttacatcgagatggatggaaatgtcagtcactatgctggactaggtcatctctgacgggcccaaacccttacctttgatgggtttggtcttggtcagtgattagtggtcactgatgacaaaattacctgtgacgggtgaaacacccgtcacagataacccatctctgactggtatataagtcatctctgacgggttaaaacttgtcacccgtcacagatgagttatcagtgacgtgtcgtaactacctggccgtcactgatgactcatctctgacgggttgtaacttacgacccgtcactgatgacaaagcaagaaatacaatttttgaattttaaacgcaatgaaaaaacgtcaaaaaaatattttgaattttactagccatcctatacatcgttacacatcactacctacaaattcacaatttttcacgcaatatagcctgcatgctacatatgagatttgaactccagacctcaaccttccataaattcacaatttttcatgcaatatagcctgcatgctacatgtgagatttgaactccagacctcaacctccataaagagctcccttaccaactcacctactcagcacatattgactactcacccaatgttattattttgtctatgcttgtctgaatcatttaaatatatttaacaccctaaatgacttcaaatgaaaatattatcaactaaatagttatagatctcatcgtgttttataacttttacatagaaaatatcttcatccgatgtgtttgaactttgaagaattcaaaatttcatttttcaaaatatatctcactttataacctgtattttgaacatgtaaactttgtgaaatgaaaatattttcaattataatgttgtaaatctggttgagttctatgactttgatatggggcatgtatccatccatgtccatttgaaaaaaaactcaaaattttgtttttaaaagtagatctgatcacttgtaatgcatgttcggggatgtaaacgatctctaatagaaatgttgttagttataaagttgtggatatcatcgagagctacaacttttatatatgacatatctcaatctgaggttttttgcaaaatttaaaattttgaattttcactcatcactgacgggtcataactacaacccgtcagagataacaatatctgtgacgtgtgttagttaaagacccgtcagagatgagtggtctcttttgtgatggttcataatactacacccgtcacagataacatgtcatctatgacgagccatggttgtgacccgtcacagatcgtcacagacgatctgtgacgggttccaagtgcaagccgtcacagatgacctcacatctatgacgggtcctccctggtagccatatattgaagaggatattttttcggcccgttagagatgactcatctttgacgagatgcgttgtcccgtcacagatgacctgccactgaagcccggatctgtagtagtgagttgtggtcacggtgacaggtaatccataattgattgtccattaattagcttatcaggctgggttgcaagcttttcagtcagattttgaagacaaattaaatttaaaactgaaatatacagtttatgacaattttagaagttttgatgaaaggatgtaatgtaaatcgtaaagttcaacaatacaatgtctgccaaagcccattttgttaagaggagaaaaacctccggagccatcgttccacttattcgcggcatatttgcaaacgaaaagtaatttgtgaaaaaaatatttatatatgtgtttttagcgatctaaaagtaaaggctgaaaaataaatttcgatgtaaaaacctcaaaatcgtgaggaggggaaaactaagagaagattgagagagaagtaaaacaagttgagtcattagtacatgatcaattgagtattaattatgttaaatttgataaatggattaatatgttttttaaaacaattatcgtttagaattttttgttgcaaaaacacaccgtctaaaagttcagaaagcatgcgcataaaaacaagagaaactttttacgtgggtttgtaactattaagttacaggactctcaaccaattaatactagttaatcaaagagcaattctacggtccttgataaggtgccaaaaatttagtgtaaaatttggtaccatataggacctatataacacgaggtatcaaatttacattaaaaaagttgtacctcgtgttacctacttaaggaccataaaattgctattaatcaaattataacaatactttgctgaaagtagtagtttagccattctacagagctgcttggtacaaatcacatgatctatacatgacccaggaaaaaacaactccacaaacttgttaaagcaccaactgaagaaagttagattttttttaagcatctgtagaaagttagattcaaactccactactccactcatcctttatcatcgatatcctaatgatatgctgacaatgtaggaagctcttggccatggttagaacttagtgttgcctttcagccgtcttctcaccagcattcactagtttccatacagcgtcttaagggtttgccgtaacttcttaacaccagggttagatttgatcttggcacaggaccacctatgctttcctaatgcctcatatgcccagagagaggatacattcagcctcctcccatcgtctctaataaaaaactgcatttttagctagtcaaagacagattaaggatgttaaaacactgctatgctcttcattactgtccaaggagaggatacatattcggcctcctgccattgtgatataagatgtagacagagctaaggagcagtactgctggaggagatgaatgatataaagactgagaggtggaaactccaaacattcatgaatgatatgcgatacattaatcaatgtagcaataggtcacctcgtcatcttttaatttgctgctccacttcttgttattggaaaattctgagatggcgattctgctttgagactgcttttggctcaacagttaacagtattagctcgaataaaaagatctgcaacttttaacagtaggagtcaacctaatactacaaagtgaacagtgaagtagggatgatggtatgtgatcactatattttgtacctttggacaattgaacttgggttttaactgtaagttcaagaaaaattcttgtggtaattaaactacagctcgagagtgaaaacaacactggtatatctaggggtgaaaacggtaacggtaattccaggccgaccggcgttcgttttcgattttctacgggccgagccatatggaaatggtaatcgaccgaaataaaaatagaaatggtaaaaaatatagaaatgaaaacggaaatggttttgctgttataccgatcgtttccgtatttaccgtattcttgtggaaattaccgtttcttattaatatggtaattaccatattctaaatatgtcaatatttataagccatatctctacttgacccatagcttacagattgattgactcttcaatcaaatctctaacttttatttttgtgcatggctaaaatggagttaatttataatttatatagtataagcttgaatttatgtatgtaaagttaaatatatgtttttatagtttaatattttcgtatttgttaccggtttccgctctgtaccgacctgtttccatccgtattgttccgtttccggttttccgatattttcgatatcgttttcgttttcgactttactgttttcgatttcgtttccgagaaaaatatggttccaaaatggttgaggctgttttccgatcgtttccgaccgttttcatccctaggtatatctagtagtagagatatccctgaatccatatggaacttggctatagctagtaacaattaattatcaggctctaatgaaagaagctacaactcactggattggtaccgatcctctgccaccggcaaggaaacagcaaggtcgccattgtgcctatccaccgtccaaatagattggatggctagaaaataacgccgaattcttttcagcaacttgaaacggcaacattcttcttttccattagcacacttctcgaacggataatcggtgtgttttgtaaaaaaaaagtagatttttttaaaatttatgttagttaataggtaaataatcatgcggtgattatccacacagttttccattttacggggcttatatcttgtttcttttggagtccaaccattcttctccatcgctaggaagagaaaacaagtatagaattgctagttggcgattacgcgccattagcttaagtcgcgtgcattttttttccccaaggctccgtatgcggtccacgtactcactagcagcccatccgattggttttttcctttttcgcgtggcaatagtcttccttttcttttttccccgtcgcgaagccgtgattagatccgataatcgggagaaaattgtgatcagctgcacttctacgtaattagatccgataatcacggtacttcctttttttcacataacattgttttccttttttactaaagatttgaaacctatcaacttgaattttaaaagctttcaacttttcatctcaaatttaaaaaacttttaacctagatttgaaaactttcaacccaggtttgaaaactttcaactcaaatttaaaaattttcaactcaaaaattgaaaactttcaacttttcatctaaaatttaaaaaactttcaagccatatttaaaaactttcgacccaggtttaaaagcattcaattcaaattataaactgtcaactcaaaatttaaaaaaattcaactcaaattttaaaactttcaagtcaaaattaaaaactttaaattatacatttgtaaagagatgtgtgaaagattagaagaaaaatgggaaaggaacggcgaaaaaaagtgcgaatagagaaaattaaaaagcgccaaaagaataaaagaaaaaggcccacaggaggggtccagctagcgcacgccagtgaaattgctggcgcttacgcgcgcattagcgccccccaaacaaatatgctactaccatatccttttcatttcttcaagttcgccaatataatataataaatctctttattctacagattttttttattctacagatgattccaacttagcaagctttcatacacagctaattgcggaattgcctaggaggtgttttctggtttcctgctattttctttattaagtattttctactccagcgttcatggcttcttgccagcatgtttatctttaatatgcatgatctgatcagccttttcctgaggccttccaagccaagacaataaaatatttgttttctttcgcaagcgagttgagtaccaaaatcttcattgcacgaaagaacagagagatagaaaagagctaggagtgtcgctaaattatataaggaattgaaagtagccagtaactcttcaagagtaactgcatgacctacaaatctctagcttcattctaacttcagtaatactactgtactcttttaacagtaactatacagctacagttttgagtccaatgtgtgtgcagcaagtgcttttcttttctggggcttctatctatgatgggaacatattgtgcaaattaattagtaggtttgcatgactatagatttttttttcttgaaaatgtaaatgctatgcatttcatttcattaaagagaagagaaagtatgtacaacagagcagaaaacacaaaaataaaagggtcgccgaagtgatgggcaacaactctcataagagctaatctcctaaggccttgttcggtttagaggggattatttagaggggattaaagaggattggagaggattgaggaggaatagttccacaccacaataggagtggaataaattccctctaatccctctctcctagggattaaccgaacatagcctaagtggggatcgaccagcccaagaattcgtgaaaagctcttcctacggcatcacaccataataaattctcctttgccactgcatccaaaacaaagtagtactaggtgtgggattgttaaaggcgcagtcattccagtgctttaaaatttcccaagccactaagataatcaaagagtatagcccttccttagcatcctgagagacacctctgcatgaccagggatgaatgtagatgcagagggaggtgggtcgatcactgcgagatttcagtttctttaaagaaacgtctataaaacagaggctacagatctagaagaaatatacaagaacaataaacaaaactcatgttgctgcttttgaaacagcaatttgatcaatttgtttttaaaacttgatgcttggatctagaaattgaggctgttctgcggtgctttgaaatttaccgagctacctgcaaccagaacctcaatccgtggaagactttggtgctccaatttgagtgtccatggaagacaggagaattacactatgatcgtaaatgtttcgtttgatgttccattggaccttctggtgtagtgagattcatcgacaatatcctcatcagtgccggttggaaggcctcatcagtacaagtttcccaaccggcactacaatttgggcgctgatgtggggtgccatcaattccagtttaggcaccggcaatgataaacctgtatgagcccaaaaaaaaagtaaagaccggctcgaaaaatcagctaattgagtcgattcttcgagccggcccctctcattccacatgccaatccatatccaaaaccattccatgttcaacaataagaacactcattccccattaaagaacggatcaagaacacaacaaatattgatttaacacattcgatgaacattatatacagattgggatgaacacatatataaccaacattggctcaacatacatattaatccatcccaatggtaaccatatcaagaatcccaattatcatcgaattgtaatatccccaatcaatccccaatttcaagagtagtaatatatattcaacagatcaagaacacataatctagtacctacacaaggtttgcctcaccgcagccatcccagaggatacaccaacgccttcgtcgatctccttcgctgccatcatctcccttcagccatcaacaccacctccggctcgctttcacgttcttccgctcggcaatgccttctccttcctcactggcttccccatcgagccgctcaatctaaactgcttccctgaatcccctctatctggacggagagaggaagaggaggaaggtgttagcggcagccctgtagttcactcaaaactcacactcgatcggaggttgaagacagtgaacagtagaaacatcaggtgttctacatgagaattttttgcactgcgtagaatgtgcagcattttctggtttatcatgaacttaaatagcaatcatacatgaagactcaaaacaaacaaaaagggaaagagtggagagaactggttgttaggaaacgataagcgaacaaacgataaaaaacaatagatcaatcacagaagacacgagatttaacgtggaaaaccctcccaaaacaggagaaaaaaaaccacgggtgccagccagcaaaatatcttcactatatctggggtgaggttacatcgccgcacggcggtttacaagaggtatatatatggtggaaccctaaaagggatgacaacgggccaagcctttattaagtacaaatgaatttggatcacaactcaacaaactccaccttgagacaaattccttcttatagcatgaaacaatccttcaccctgaacacaacaaagacaaaaacactttcggcgccaaatagcctcttgggctaaaccactataccaattaagcttgagcaaagctcaaacttagcaacaggaacaggctttgtcatcatatcagcaggattatcatgagtacttattttgcataccttcagcttaccttgcgcgactacatcgcgaacataatggttcttgatatcaatgtgctttgtcctctcatgaaacatctgatctttagtgaggcatatagcactttgactgtcacaaaacaagttaatgcaagaatcaactccacaaagctcagcaaacaatcctttcaaccaaactgattatttacatgcttcagcaatagccatgtattctgcttcagtggtagactgggcaacaacaggctacaatgttgccttccaactcacagcacaactaccaatggtaaacacataacctatgagtgagcttctcttatccaaatctgcagtaaaatcagaatccacatatccaacaagccccttatcagtcctgccaaacttcaagcaagcatcagctgtgcctctgaggtacctgaaaatccactgaacagctttccagtgttctttaccaggattagccatgtatctactaaccaaactcatagcatgagataaatttggacgggagcaaaccatggcatacatcaaagaactaatagcactagaatatggaactctagacatgtattccacatcctcatcagtactagcacattgtaaagctgataatttaaaatgaggtgcaataggagtagtaacaggctttgcatcatgcatgttaaaacgctaaagaacattcttaatgtagctttgctaactaagaaatagcaaaccagaatttctgtctctagtgatttccatacctagaattttcttagcagcaccaagatccttcatatcaaactcactactcaattgtttcttcaatgtactgatttgttccttgctcttggtagcaatcagcatatcatcaacttataacagcaagtatataggtgatccattaacaaatttaatatacacacagctatcaaattcagacctcttaaagccatgtgacaacataaatgaatcaaaccttttataccattgacgaggagactgtttcaaaccatacaaagatcttttcaacttgcaaacataatcctccttaccaggcactatgaacccttctggctggtccatgtatatctcctcctcaagctctccatgtaaaaatgctgtcttcacatctaactgctcaagctcaagatcatgcatagcaacaatactgaagaatgtgcgaattgaactatgctttacaactggagagaacacatcattataatcaacaccagcaatttgactgaaaccttttgctactaaccttgccttaaacctcggaggctcgctaggagataaaccctcctttctcttgaagatccatttacaacgaacaggcttcttctgttttggcaagtgcacaagctcccatgtgccattcttctcaagagattgcatctcctcctacatagctgagatccacttctcacggtctccagagacaacagcttcaatgtatgtggctggctcaagagtattctccacctgttcagcgcaactaaaagcataataaaccatatcacatttctcaataaggcggactggagctccacaactcctctttgttctgcgatgtgcaataggttcatcttctggctgcaaaataggaggtgagtgctgaacagtatcattaacatcattactaacaatttcagtttcctgatcatccacgtgctccacctgcacgctaacatattgctgctcctcatcagaaccacctggtatgacatctgtgggcaagctgtctttaaacataacagattcattgaaaacaacactcctgctcatgaatgtcttattagtttcaggattccataacttatatccttttactcctgaaccataaccaagaaacagacacttaatagctctaggctctaattttccgttatcaacatgagcataagcagtgcatccaaaaactctcaactatgaataatcagcaggcataccagaccatacctcaatgggagttttcttattaagtgggatagaaggcgacctgttgattaagtagcaggcggtgttagtagcctctgcccaaaaacgcttgctcatgcgagcgttggacagcatacaacgagccttggagatgatggttctattcatgcgctcagccacaccattctgctgtggagtgtacgggatggtgtgatgcctaacgatgccttccttcctgcagtaatcatcaaaagcatccgaacaaaattcaccaccattgtcagtgcgaaatacttttacctccttttcagtttgcctttctatcatgactttccactctttaaaagcagcaaatgtatcatctttatgtttcaggaaataagccacacttttctggagaaatcatcaataatggtaagcatataacgagcaccaccaagagagggcttacgagaaggcccccacaaatcagcatgtacataatcaagtatacctttggtgcgatgaactgaggtattgaattttaccctcttgtgcttaccaaaaacacagtgctcacagaacttcatgttaccctgagtgcagccatccagcaggttcctcttcatcaattatgccataccaagttcactcatatgtccaagacgcatatgccacaggtgagtcttactaggttcatctttagaaacagcagcagcggtaacagaaccatgtaatgtacttcctctaaggacaaataagtttgcagaattcatatcaccaatcatataaacgagagaaccttttgatacctttacaactccacctgaaccggagtatttgtatccttctgcatcaagtgtgctaagagagatgagatttctcgccatacctggtaagtgtctcacatctttcagcatgcgtgtcatgccatcatgtgtcttgatctaaacagagccaatgcccacgatctcacgtgggttatcatctcccatgcgcacaacatctccattctgcacagacttgtaagaactaaacccatctctgttaatgcaaatatgaaacgaacatgcagtatcaagtatccattcatcatgactagcaacacaaccagcaaaaacgacgagacaatcttctgaatcagagttatcagcactggtaataacagaggccttaccatcaaatttccttttctccttgttctgcagcttccaacattcttcaatgaagtgatttttctttttgcaatacttacagaactttttacctctagacttagaacggcctctactctggctcttgtcacgatcattgctgtcgttgtaggttctctgctcagatctgcctctgacctgcaatgcttcgcccttagaggacgatgcatcagactaaaccatacctctcatcttctccctgttttggagcgcctcatagacttctgctagggttagttcatcacagcttaaaagtatggtgtcatgaaaatttgcatatgaactagacagtgagcataatagtaaaagacctaaatcttcatcatcaaactgtacctccatcgacactaggtcggcaacgatctccttgaagaccgatatgtggttcaaaacagaaccactctcctgcaacttgtgcgagaacaacttcatcttgatatgcatcttactggttagatctttagacatgcagatcgattccagtttgagccaaagttctgcagcagacttttcctgcaacacttcttgcaaaatatcattagatagatgaagtaggatcagtgacagagccttacgatctttgcgcttctcctcatcggtccattcagtcaatatcttcttcccgaagcttctcagcgcctcatcaagatccgaagtttgcgccatatcagcccgcatcttgacttgccacagcgagaatcttgtcgtgtactctagcagcggcagaacatacttcatcgacgccatcgcgaaaccctcatgtgggaacaagctctgataccacttgttaggaaacgataagcgaacaaacgataaagaacaaatagatcaatcacagaagacacgagatttaacatggaaaatcctcccaaaacaggagagaaaaaaccacgggcaccagccagcaaaatatcttcactatatctggggtgaggttacattgccgcatggtggcttacaaaagatatatatatggtggaaccctaaaagggatgacgatccgttttgcgggggctccgtccccgcacccccgggcgtccccacgtgcacagcccaagcctcccggcaacgggcctccgctccactacggcagaagctggcctttattaagtgcaaatgaatttggatcacaactcaacactggtgagcgttcgccatgcacgccaccactccacgaagtcctggcacacagattactcctaaagactcgctccgcccttgaacatggctagagcacaacgcccacaaggcacgcaggtaggtgtacaacagaccgacaaatgaatgctacagttagcttcataggatacaaagtgactggcacgggattatgtaaagtcgaacagaagggagggcactgtgcagcatgtgtggagagagaaattggattggaggaggccacacagaggccgagcggcggtagcggtaaggagaaggcatattggtggcggcgacaattttgggagagagacaaagagagagcgagaggaactaagaagaatcgagaagcgaagaaaaaatacagagaaagagaaagagctagacttatctgaggagttcattggttggcttatgattatacttataagacaaaatttaaatgttagaacataattttgaatttaatttttttttcatcgtagtttattttacaacatttgattttagtcgctaaggacatgaatataaaaattttattcatgaatttgataggatctattcctatgaaacgaataatgcatatacggaaaaaatagtaaggttcaattcctacaacaatcctttagaaatcctttaaaccaaatgaactcttagtaccgggtttttttattgaaccgggactggtgtggtgtcatcagcgccggtgcttgcttttacagcgcactggtggttttcctggaacgggtttagtcgaaccggtactggtaatggcagcactgatatgctgttctgcagcggcggatgcagaaggatatattcctgataactcccaagctgatgcggtcgcttcaatagaagcagaaatgagtgaatttagtgagaagtgttgtatcctaggagtttaattactatcgtgcagagaaaagacgatgcaaaggctagaagcatcagagtgtgtggcttcaccttagcctacaatgacgtggtcatgtggccatatattcggtatggatgtggatagggctggcaaacaatgcaaccatacacgttatctaaaatatgacaacatgaaactggtttcattgtcaaaggcacgttatagcacactttgaaacaatgggatattaatatatggtaaactaggtaatgcagaccagtgttatgtatattcatttaagagaaagagtgtccaaacggttccaagtaggacagccaaatccaataaaaacactggaatgcccaaataatattacaatttccatgtaaaatcgtatgatttgtacaattattttattttcatttatgataaggtttctacttcaatgacagcaatcacatgggatgattgttggggcaagcaaactttatagatgttatcggggagcatttaaaaaagcatgattggaggtatagtaacactactgcaggatagggctgtagtaacacatcattatcagtaacacaaactagtatgcgttgctacaacatgatcttgtagcacatagcaattcctattgataaaaaaacgtgttacaatcattcagctagtaacatctctttttaggacctgtaacgcaaaagcatgtgttgccatagatcctaggaacacatattttttccaccagtaacacataaacaatatatgttcacataagtggtaacatcatttttaattataataaaaaatagtaatatcagtttaagattgcccagttatcacaaatgtaaataattattaaagatctttatcaagcatcacatattaacatgtttgaattacacggaaagtaactgtatattacatccattgagaacatacaaaataactcgatctagggagttggtccattaagaggccaactaccgaacaaccatttcatatttgagtatacttgtaattcgagcctcagccctcatgtgctatacaagtccctgcagttgacaaaaaaatattgacccatagaaattaatatgtactatactccgctgcacaaaaaagcatccgctgcacattgtgttgaattaaaatgaaagtatttaaggcttgtatagccgtagttttaaaaccatggttttgttaaaatgtcacgaaggctccaatatcagagtacaatacataaaaggatccggtagcatatatatatgattggacaattggaagaaaagcttacaaattacttactagtgatttcagaaaaaaaaaagtacaagtgtttttcttggaataggaactagcagcttatttatacggtcttgtaaagtaaagaattaagatcagagcagagtatttctacacaaacgataattttagtgcaaggcattgaactagtcagaagacgtatgaacaaaattgaattaaaacattctcatgattagtacatatatacaagctgtaactacatctttgatattataatagggtttgtgtgaactaaaattttgtgtttcattatttgcttcagacattgtatgcagatattgttgtatatatgcttctttaattcccatggttgtaaaacttataagtgattactaattgctttgttcatatctcccggccgtcagaattttcatttcattatctaataaaaaaatgatgaggagacgttgcataggggtacacacttacgagttacgatgtatatttgattcccaactacctgttactagtttacaatctagcaactttggagacatctcttggcatgggcaacctgtgagcccagaaaaggagacaagtaagtgtcgagtatcgagagatgttatgataggatggggatactaacagatttagaaagtacatatttttacttaaaaatataatatgttgcataaattaaagcatataaattgcttttagtaaatctaattgatttttatgtgaacttaagcatatttattcatactatttttaatccaccttattttaaataatattgtgtcagatcatagaattatgatactacctaaaattttgtagaatcatgtgtaaataatcatacatgcaaatttaaactctccaaaccaaggagcacattgcaaggaccggctatgctaagaaatgttggtaccaaagaatttgcaaggaccggctctatgcctctatgtagattaaaataataaaaaaacagtctgtcacatctttcttggagcatgcatgaagcatatgtccgcatttatgttatttttgcctctagtgggtcccaatacttagatggactggtgctaaaccatattgtacagaagcttagtatcttaaaacttctatgtggtgagtggcaaacttttagcttcccaaccgagcagttagatttaggcatatgtttggcacggctcgagttctagccccaactctactggagttaaagtcctaccaaacagtgagttgaccctaaaagagagtaaagcgggctgaaacagtgagttgaccctaaaagagagtagagcgggttgaagtaatctggaaaaaatactgaagaggagcgcattttaggcaccctattgtgtgacactcataaattagagaaacatccatccattgattttcacttaaatcgatagacacattattttacatcgatagacacattattttacatcgttattggatctttttttttaaaaaaaaacatcccataccatattcccttcctctccatccctatgtgcattaaagtacataaacattttgctaagctgctacttgtctcacttaa

SEQ ID NO: 15364 - DNA, 1264 bp, Oryza sativa
caaaaatggtaataagctgcttggatacccgtgatattattttgttatatccaaagaaaaaggagatagaaacaatcacgaaagtatgattttgccccctttctgccatgtgcggctcgcatatagctctgacgccatggacgtcactacatgggtggcggagggtaccgctgcgagaccgactgcaatagcaagtgctctacggcaccctgctcaacatgaaccaggaggtggcccacgttgtgctctccccaagtgtggtgtgtggcggagcatcggcgccggcgtggctctcgcgctgcagcggcgacgagtgcgggaacgatgcggacccatgggcctaggcgcaaaggtcctcctcaaaaccttgcccccacagagccacctcaccggctgcaggtgcggttgtggtgtcagaggggaatgtgagacagacttggtaggcaggagcaaaaatcatacttttgtaattgtttttctctccatttcgtttggatattgtaaaataatatcacagatatccaacagctaattacaattttttcgatgtcccactcataaattagaaactacacagtttacacagtttaaagtaattttagttcacaatttatatgttgcaagtaaccagtgttcaaagtgtaggatcgaaacacaagaacaaagccaaccagaggggggtgaatggttggtatacccaaaaaccgaaaacttttagcggaaataaaagttaccctcgaattcgatagatcgcggtctgaccgaagttgtattgccggtctgactgccagatgaatgtcggttcgaccgatgtagatcgatcgatcgaaccgccgaagtcgcctgccacgcctgccgccgccaccggtcagaccgcccgtatgccgctggtctgtccgccgcgtgccgccggtctgaccaccggtatatcgccggttagaccgccgaaacccggtaaacacaaatcgaagaactcttaaagtggatgacgactttattgattctctctgtgtttacaaagtgcaccaacagcactccttacaaaaatttcgactaaactcgaaaccctaactcaaaactcaactcaattgctttcaaaagcaataccgggaagcctcacgctccccctctatttgtacccgaggtaggcagcctaaatccacgaaccaaactcatactaagagtcctaaacaccttaggaaaccctctagtacaagaaagaaactttacataaccaatcgtaccaaacttggactccttccaa

SEQ ID NO: 15365 - DNA, 27881 bp, Oryza sativa
  unsure (1)..(27881): unsure at all n locations
nnnnnnnnnnnnnnnnnnnnnnnnnnnnnnnnnnnnnnnnnnnnnnnnnnnnnnnnnnnnnnngttccgtgtggtcccggtagatttatgctgttcttgagcgttgaatcggtagggggatggatacacgggggcgctagggttcaagatgcttgtgtttgaggtatagagatctcgagtcagggtcggttgtttttgcgtctccttagacgagatcttgtgcgatccagttatggggaattctggtttgtgagattgtgagaacgcactgcaagaggtgattctgacttttatctcctttttgctagatgtgtatgtgttggtgtatgcttactactagtatcttggttttagtatttagtcatgagttgacatgatctccactccccaaatcccagatccagttagtcagttacgcgctggtgtaccttttgagttttgaggttgaattatactgattgaattagcttgtatagctgaatttggcaccaaaaagggtagtatcatagattttttttcgctgttaagtagtatcacaaagatttgaaaagctgaaactctctgttttttttaacacatagaatgagcaagagatttcttgtagtttacttgcactattccatcagatgctgtgtgaagtcatgagatgtttttacggacagtattgttccgtcaattttagtggcagacctgctcatgctgtcttgcataatattttgatttttctcactatcagtagtccaatggtatgctggcgaagcttgattggcactgtcttgactcttgagtaacccgccgttaggttgttcgttgaagtattttaactgatttaactgtggtctgtgttaatcaatcactgaacaaccatagcacatcaaagaaattgttgcaattaaacctgttttggtgtttcttcctgctcttattggaggaagaattagtgactgggatgtgtttgtgaacttataaacaagggattagtgcatctggtatcaataactttatctgcagaattactttaatgctttgtactgttaaatgttcttctttgaaactacttatatataatttcttggtatgccttcccaagtcacaaataacaaccgagtcctttttctgctgacatttttttttaatttttttaattatgtcttcagacgtgactgacatatgctttctacctttgttgcagatgtttgacgatcaagacttgggtttctttgccaatttcttgggcatcttcatatttgtcttggtcatcgcttaccactttgtgatggcagacccgaagtatgagggaaactgatgccatttttgttgagcaaagggatcatatgatcctcagatcaaaatagtgcgatgtatgccagttaatgatagcaatagtgcttgactgttattgtaagttcttacgcgaaatctggacctgcaatttctggcattttgacattacacatgtttaatcgattgaaatagtgaatccaggatattccaaaaaaattgattatacttatctagtatctgcaattctgcatatgctagtccgatgggtgctggcttactctatgatttttctctccccaatttgttggatgtggaaaaaccaaatcattgctgcgtgccctcgatcatgatatgttgttttggtaattctgaatgaatatgcttcaatatcagatacatgtgcagttcaagtatccagcatatccatgttcaaatgctaaaaaatcatcacctgttgcatttttagctcttcttcttaagcagattttgcacctgcacgattgaaacatggaggattccaactgcaaaaatctcttggctggtcaccgttcacggaaaacacctcgaaaataggttagccaagcttaccccgaaccattccttatgccctaaaacttacaaggcccatacccaacacaagaaccatctcacacccatttaactcctctcctttctcccactttcttggagctcaaacatcaaatcttcctgtgtgagagatcaagagagaggaagtgatagattttttttacctgacctagctgtttgatactttgatttgttaatttcttgtgcatttgctgtttgtgatccgttgctgtgatcgatgtgcccctgaacgaggtccacgacgtcgttggagttggcgccggcgagccggcgaagatggatcgccgccgcgcggcggagctgatgctgctgtccctctcctcgcagagaacgcgcatggcgctcgtgggtggcaaccacaccgccgcccgcttctgcacccgctaaccccgccgccgccgccgtctcctcctcttcttctcccatctcttctctctcttgatcatcttctccgttcatctctgctctgagtgtgtttgatcctcttcttggcgatatttttgtgttgggatcaatggcgacgatgaagaaattagctgcgagggatggcagggccgccagcaatggcaggctcctccggctggtggcgcgggcggcgctcctcgccgtcgtcgtgctttctctcgtgtcgctccggctggtgctctcgccggccacggcggtgggcgacgacggcgagctctacctgccggtgctactcgccgaagtaagcgaccgcggctacctgcgccacggcagccgctcggtgttcgtcggcgacgccgggtcgtgggcgccgttcctcgagcggcaccacgtcgccgtcttccgcgccggcaagctccgcgagctcgccgacgagtccgtcgacgccgtcctcttcgacggcgacgcggttcagctcggcgccgtcaaccgcgtcctcaagctcggcggcgtcgccgccggtttcgccacgtcggngtcgtcgacgttgcagccccctgacaactacaaggccgtgttcgcgcacaggtcggaggcggccatcgccttcgccgtggagaagaccacgccgccgaccacgagcgccgccgtgacggcttcgccggtgggacctcaccggaagctcctcgcattgccggggagcaagaaggacgacgcgttggccggtctcgaggccgtgctcctcgagccgccgcagaggcagcaccggcgaatcatccggcggctgcggccaaggtacctcccggagctgaccggcgactcgctggaaggctaccgccgacgaacgttcatcgacgtggcgccctctcgcggcggcggcgcggcgtcgtggttcaagaagcactacccgagagggaagcgcgtgttcgacatggtgcgcctcgacgccgccgacgcgacggagccggcggcgagctcatcggcggcggggatcgccgagtggctggaagggaacgtgagggaggaggactacgtggtggtgaaggccggcgtggaggccgtggaggagatcctccgcaggcgcgccgccgtccgccgcgtcgacgagctcttcctcgactgcgacgccggcgccggcgccgacgcggcgcgccgcccctactgggagtgcctggcgctgtacggccggctgcgtgaccacggcgtcgccgtgcatcaatggtgggagctcatgaatgctcgaccacgtagagagagaaagaagagagagagagagagagagagagagagagagagtgaaatgatggagctcatgagagggaagagatcactttgggttcagaacaaactatgaatatgcagggtactgattaacagctaacggataaatatatttggttttggttggggaagagtataaacttatgtaaatcaagcaaaacagttgttccaagattggacaatttttggatcttgaaattcaaccagcaagtaaatatatattcatgtatcaagcatgtgtgtttggccaaaatcattcttctagggcatctttcttatggtactgatgaagacaaacttgtactccctctatttcctatttctcctatgtaaagtaacatagttgggcagcaagcacaagaacgaatgattctatttcctatttcctattagaagaatgctttgggtttattttaagtcaaactcttgactgactttgtaaaatatgtagcaatatctgtaacatcaaattaggttattaattctaccattgttttttttgttagtaatggtactacaattttctaaaagcttaatcaaattatgaaagaagtcgtatatgctaaaagctctttcaggactgagtttcaccaagcgtggcttgaatccaacaggctatagcacgcaagacacatgcatggaggcccagcccttacttaattttctcacatctccaggtccagtggaagctgaagtagacctgcccatcttgagcttgtcaatggaacagtagatagagggttgtacagattcgttgtccattaactagtggaagctgaagtaaggtagacatgttccaatcatttgtccctaaatcttgatcaaattttaaaaagttccgactagaaaaaaaatcaaatcaacttataatataaaacggagggtgtacatcacgttgtaaaatggaacccaccacttctttagagttgccgttagtgccatctgtcaggatctacttttatatacgtagttttttaaggtttatttgaaaaataagttttataaaaggtttaaatgtcaagatttcccgtacaataatatgttccaaccactaatcgtgtaaatctaaataggatggaggtccaaggtggtcgcaccccaggtgcggaattgggcctaggtgttgggtcccaaaactaatgattcagaaaccgacatatttaactgtatcaagccctgaatcggtagattgatacaggttcaacaatctggatctttatcgcatacatttggtcaagactccaaaggagatatatttatataaaataataggacatttacaaatttgtggctaactattacagcagaagctatactgtgacccaattctgccgttttactatagaattaaaccgtctaactatactagacttgaagactagttttaaaggaaactaacttatgtgattgaactcccagcttcggcaaaaactccaaatagactctgaaaaagaggggttgaagtaaggataagtacaacgtactaagcaagctattatattattcaacaatgaatgcatgagaggtaatatctgtgtagagctagatttacttgcagaaagcagagaatatagaagtagaaaacctgtaatgttttaaatgcagaagtatttaataaaatttcaaattaggtttctatccaagatgccatagtgagtcccaatgcccgataaccgcgagcacggctatttgaatagttttgaggatattcatactgcagtagatgtacgctttacccgcaatccatgacgtgccaaacacattagccttgttatggcaaagcttttcggttactaacatcagtggtacctgttccatgaactataatccccatacgctctgaacgtaacattatcagcagtgagaggagttatggcgttcccggggtctttagagagatctgattgtatgacaccatgtcatcgcaatcagggttcacaaacaagtcacatgacatcataatttatctcaaacaaatatttacctgcgcctcggtaaatatcacaatattgcccttcgcggcataaatttgcctcctgcgcgaggacttaaataagaaccactacacagaggtaccacctttgctagataacttaatcagctaggtctatgcccatacgagaattgcggtcgtactcgtatgttcttcacatgtacttggtagtcttatgtcggttggaacagtactagccacccggaaatcaaccatttctaccgtactgtcccaatctaagttcattatattttatgcagtctaactaggcagggctaagcaaaagctagcatatctggtttgctatgttcaggttatgcatttgaaatcatgtatgactaatgcatagaatagagatataagaatatatgatcattatgctcaaaggggaggaataataacttgccttgctctaacgcaaataaatccaagataggcaacctgattatccgattctcgaaataccaaaggttgtcatccaaaacacaataaactctactgagaaagaggaagaaccaaattcaataaaagccataaaataataagaaaacgataaacagcttaagagggctagggtttaaggtataacctatctcttttgtagggcatagggattactgggctaatattttatgtggaggttctagagggttggaggctaaggtaaagagggaatcaagcaactaatgttgcttatattttatgtgaaggctctcgtgatttggatgataggaaatatactggatagttgatatggttaaataggtatgtggctaatatgggtcaaggttgggcttttgtagaatagtggctagggtttagttgtttaggccgatatcgaggtaggataaatatcggctagggttttaggtgtttgctagtcgtcgctagagttggacaacataacgactagatttggtaccatttctagccggtgtcgatagacagcatatcggctagaagaataggaggtgggtgcaggtttagtggggtggaagtgttactccgacaaccatgagtggcggcggagcggctagggtcacacaaagctcgagagttaactgtgcggcgtgcaatggaggtcgagaggatagtgaagctccgaccgctatacgcatcaaggtgtggggtgccaggagcagcacttcgaccttgggtttggtttttgccgggctttacaaccaacggtccgacgtagaggttcgtagaccgcgcgaacgtccccatggaaggcgtaaagttccaaccgatggcctttaagtggctaaagggtattttggagataaaagaaaatatttgaaaagcaaatataagtttaagttgtaaattcaatcataagattaaatcaaatatttattcaaatggtatttgaataaattaaggaaattcaaataaaatattaaaatagcaaatttggtatgaaaatgaagagtttgaatttagatgaatttaggtccaaatttcactagaatcggatctacagtttaggagatatgggcttctaaagattggattttgagttaaataaagaaaagcgaaatagtactgtgcaggggcccacctgtcagtatcttttctttttctttttctccttcttcctcccgtctcttccttcttttctcctctttccagcacgagcagcagaggagaaggagaggaggggcgccggttttccggcggctggaagatggcgacgccggcggcgggtggtgttcccgagcacaaagcatccggggagtgcggtggctggcggagaaagtgaaggagaaggccgaaacggcgacgacaagagctcgaccgtggcaacaaaaggagtggcggtggtggcttgttgtgggggctaaaagagaggggaaaagggaaaaatgggttcacctcgtcgaggcaaacatgatggcgcaaggacttggcttgcagagctgtggaagaggagatcggccagtggcggcaatggccggtcatgagaagagagagagagagagagagagagagagagagagagagagcttggtttatatgtagagaaggggagggatggccggctatttataggcggtggaagtcggtttggaggaggacggcaaggagggtcacgacgccggtggagtggaggagaaggagacggcgccggcttcgttttcttagcggcgacggaagggagtttgcggcggcgtgcgcgtgtacaacacgcgcacctgcaggaggaaggtggtttggcttatgggccgatttgggctgaggggagagatgggccaagggaagaaggaaaggaaattttggcccgatgacaaaaagaaagtcttatttgaatacatgatttggataactaggttttgcaaagaatttgaattcggaaagggaaatttatttgggtgcaatatttagaggtggagtttgagggaatttatttggaagcacttaaataggaagggaaattaataatattcctcaaaatatttttgggaatatatagaagggaattagttgaagacaataaataggataccaattctaaaattggtattatgtatatttgtggctaaaagggaaagttgaatgaagagtataagttggaattttcttagcacaagagcaattattcacaatatttgcaataatacaattcttgtgccgaagaggaaattaagccacagagattaaattggtgactagatcaaaagggggaatttggatatttggatcgagaatcaaaggatgggtttaaaatcaaaggacgggctaacaattaattccaatgagattgaaattactttggtttaggttcaagggtaaaattggaggatttcttggaccataattcataatagtaaaaatggttttcaaactaaatttgaataaaagagttttagtcgaaagaaggtttaatattcaaaaatagagttccaacaagaaataccaaatatgtttttaaatgaaaagcacaaaagatgttaaatagcatagaggtttttatacaagttagttttaggaggtcccgctaattatattttcctaggtttagaaagttattaagaacataagaatcagcatgatgcaatattagaaaaatgacacattttcaggatgttacaaatttaccccccttaaataaatctcgtcctcgagatttctgaagagtccatgtagaagtgtggaaatcttatcttttccaaaattccagatatctgtttaattagtcggttgataacttcatgtttttgttgcatagtattcactctaggtctttgatgagttttgtatcttttccttgtacctttcgttccttaaagtatttctggatcatctctttgatattcctttatcaactcttcttgtagttattctggcattgtttcttgttgtctttgtggtataaactggattataaaaagctgtagatcacttgattaaatctcatgtgattcaatgtttgaggatccaacacttaataacttgaacatgttgtaggatatttctgtctaggatttaatcttccttgcacatatatgtgtagcgatgatactcgtcgaggaggtttattatgatcttttagttattctggtcattggggtgtatcttcggaatagggctgatgaatgatcttcgtttgatggctttaatgtcttcttagacaatattttcttccaaccttttgtaacaattcaacttagatttctgaatcctaatcttgtgttgtttcataattccctaattgttcgtagttaccaatcctcttcttatgcattcccttacgatatttcttgcggtaactgcgtacggtatttctacgatgattgctacatcacaacttcttgaatggtgtcgaacattgaagtcgtattttctaactatatctaaccatttccttcagtacaaatccatgtagcccggttgtcctcacacggccccatccatctgtatcccgtccgtgcgtgcgctcgtcgcgttcgcgttcgcgtacaccgccgcgacgcatccggccaagcggcgtctttgcacatggcaggccgcaggatcgcgccgcgcgctgccacgctacgctagcgaagcgagcctcccgccggtgtcgatgcctcgccctcgccaacgacacgccgcaatcgacaacaccccaacccgcacccgcgggtcccctccctcttcatcagtcatcacatcttccccgcggcgagctgtgctgtgctgtgcatcctgcctgcctcctcctctgatgccgcctgcagcgacagccttatggcttgcgagagagttgaatactcctcgtgctcctctgcacgcggcgtcgcagcgatggacggggaggcggtggtggtgcagcgcccgtgcaggtgcagggtgcaggcggaggcgagctgccactagctgggctgtggctgctggggtctctgctatggttttaactgccctgaagcgttcactgacgcagacaaaagactcagcagcagctcgcacgctactgttcccgcacagcaccgtaaccgtgacaccatttttcttttttgttccttcgtagcagcatcgattattacacgtataggtaattaagggtatgttcagatttgataccaaaatgaaccttcctgaattttgataaattgacagcattgccataggattgacttaataatgttgccaaaattctttacacattgccaatttttgtgacaaactaaacatgatactaccgtgaatcaacaagggaagaatcctacggtaagggggggttggacaggattcacctttccgactgagtgccggatgctggatattgaatttatcattttaaatttgaattctcgaaaactattcggaatcacgctcggaatctatatattcgtcccacgttcgaaagctctagattttgtggttcgttaacccttatggtccaatggattaatcaagcgcgacaacaacagctggttcggcaaaaaaaaaaaagaagaagaagaagatttgaatgataaattactctgatgttaattcatcccttagttcgatttttttttcaagtgctcaaatcggtccaaatggttttgccgccttgcatgatatactgtactatactaataaactggtatctcctgacaacacaagttcaggtcaggctcatttaaatcatttgccaatcacgttctcagtacagtacttactgatctaatgcactgtgggtatgtatacaaggacaatgtactatgtttggtaatctcgggtagtcaacgtaacggcaagcgatgaaaatctttccatggatactaatgctgcagtttaattttattccgggagtaatcaagcacaactagtacatgacaagacaatattgtggaaaatttacacccatttggaaatatcacgtgctaatgcaacagggtcacctgtatctctctgtgtatctaagtagtacagtcaacaaagaaaatccgtttaggacaagttctgtactagtactgtattatcaagtgcagatttactgctaatgcgatcagcaacaatacggggtacagtaagtactaactaatgctaaggaggaaactatgcatccggatcttattgtagcaaattaagcactcatctcaggttgaacaactagcttagctacttgccgatttgaggattacataatgataaatttatttcttgaaatattttatttgtatctataatttaatttttttcgcgaatgcgcaaaagaattgcacgtcaatatattagagggagtatctataattcaatagacaatccatagctaatatggtgaataatctgtttccataccttattattctaccacaagatccgttggaaaatttgcaaccaaaaaaaaacaagaattgagacttgtactatcaattttcaggggctgtgagcaatatgtgcaattatgggatgtatttttttaaaataatttaatgtgatatattggctcaattgggtctggccaatgccaggagcccaggactcaggaccctctcatgacaagcatgcatgcatatttatcatgggtccacagtacagagaccatggcaggtgtgaggactgaagtcttcaactccttgcattgcatgagtaaaatagcagttggcatagctgcagcctcttcttcacccatttcaggggttgtcttcacggacactgtccctcacaatatgaaaaagaactgcagccaccaataaattttcattgcaggctttttaccagcctttttaggtgaatttattgagccattcattcaatcagtatcaccactaccatgagagaaaaaaaaaaggggggggcagatttaggtgaggttgtcattggaaaatcctacacgtctgtccctgaacagaaattcagatactcaggtgacacgttttatattgaaatttagtacttggtgagactccatgataggtttggttctcatgaaccatgaggcatgtatgctctccttctgtcttattgtctctttaaactgtttgattgggaaattttgatagataataattgaatccatttgtgatgtaagaatttcaaaagaatcagcccatttcacataaaaatcagaaaaaagttactacagaagagaaggcaatgaaaagaaatcaaaacgattttcagtgggtggtgtggcacgctcacggtgagttgtaacgacaacattgttcatgtggagttgcgggattgggattcggtaacattctaggtgactcaatgtcaccgagaatgtcatgggggaatgtcactgaatctgtgttcggagttgcggtgcctagcggcacttcaccgtgacctgtggtgaaagatcatcatatatgataattaatttttagttatacgatgattaatatggaaaggaggaattacattataaagttcacgttacaattgggggccaataagagccaaaacacatagacaaggtcattgaaaggtatgattccatcattagtttaggggtttaaacagatcgttggaattgcatattgccaatagttatcaatgcaaatgggagttcagacatgggacccatttgtttgtacctactttccaccatctcactatcaagatacactgtttgtttatcatgtgccataccaagatttgtacttacgattggttctcttcataaaagatttgaatcataagaaagtcattgcagagaactttcaaaaaataagagagaaatgcaggtctcgcagacaagcagtcaactcattgatgaatcagaagcacacctttaccagaattcagatgaaaaaaataatggcagaatttctcacaccatgaatcgtttttatatggtgaaagaataaaggaacaaaacgaaattctttttgttgattttctctcacatcctcacatctccaatctcatatccacaaagatttctctgctcagagaaggggaagaaaaagataaatagaagcaggaggaaaggggaacaaaactgcaagaggaagaagacttcctcctctcctcaaaacacaccctttctctcttcatccagagttcaagaagctgatactagcttattactgctcactttcatccttgcttgttatgatgatgctcgccatgcaccactacttgctaccctgatgagttgctcactgaatgaacaattgcaaagcaatgccaagttatgtatgtacagttatcagattggtgttgtgtttaatctcctcctcttggaagcaggagcagagtcctggctgttgtaatctttgttgttgctgtttgactgtgatgatcctagtgttgtgtcatcactcctaaaactgaagcacgccgcgtccaacacggtgatcgggctgtgtggaactgaagagcttgcattgctgttccttatcttcttcaccaatgccttctctaccatcagctcatagcatctcataaccatctcctgcggatgcacaaacatgacacattcagaaacattgaaaatacaatggcagatcagtatgccattcctaaaatgcaagaaaaggctcaccttatttacagggatttcagattctccaagggcactgttgaagacaagaaactgattctcagcaagcacagctaacaccactgcggccgcaatctcagaaggtctgaatgacaagaacctagagtctgtaaaaacattgcacataaatttctagtaagtacaacttcatcagatgttgccattggcaatgcaggtagatcttctcgattaaatcatcgggcaatatgatcaaacctttcagagtgcccactgtgagatcagagcaccatgatgccagcgtgtagctcggcggcttcccttcattgaacttgtccaggaagtagccgatgaaagagaatggggtcacagcttgcagcctccatttcagggttttcatcacaataagctccatcctcttaatatgccttgcttcaaacacatattccgcatcaaaaacctatcatgcaacaaaagcccattttagcacaagatcatcgcgcgatcactgaacaattatcgatttcaactgtaactcttcattcattcacctgaaggtccatgggaagagggaccacggtctcctccatcttcgtagcaagagatagacaactaactgacagcaactgttgcatccaagattcgtcatgctacaacaacaagaacaaacaaaagcatcgcaatgatcactaccgggattcactatacagtaattaagtagtggcaatgtacatacacgtcccagattcttacagggagattaaacgaggagaggaacctatccaggtagttcactgcgaggtaaaggctgagtggtccaaagttgtagtaggaatggacctgcaagcgcacatgagagaagacaagattagcaccttcgtcagtttctacttaaaaacaaatttgtccatataaaaggcaaagccccattgttatctgcaatctggtgctttgtcaagtttagcagcaaaggcaaatgcacagagccaaagcaagatcgacgctagagtcaaagatgtaacgcaagcatgcaacaacctacctagaagacccaattaatccatcaatagtaacaaataaagcaaaaaaaaatcctagagctttatttatttttcctacacttttgattcatattcaccttgcaaatccaatcaatggcatctttcctccaagaacactccaatccaccgagctccagcttctccagatacccccgctgaggctgatgatccatctccttctccaccaacaacgccacgaactcatcggagtcgatggggaacacagcaccaccaccgaagccaaagaaatcaaagccgccaccgccgccgcaccccagctccgccgccacctcgccgccgccgccgccaaagccgcccaggccaagcacgctgctgctgtcctccgcgcagaggaggatgttggaagcgccgaagcaaagaacacccatatcaatcaacccaagatcgcaagaaacaacacctcctcctctagtactattagcacaagtgatactggtattgattcaagaactcaagaacgcattgattcaagaactcaagaagagagagagaggaaaggaggttggtggtgttttggggagtgagtggcctagggaggcgagagggagagggagagggcgcagcaatggaggtggaggaggaggaggaagaggggcgacgcttttgttggtgcgttgtcttggaaagtggaaaaaggaggggagagacagaggagaggtctcctggggaagagaggaggaggggtttttggggcgtggcagttttatagggcgtgcgcgtgcgcgtgcgacgagacaggaggtggatccgtgtgcggtggtgcacccacacgctgcgctgcaccgaggcgtgccaacttaaggccaaaatagagggagccgggagagacgtggcgatagtaataacatttcctagtgtaccgaacgaattcaaacaagtttagccaaacttttttgataaaaagtatttggtttttctcggttttacacccttcttgcgacggtaaggtaaacattgctcctcttatgtctacgctagacatttttgtaattcaaaaatatgacataaacatcaaatagattggcgtcgagtaaaattgggtgaatttgttgttacgtttagaatattaatcgggcactacatggttttttcttcttcttttttaagtagtataatgtctacggtgcaactaaccacgatgcgcaatatctaaaatgtgattaaccacgagttatttggtttactggtgttatgttctatgctagtagtactttatttttaatcgtataatacttgtttaaaagtctctagtggctggtgccaatgaatatgccactcactgttgtttttgtagtttttacaaattgcctcaatatttttctaatattgtagaatagtctaacatttagttcagacaaataaataatagataatcaaataagcaaataaatgatactaaaatatttgattaaaaaatattttgctatgacatattatgattcttctatccatagcaaagtatgagcattttgctagtatgagaaatgtgtgacacctccttacagcatagagaaaggcacaagaaggcaattgtctcttggttagtggtattaggccatccccaacccagaaactatcaattagtttccatatttgctatgttatatatacattatgcatagaaactatatatacaatggatgatgtcttcaaattaagttctcatccaatcatctttcttctctcctttatctacctatccccttcttttcattattggttcttgtgtagagatgatttcttgcatgagaaatggtttctccatctttttgcctctctcctcattaactctcttggcacatcacatttttgtttatgtggcaatatattttatgctatggatactagatgtcatggagggttagggatggccttagagtaggtacaatagcagactataagctagctataaacatattttaaagagataaaagaagagagagaagagcagcggactacagatctataactagctgcagcacggatttcaagatataacgtgtgtatgataggtgggactatgcattaatagtatagtaagcaactattgtatgaattgtattacattggctatagataattggagctagtagttggctatactattaaacttgctcttagaggggcgagggggaagctaggagaggggaaccacattacaaggattaaaaaaaaagaactagagaagtcacctatggcttaaatacaattatatgcattttttttggtacaatgatatgtacattgaaggcagaaatctatggtggtgagatacttattgtactacatataactgttccttgttttttgggggtgaatagggaggagtgttttatttttttttaacaattctgaaccaaaaatagtcatttgtgctatacagcacccagtgaatatatgcccaaaaattacaactcttcacgcatctatggcttcacgatacacttggtgatagaattgcgagaaaaaactagtcaactgtgctaatttaagatgctacaactaaatatagttaatgaccatggtagcctgatatatgtttaattaattctagaagatgcagttgataacaattgtatagtcaacacaacctgatagcgtgctagttttcttttagcgcgcactcgcttgcattaccacatcgattactaaatactaggtctgtacatttgcatctgtaaatttccacaatttatgttatctgtcaggtaattgggattgatgcgtctattaaaaaaactaatcaacccgagtgttcatgctggactgtcgaacagaaggaatttcatcgcttacagctgcgttgacaacactaaaatttgcaggcgtagtacaaattacaattacacatgcccacattgcatttagatcagaatgacaataagtagactgtctgtaacgtaattggcacccagaataaactggtggttcctaattcgcgtggtcaacgagttctttttaatataatcattcaaggcggcaatccattttggattgtgagttaagagctgcttaaatccgatgggcaaagcatcaagattatccaaccattggttacgcataactaaccaatcaatttggccaaagcccataggattcttctccatgtatcgatggatcacacaatagataaagtaaaagaaagaacaaatgctgcaagatatcaccttgacgtttttgttagcatatgcaccccgtccccagtggtcctagagttggataaacccaacacatatccttttctccatgcagattcacgatatactcacattgccttctcttcgatgccactgcactcttctcatgatgcaaaattgttactaccacagttttacaaaatgctgagctgtctgaaaaaaactctgaatgtgtgatgctgctctgatacatggctcctatgaacagatcggtcaataaaagtttaggcaatttaaccacagccactctcattctcatcatgtatcagaggaaatgctgaaagctatagaatctgcgatgctgctctgaattctgaaacatttttttcttggtacgggtacctatgagagcaggtttaatagtatagtcaactactgattccaaatcatatgtagttattttaataaccaattcatacaataattatctccaaatatatactacataattaatatctagtttcacatatcatacacatgtatcttatagtccgtactgcagttggctacaaatctgtagctccactgcttttctatcttacatcttatcttcttaaaatgtgtttatagttagcttatatcctactattgtacatcctctgattctctgaatatctgtctactagaccagtagtaataagttgactagtggtgctgtggaggcaatttaaccacggccgcccaggcggcgaggcaggcaagcaggcgaggcgccccccgggcgtgcgttgtcgcttgcggcgtctcctccgcgatggctaggtgcaaagattgcgaagacgcagtacgcgtttggctccatcgccttgtacgcgacggtggcgcacgcccgtgtccggcaccgcgcgctcgccatcgccatcgctgcgtacgtacgtaaaagccaaggcgagagcgtccaagcggaaaaagcctgtgccgccgtggcgtcacctgtacagtcgaccagtcgtgtctctccctcccgtgtccgtgctcgctgctgctgctcgatgggtataattcctagtgccgatagctagctagctgctcgttacattttcgctagccctagtcctccttgcaagggacaacctgttgttgttgttttttttaagaaacacggtacaattgcaagcaatcgtaacacgcatacacttatctctataacacgcacacaccatatttcgattatatcagaagactgagctgatatatcttaaaattgacgaagttaccacgaatgcctcgtgtcaatgtgtacgtcgctctacaactgaaagaataattacccgtaaatacgagcatccgttttcattttgttactgctacgatggttgtgtgatttgtagagttcattaaccttgtgagccgaaatgaccatgctgcgtcatgtatgcttcggggttgggtagtttggggtgggtgtgatggtcagttttatggctcgtgatgcggttaatatggtgcaaccaccaccaacgtgatagtttgctgggctaagcccagcgatcgatccatctcttcttcccggggggcaattgggccaccatttttgtgttttgacactcgtgaggagcgtaatgtgatgcaactaccagccaagaaggggtttggctggccttgcagcatgatgagctcgtgtgtaccctaccaaggaagctggctccacattgtgaagatgacgactagtagatgagagtatgtacatgtgctccattggtacaagcatagcatccataattgctcgtgagaagtttcaagcgattcaacaaccaaagtagctagcactcggaacaaagaatggaacaaaaatgatctggtttgggttagtgaattgcattctttggatcagcaggagtagagtgtgcactggtccatttagtcatttacaaatcaagaggcatggaaatgcctgggccttcatgccatgtgctttgtttgcaaagatggcttgactactattactagaggaactggagttatttctcgtgaggaacgttatatggtgtaaccaccagacgaactagctggttggataattggatgtaatcaagtatacactagcttactcttttacctctagtggcctggtgatgttgctcttttattgatcttcacatttattttcttcactgcaaaactgcaaattttacgctgaattaaaagatagagtatatataatgcattctacagtatatataatcctgaccagggtttactttatcattttaaccgatttgatagaaggtcaccgatataccaagaattccaaaattttaaataaaagttagttaaatttgaacaaatattaccaaaattcgtgaaaaaattaaaacaaggaaaaatttcggctaaaatagtattgtattggaggggtccgaaatgaccgaaatttccaaccctgatctttgacatttctcctttcgcagaaatactccttgaccaatcggaacaactgctgcaatgctctaatgctctgcaagtagagctactacgtacctctgttcaatcagatcatcaggcaatcgatcagcaatgtacgcaggcaggatgcaacccgtgagaagaataatgctgtgtagctaccagtggtagtcttgtattggattggctcggcttccacattgattcaggctcagccagccacatccgtactgaattcaccacacttgaagtcgatcttgaacacactgagaattagcatgcgcgtcacgtaggttaattgaatgggaggcaacatttagtgctcgtgacgggcgtaacgcggcgcagcaaccggtcgaggtagagctgcatggtcgtctcgtccgtcagattgcgaacgattttagagcggagtagtacttggcgtggtagacagatcggtcgccgtgtgatccgtgtgaccctgtcgccccgtgcccaacatgcgctggtcccgtcaatctcggagagcgcaacccaactaaccaaaccaacaggatcattacggccccatttggtagggctctaaactccaactcactcctctcaggggactagctatgtgagttgaactatgaaagtttggtagttaactctgactgaaaaaagcaaaaaattgaaaaaagtgtaaaaaaaggaacctaccgccggagccaatcccaggcgccgcccgccgcgtggcgcatcgtcgccacccgcgctggccggccgcctcccgcgtgtcgtcgccgcgtgccccgcccgccgtcgtccggacgcctccgcacgtcgtcgcagcgcgcgccgcccactgcccgacggccgctgcccgctagctcgctgcccaccgcccacgtgtcgtcccgtcgccctgctaccgtcgtgtgcctgccgccgccgccgcatgctagctcgccgcccgccgcccgcgcgtcgtcccgccgccgccgacgccgcgggatagcactgaccggagcgccgccgccgcgccctccaccgcagcaaccgacgccatcgcccccgatccctcttcctcctccgccgccatggccaacaccgcctgccgtcgccgacgccgcccaccaccgcccgccgcagctattgggactcgggagaaagatgggggaggagaggaggtgagtaggggtagttcaatggtatttttatgtaaatacactaaagaattaaaggttagtgggtcttttggggtggagtggagctgtggagcagcaaaaacccagctccacccccgtagtacaattttgtggagcagctctcccaactccgctcccaaaaacggagtatctggactgtttgacacaactccagctccaggtaagttggagttgggagctggagctgtgccaaacggggccatttgtcgataaattttcacctaaaaatttgacagatgtaattatagtataattgtgatgtaattacattgtaactcacttatgtttaagtttcaaaaatctcttcgtaaaattctatttcggtaaaacggaggtcgtggaaacgaatcctctcatatgtgtgcgcgtagtgacttttttcctcctccatttgcacaaatcttgaaacaaatctaacggtttaaaattatgtgcaagttacattgtagttacatatgttactacgattaaactgtaattatatatgttcacagcgtcttcacgtgacgccgcgagatagttatcaaccgcggcccgcgtaaaacggcccaatcacgcgcgcacggctcggcccgcgaggcgtcgagacgagaggattcctcgcgttttcgccgattcggcccgcgcgcacacgcggcgcgtcgtctcacgcacgcatcggtctctctctctctctctctcggtgactcttccgccgcctgcgccgcggcgcgagccgccatggcgaggcgcgcgaggctccggctccggctcgtccgcgccctcgccacggcctccgcgtccggatcgcctgcggcgccgcggccggcgaggcaagcggcgccctacctggcggtgctccaccgccgcgggagggcggaggcggcggcgtgcctgaaccgccacctccgcctgctcccgctcggggaggcgacctcgctcctcgacgcgctcccgtccgtccgcgacgccgtctcctacaacaccgtgctcaccgcgctctgccgccgcggccaccacgaccgcgcgggcgcgctgctccgcgccatgtccctggagccccacccggcgtgccgccccaacgccgtctcctacaccgtcctcatgcgcgcgctctgcgccgaccgcctcgcggaccaggccgtcgggctgctgcggtccatgcggtccgccggcgtccgcgccgacgtggtcacctacggcaccctcatccgtgggctgtgcgacgccgcggaagtggacaaggccgtggagctgatgggcgagatgtgcgaaagtggcatcgagcctaacgtggtggtgtacagctctttgctccaagggtattgcaagtctgggcggtgggaggatgtaggcaaggtgttcgtggaaatgtccgagaagggaatagagccggatgtggtgatgtacactgggttgatcgatagcctttgtaaagtggggaaggcaaagaaggcgcacggggtgatggacatgatggtgaggagggggttggagccaaatgtggttacgtacaacgtgctcatcaattgcatgtgcaaggaaggttcagtgaaggaggcaatcggtgtgctgaagaagatgtccgagaagggagtggcgccggatgttgtgacatataacacactgatcaaggggctctcggatgtgctcgagatggatgaagcaatgtggttgcttgaggagatggttcgaggtaagaatatagttaagcctaatgtggtgacattcaactcggttatacagggcctttgtgatattggtaggatgaggcaagcgttccaagtccgtgcgatgatggaagagactgggtgtatggttaacttggtgacatacaatctgctgattggtggactccttagagtccacaaggtaaggaaggctatggagctgatggatgagatgactagtctagggctggagcctgattcattcacctatagtatactgataaagggtttctgcaaaatgtggcaagttgaccgtgcagaagatcttttatctacaatgagagatcgtgggatagaacctgagctatttcactatattcctttgcttgtagccatgtgtgaacagggtatgatggaacgagcgaggaatttgttcaatgaaatggacaacaactttccactagatgtggttgcatatagcactatgatccatggtgcttgcaaagcaggggacttgaaaactgcaaaagagttgcttaagagcatagttgatgagggactgactcctgatgctgttacatattctatagtaatcaatatgtttgctaaatctggagacatggaggcggcaaatggtgtgcttaaacagatgacagcaagtggctttttgcctgacgttgccgtatttgattcactgatccaaggttatagcacaaaaggagagataaacaaggttctcgagttaattcgggaaatgataacaaagaatatagcacttgattcaaaaattatttccactctttccacttctctggttgcaagcaatgaaggcaaagcattgttgcagagcttgcctgatttcagtgcagaaatatcaaaaggcaacatcaattcaccccaggagttaatgaaagtgttgcataatgtgtgcccccaaacaaattaaacctggtgttgagcctctttcatgttctcctgcgcaggtagccttcattccttcatatttgagatttaaaatatgttcctttgttctagatctgcctatagtttgtacatagttttgtccattcccaaatcataggtgctatttgatttcggctgcagatattaaatttggcacatctctatcagatgtagttagtagttactgcgtgtcatgcgtccattttcctcgtggttatttcagtaggttcttaatttagtctttgcttctctgtaccaatgcaggctatatcattcaaagctcccagcaatcagcaattgcacaagagagcaaaactaaatctgggtacatttgccggatcgttggctagctggagtcatcgaaattcacaggcaaatatgatcatttgccactctttagattgccacctgccacccagtgaggctgtgacaatgacacggggggtcgatgacatatgggctaggatggaaaaacatcaaattcccaatctaagagtagcaaatcatcaattttgggatgaggatttaggatatagcaacttgcaagtatataggagacaggaagtccatgtccagcaagtatcagatgggcatgattcacggcagtacggatgactattttcaagggctagcatgataccagcatcaaaggccaggaagcaacgaacttgaaagtttcgtttcaaactcgataatgacatgctactgtgtcatctgctgccgacatctccatggtcttggtgccagagctggacttcacctgctcgggtcctgaagaggtggcatctgtgcttccaagggcttgttctccattgattgatctagcgtgtatgcagccttttctaactgggattaagagttgagattgtttttcttgtccctggtattgttaatttgatacgcaaattattttgacgttgtagtggtatggcaaaaagtatctcttttacggtacacaaattttctcaagagactggcatgcttcgtagtcactactcaaatactcaatgatgataccaaacggttattctcgttgcaattgccgaaatgagttgcaatggcaacttttatgtccaaatgcggccgtttgcaattggaaaaagagaagaagaaaagacgctgcttttcagattgttcggcgatgtatactccaccgcagtacatctccgaacgatttccctgtggaataagttcaccagaggtccctcaacttaacaacgagatttatttaggtcactcaaccacaaaaccagaaatgttcacccctaaactcattcaaaccgttcaccggaggtcccttggcagtatatgtgggttgtttcgctaacgtggcatcctagtcagaaaaaaaattaaaaaattttcgtggggcccacatgtcagctgcggtttattgtttcttctcttttctctcctcttctctttcctctcctctttctttgccggcggcgggcgcggcgatgggcgagcgcgcggctggagtaggtggaggggcggcgtcagcgcgctagagcaggcggagcggcggcgtctccgggcgagcgcggctgcggcaggtggcggacgagcacgacggcgggcaagcggcggctccgagcgtgggtggtgcgcggccggagcaggcggagcggcggcgtcttcgggcgcgggcggagcagaggggcgggggacgcggcggcgaggcgtcgcctctttccccctctcccgccggcctcatctcccccactccgcccggcttcctctccccctctccggcggggcgctgggagaagggcggtcactcgcgggtggcgtggacagggccgaccacccgactacccgagcccggagctccgtccgctcccgtcgctgcggcgcgccaccacgctgggctcctctgatgagtgcgacggcggcgggaaccagcggcgagaagaacagcacgcagagcgacctagggctaggagtagaggtgcatggcatacctgctctccactccacgtcgacggcgccgtcgatttggccatgctggtgaagtttcccgccgcccggccgtcgccgtcgccgatgacggccgaatccagattttccggcagcagagagagcgcatccccagctcgctgctcgccgccggtcttggggaagcggcggcgtcggggagagtggagagaggtcgggagtgagcgaaaagccgagaaggggaggaggatgacccatcgactcaggcattcgactgccacccccctctgattcctccgccaccggcggcgacatctctgtcggccgcggggatcccctcccggaacaggagcccgtcccggatcccgccaccacctcccgccgcggttgcccacagtccgccgccgctctcgccggctgtcgcctcgctcctgcctgcttcgcatgccgctgccgctctcgccggccgtcgccccgcccgtctcggctcgtccaagaagacgagagaagagaagaaagggaaaaaagaagggatgtgggccccgcaccgttttctctcacttacatgtgggccccacgtattttatttatttatttttgctgactaaaatgccacgtcagtgaaaccacccacatatactgccataggatcttttgtgcacagtttgtgaaaatttaggggtgaacatttctgattttgtggttgagatgttaagttgagggacctttggtgaacttattcctttccctgcagaagaaacaacagtatctcgtcgagagcagtgacacaagtttgacacagaaccgatgaaaaccgctcagttttcttaaaatttgaagggatttttaggctaaagatcgtagacccggcttttaaaaaaaacgtctaagaggtcttccggctaactccacaagatggtgggttagctaacctgggttcaaaatctcatttgatattagatcttttcataatattcgcttttttaagctggtttttaatcaaaagtcacaaagtcagaaaatttgaaggtttcgagccaacacgagttgacaaacagcacactagaccagtcaaatataatttataaaaaaaatcaaattacatttaattatttgataaaatttgttcgtatgtcattgccttttactagatggtttaccttaccgctatctagtggtatcacagttatcaatcgtttggttactataaaagcgataagatattaagtggtatcacaattatcaattgcttggttactaaaaacccaagaggtttttgattaaaaaaacctattagcttttaaaaataaataatactccctccatctattttcaaatttgaaaaatttatttttaaaaggcatatttcaatctaacaacctattatcttaatgacattctcggatttaatgtgtgactctctattctttcacacaagattggctacatggatatcgagaaatgcaaatatcaatgaatcatttgtttacgagaaatgactagtagcatgtttaaatagatgataagtaaaattacttatccttggtctgtgtgccaagatgaaatatgactattaaaagtagatggagagggtattgtagcaggatgttactgtgataagtgaaggtaattatctgccgcactgctgatgctagcaaacagtaaaactgtaaaagcttcaggtcaaactcacacgctggcccagttgctcagttaactcctcccaataatctcacgcgctctcctctcgcatcgaccctgtccctctctcatcatcatcattcatcaatcgtcgcctgatcgcctccagcgaaattcttcctccatttctctctccatcgaatctcatcccagcagcagcagcagcagcagcagccgccatggattccaaggcggacgcggagtcagccacggccagggccgccacggcggc

SEQ ID NO: 15366 - DNA, 22191 bp, Oryza sativa
ccccccccccccaaatcccaatttcacatccgcgtgatcgaatcaaacacctgttcatcatcatctgcagcatccaagtatccaatccatcactactactactgatttgtttcaccaatgctatgtgattcttctctgtttgagtgcttacttgttcatcatccgttagcatccaattaatccgtcacttttcagggtcaagaacactaattctgctagtactaatttgttccaccagtgatatgctatgtgagatgtgattcttctctgtttgagtgcttggaattggaaattcttctgcattgctgtagtgaaaactgggccaagcattgctgatacggcgatggggaggattgctcagatatccaaggtgatagctgaaggtggatatgacaaggtgttccaccagacgttcgagtgcctgcctgatgagaagctcaagaaggcgtacgcatgctacctttcgacctctcatggcccgatcatgggcgtcttgtacatctccactgccaagattgcattttgcagtgacagtcctgtggcgtatgtcaccgaggataataagaaccaatcttccatctacaaggtatggtgatttctttcgtcatatgctctataaaccacatgattgtttgctgatattcaagttcttggtttcgtagaaattatttcagatgctggtttgtatcagtatcataaatgctatagcaaattggtactaccctggttccaaaatataaacatttctgcatgttttccaaaatatatctggacatccctccttctggatacattttgaaactcaagcagaaatgtttatattttggaacggatggagtattttataagttatctcaactttgtgaaaacatactaattacgaagaaggcatggaagataagaattccacgcgattcgtatcatgtatgctaccaaattgctatttcaagtcaagtttcggacgatttgcaagggatcttgtagaaacacacctgatcatgtatgtatctgttttaacaggtagttgtacccgttgctcagctaagatcagtcactcctacggcaagccagcagaacccagcagagaggtacatccaggtggtttctgtcgacaaccatgacttctggttcatgggcttcgtcaactacgacggtgccgtgaagagcctccaggaggccgttcgtggcggcaaggcttcacttcaccatcacatgtattttttgtgaacatcgccgttacatgtattgatctgtccgtcgttcgtcatgcatcactgggaattcgcatgtgtcggtgtgttaaattgtctgtacagatcgctccccttgctgtgtatattggctgaaatttgtgttgcatatgcattcatgtattgtatgtagtgtgtggactagatgtgtacaaatactggattgattgttggcttgatgctccattaaagcctttctgttcgttgttcccattctaagttcaatcacatgatgagttgacgattgctgttgaatatttttggcattcccggagttaatccatgctgagaagatattactaaacatggttttgggctgtttagtttacgtaaagtgttggtattgcaaaaaaaaaaagaagataatactgtattagcaaagaacaaatcatgccagaaaaggtaaatgcagcttccaaaaaaaagaatgttgtttgaatagaggttaaaacaaattttagaatcgaagttctcacccttggattaccacaagtgacgatgaatttcctttgctgctagcaaacatgttgcgctgttagcgcaggtacaatagcaggctataagccagctgcaaacatattttaagaagataaataaggggagagaagagcagcgggctacaaatttgtagccagctgtagcacggactccaaaacgcagtgtgtatatgactgatgggaccagatattaatagtgtagtatgcaactattgtatgaatgagctattaaattgactatagatgaattggagctagtagttggctgtactattaaacttgctcttacctcatttgctttgacgccttggcccgcccctatccctatggaaccagagccggtttataggatggcgcctgtgcagtgcatggctgaggccgtggggaaatgaggtcgcagcctcacacgcatatgtatactgcatctgaaatttctgttgtgtaaagcatcaacaacagtaaaaatgtagtcttcaagatcgaatatacagaaatttcaaatttctgttgtccaaagcaaatcaacaatactaaaaatgcagtcttacagaatcaaatatcactatagaaatttctgttgtgtaaaacaaatcaacactaaaagtgcaaccttcaaggatcaaatatcatccacaaaatatgaagttaaacatcacaaatatccagggcatcaaagtgacagactaaaaattaacgaagctagaaaatatcttctatgcaatgatgattacagaacagagtatttcaaaggtccattcgtttcattgactcgtccaagttctgtaaaaaaaaaatataaatagttcaaatgatcaatatttctaagcaaaaaaaagatacattttttctaaaataaagcattaataaagctttctaaaatattgaattattggtgatgataaatttgttttccatcaagtgattatccagaatttgtaggccaaattttggaggtgttaattaaatatgatagttgattatctagtttgccagaatttgcataactaagatagtacatacaggaaactgacgtaatttgcatcaactttgctgataaactatcagatttagaaaaaaaaaacaaaagaacacaagaaatttactaaccatggaatcatcaataaccagatccttcatttggacatccataagcttccacaatccattgaatcctctaggcccaggttctgtacataaacatgttagagagatcaaatgggtacatcagctcatctagttctgtaagatgaactaaatgcatattaacaaatgcaaagaaacatgcagagtagtccatctagttctagaataaagattcatcaggtaaaattttactctacataatactgctacttaaattagatcctctcaacctgagattgctaatttgctcatcaagcaagcaaacaaaagagaggtactaagcaatgaccgttcaagtctcttccagccacaagacttagtagatgcagaaagtacagatggacaagacttagggtttatggaaggaatcatataccggtgctcacgggcgagagaaacccagctggacgaaggtggcgatgtggctgggtgtcctccggagccctcatcgttgctgccggtggagtgtcctccggaacacctcgccggtcactgctcctccggttggccatcaagcagatagccgccgcccactggtgcctccatccgccgctgccacaggtagagcacctcgtcggtcactgctccgccgcctgcaggtagagtgcacaccgacggtggagcacagtgccgcgtcgcctgaagtcgccgccgctgccgcgtgcgagacgagagcacacctagggtcaatccacgtggaccctagggttcactgggtgtcagccctttgttccctaaaaatatatgggccaacccaagaaccttttggtgccaaatttttagggtcggccagcgcacctaatgggtcgatctgccccctttgcaggctgaggtgtagcattatataacactaactaaacagagacgattttgctatatatttgtcgacaaatttttccctaaaaatttgacagatgtaattacagtacaatcgtagtgtaattacactataacttctatgtaatcacactgtaactatagtgtaacttgtatgtaactttcaaaaatctctccgtaatatgttatttcggtaaaatggaggtcgtgggaacaaattctttcacatatgtgtgtgctatgatttgttttcttcctcaccaaaacaaatcgtgtaatagatctaacgattcaaaattatgtgaaacttatatataagttacactgtagttacatgcaagttacagtgtaattacatataagttacagtgtaattacactacgattgtactataattacatctgtcaaatttttcgggaaaaatttgtcgacaaatgtataggtagtcccgtttcgggaaaaatatgtatagcttacataaaaattcatgagtggacgtccacatgagccaccaatcgtttattcgacaaaatcagcataactggcaaaaagaaaaaacttgcagctagcacctactcctatcaatatcctacatgagtattatgatccatacaagatcattcaattcttcaacctactgagatgcttcacaattttttagagcttcaaattttatccatttgcttagtgtgacaatgctccaaacaggggtcttggaaatacatgacattctcgacgcattacaacttacaagatagcatattgcatatagttaagttaagcaacaactgttgtataaaacactaaggaatctgctcaagaaatttcaagcttcacaaggagactaaattaaagataacatatgctggattgattccatgaagttaagaaacggtcagcatgtaacattgaaaagtctgctatagaattttatacttcaaattaggggactaaattgcatatactagaattaatagaacattgaataaactacaaacaatcattatgaacaaaacaaaagaaaaaaatcaagatgaccttcatggcctcacactaaaatatagtaatgcttacgtctatagagcaacaaatggaaggaggcatgtcttggaacataattcccggcagactttctctgggagtctattattgtttatagataaaactagataaagcacattttccatgccttgcatagatcaatttctaggaacaatatactgttgtgttagattaagacggccatcttacaaagaaaatgccatttattactaaattccctaaaatattctaaatgatattttagtactttaccaaatagtgctacaatattcagaacacaaatgggggctgttggcatcagataattattagtggtaatggatcagctgcctatattatacacataattatttgtaccaatttatacaaatttacatgatatgttaataggataggtgcacagacctgagatggctataacaatcatcactgctcctgaagttctccaagcatgcccaacaaatgtgactgccacatttacactcgacatggttgcaaccatcagctttctcgattgtaaagtggcaagaagggcataccttcacattctccttccccttgcgccattcaagcagagttgcatcagggtcttccttgtattctttgtatgcctcacaggatatgaaaggatgatattcaagatgacacttgttgcagatctccacaaagcaagccccacagacaaaaggtttgctttcagcatctgcagcagccacttggtaaatggatgggcaatcaggagtaggacagaaacgatattttcctgcattagaagcaacaaatgctctcaaggaggctctaaatagctcttccagtttctcgctcgataggagagatctcaaatcaacaacaaggagctgcttcttgcacccatttttgaggcaacacagagggaaaccatcatgtgatttcaaagcagattcacactgatccaccaagcaagtcagacaaaacacatgcccacaagattcaagcttaaagggatcttctacctcacacaggcaaatagggcatgcattctctaatggaagttgaagcaggccattgtactttgtagaatttaccagctcagagatcatttcttccaccctttgcttgtcttctttactgcctcgaacgtaaagtgtatgttgtcgtaaatttaatcgaagctctactgcaggcacctctctcttcaatccttccagatcagccccgaacttttttaacatttccttcatcaagtttggaggtaggttacggccacgaagacgaatatccaaaggtttcttatcacggagttgtagaagggcatggatcaatttctcctctgctgcagcaacctgatcttggagtccaaagactttaatatttagactttgtctgtcatacagaatgtaagtgccagtctcttgctcaacagatttcaaatctgctacaccatcacgggacatgagcaactgaactgtacttagtgtcagatcaggatggtttattgttttgcctttcattaaaatctcaagaggccttctcaagtctgctattgtttttgtggcgtttgcagtaagcttgacacggaatataccatattcattcttttccaaattgtaagacacgcctacatgaagaagaacactggttaaggcctgaggacaccaacacatacaaatatttttgcagtccaaaacaactaaacattattaaggccgtctaagaaaggtgtcactgctagttaccacgcagtgaccaaatgaccaccggttattgaatgtaaaaactgtggatggaaaagacctggataatatttacatctactgagataaattaggaatgcaactcatagaaaaaagtgacattttcaaacttccaaacatcatcagttagcaacattggtatacacattgaatggtcacagatttgcccttatcaaagacaagatatttgtttgacgaagggccagtggcccacatacatagatgagccaagatttgagacccatccaaactgccttgttgtgtttaattttctatccttccacaaaatagaaaacaggaaagtaatttttttcccatcaataaaactatgaatttcagggaaaatatgcctcaaacatactgttcgtaaatcatataaaactgaagtatgggaaaataacattcatgcaatcatgaaaatgaagaggatcattcaactgaacagtatggaaaattagaagcagcagagtttaagaagttataaggaatgcagaattacctttttggcttcggaagctctcaagaagagaagcaactgcttggctgataacattatacacgcgtacttgacaggacacagtactatgaaacacatgctggcattgtattgtctgccaaggaagacagcatggaagaacacttccttgaagatgttccaatgctcttgcagcctctcgatgaagacttccatcaaaagtaatagtggctctcatcaccgaatcattctcctctggagttaacacctcaacacggaaattttgggcaggaaaaattttctttggcatgaaggaagaaatttctctatttagtgcttctgcacacaaggaagcagaaggggcagctatgggtgttcccctgagcaaatgcacatcaacgattttccttgttgtcgtgctacgaaaggcatcatacaattctggctctgttacatgcattggaattcctctgacaaaaatgcaattctcatgtcttgtactaacctcacagttgatataccttccaccaactcccagagcaaagcagtcctttacaacaaattcagcttccccactggcacatgttaccagcgcgagtccccgactttgcttaagtggccaagatactttagctctcactgctggaaatggtaatcctcgattactggaagagcatactggaaccactttcaatggagaaccatgaaattccatcccattcaattttgaaacagcatcttcagcatattcaggattgaggaatgtaaacttcccccacttcgtttcatctgaggccacctgaagatttccataaagtttataaaaattagcaacaccagagataagagtatccaccaagcaaataagctccttgtcattcaactcatgagcattttgatgcaaaacctctacggtcagatacctcttctcaagttccaaatgctttatttcagcaccagaaccaaatagggcaagagaacaatcaccaggttttccagaaaacaaacttttctcaaggcattcattcctcaacatccgagcttcacactccaatgcatcattaacgatgccaaacaccttttctatgtcttgttctttggcaaatagcacaacctctttatttctgaagtcaacttcaacagtcacacggtcatccctgaattcttcttggagaagtgagattatcttctgctgattttggccagattttccacaaaattttctcagcaagttatatccaagtccacttattaccttcacctgcaatttaagcttctccagttgctgaatcaaaggcatggggtgaatcgaacacaaagcatcaggatcaatagcagttacacataccaaatattgatttggtactgacaagatttctgtgaacaccacccactcaggcttgctatcataaatgagcaatgagcaagagggatgtagtttcacagcctgatccgttgaaatcacctggtaaccaaacctttcatgtccagaaaacatagcaatattaccagaaagagatgtgagaataattctttttagcaacttatcatgcacggtggactcctcagggttccaacaccagtaacttgggacaatgatgttcagctcgtgtcttaaacaattctcaaggtctgatattgtttcctggcacctcctcatggtcttggcattgatgctattctgccagcaccacgtattcctgttttcatgctcatcctcccactctttatatacagctagtaaagtgaacagatctccatcctgatgacagaatgggacctttagacggtcagctttgtatttctcctcatctgtgcccactctacaaaatatgctgctagaatttgccataacagcagctagaactacaccttccttcctcaaaccaaaaccaaagcaatcaagcatgattttcccaagcctcggctcgattcccaatttaactaggtagcgaccagtatcagtcagctcaaaaccatcacatttatattttacagcacccagttgttcaagattctttacagccatattaatagcttctgggtttggggcatcaacaaattcaaaattctgtgcatccctaatacccagcgcaagtattctcagaacagcagtgccaagatgaactttgcggatttcaggttcttgatgcacttccatcatactgaagtcagattcagagtaaagcctgtaacacctccccgctccagttcgacctgctcggccagcacgctgattagcagaactttgggagatccaattaactttcagtacattgagaccactgctaggcacaaatctgctctccttagccagtccagaatcaacaacatacttcacttcttttatggtcaatgatgtttcagcaatatttgtgcagaagattatttttctcttcccaggatagctcttgaaaactagactttgctctacatgggaaagctttccatgcatcggaagtaccacagcatctgcatcgctgaagttttcacatgcccattcaacttcgagttgagaagtcaagaaagcaaggatagcaccctcttcttcattcttgtgaatgatgcttaccattttcacaacatcgtaaacatatgaagcagtagcacaagaaccgcgcagatggtttggcacggtattgaaggaagcctcttctgatatatcagggacatatttaatttcaacaggaaaacttcgccctttaacataaaatgtttggcatccataaaaatattcagcgagtctattagcatcggcagtagcagacattatgataagtctcaaatccagcctatcaagcagtttcttcttaatcaaagctaagagaagatcggtgttcaagcttcgttcatgcgcttcatcaacaataatatatgaaatgccatctagtcccatatcattcatacagtgatgcaaaaggcagttgtctgtggtatatataatctttgaactgaaatcttgatgatctaaaaaggttgaattcaacacaaagttgtccccgtagcaaccattgctttcttcaactactctatgtgccaatgatatagcagcaatttttcggggttgagtacagacaattgaaccattagcagcaagacctgagtcagcaagatactgaaccaattgtgtgctcttcccagaaccagtttccccaatcaaaatcatcacctatggaaaacaaagctatacgacttaaagaattatttacaaatttaattgaatgactgatagtaaatacagaaaggtatgggtgcaacacaatatgtattagagaatgatttacaaatttaattgaatgactgatagtaaatacagaaaggtatgggtgcaacacaatatgtactggaaaacttggacatgctacataatcaagactcctgtgcctcatgagcaaaattgcatcttatttataggttttgcctataagcatagaatattctgccaaccaaaattcataagaaaaatgcggcatgctgatttagaatgcaagagaacctattcaaaacttcaaacagagttggaacttgatggcgcattgtatgtgaaaacatgcacaaaactaaattcctaactcaactctttcttccagagttccaagcataacagtaaagatctaatggttctttctgcattgcaaacttccaaattccaacccactacagataaaactgcattgagaagtctggctctcacctggttagcgaaaatgtgatctagaatgttcctgcggtaagcatagatgggtagcccctccttaagccttctacattcccgcagcattatcatgtgcagcctagcgaaattcatctcaccacctcccccaatcccaaacacctccaacccttcctcctctgcctcctcgtcatcctccgtcccacgcaacaatgcacgccgtatcgatctcatcgcggctttgtactcatcgattttagcatctaccaactccttctcagccttgagagttctcttctgggcctggagctgctcgaagtcgcggatgcgattgtgccccgccaggcggcgcttcaccgcctggatggaggccgcgagctcggaggagcgggcggccgtgagggagacgaggtcggagtcgacgaggcgggcggcgtgggcggcgaagagggaggcgatgaggggggcggcgtgcgcggcgagggcgggatcggagacgtccggggtgaggaggtggaggccctcgaggcggagcgaccagagctcgcgcgcggcggcggcggcggcctgcggggagcggaacgcgaggcgcgcggcctggcggcccgacgaggagacgctcaggctgtccgggggaggggagggcaggccggcgacgagtgcctcgacctccgtggccggcggcgccgagaggttgctccccccgcggaggaggatcacggcgaactgccgcggccccggctgcgcggggcgataccgctgctggtactggtactggttctggtggtggtggtggtagcggtgcggcggcgggccccagtccggcgggcggaaggggcggccatcgttggatcggcgcatggcggcggcggcggaggcggcgaggttgggtttccgagggtttggggggaggttttggagaggggaggaggcggtggggtgggaatcgacgggaggagaggagggaaaggtggggggagaggcggacgagacgaaggcctttttctcgcggttttatgatttccgtttccgtttcttttacggttcttttttttttcagatagcgtccgtttcagtggggatgatggacgcgtgaacggatgaacggacggctgtggatgatgcgatagggcaagtattatgaacatccaagcacaagtcccaagatatcacataggactaaatgataaggtggaggagagaaaaaagatgagagataaatagccatctctcatgcaaggggcaatctctacataaacttcaataaacatgtaaaagtgttagaaatattggagattgtgtgatagagataacctataatatatgttacctcttaatttaatggtgtatgtcatgaaattagatgtggtagtcacctctactatgaaacttgcccttagaggctaggctacttactagatattttttttaagaaaaggttttactctttctagattgattatatagtgcctcatctattttagattataagtcgttttgactttagttaaaatcaaactgcttcaagtttgatcaagtttgtagattaagtttgattttgaccaaaatcaaaatgacttgtaatctgaaacagaaatagagcttaatgctcacttcccattttacattttttttagaaaataaacgaataaagggtttacacatcaaattataatgctataatataagaatggataataaggtctattgatagagttttttaattagttagaattgcatattcccgctctgtgttttaaagatatgttgtttacttttggacatgacgtttgatgtccatcctattaaaatttattacaaataaaaaatcatactaaagaaagtgttgtaataataataaaacaagtataagattagtattttcatagtttttaataaaagcagatagttaaacgttgatgtccaaaagttaatagcattatatatagaaaaacggagataatgttatttttggcgtagctattagctaatatgaacttctacatacgtccaaacatagcattaattattagttcggtcatacatcgaactcctgttcaattttattctcccgtatctagtttccatgttttttttctgagcttagacagttagacggcgggcaacatagctctaattaaaggatttgtttttagcacgatcacttacgatcatttgcacgtgcattgtttgttgcaaacgtcctatttcatgatttatttcccatatccttactcgagtttggcctaaactaaatcactaattgcaatttagctcactaagaaatatttgcacgacgttattcccaattttccaatgtttcgaagctttttcgcccgtcaccatcggaatttcgtggctggtagctttgttctggttggcactaccaccaagcagtgcattggctaccaagtgggtgcctctttgccaatccagtgtaagcacactaccaatgatcacatagtggttgacgctgcaacaaccattttcgtgcaaagcacatttacttcactagcttgctttcctgcctggttgagccaggcaatccatcttatccaaccttttggccttttgctttgctttgccgatgcactgcacagggccatctcaggcttcagtgctggttaaagcagccacacactgacatttctagtggtgcagctgagtcattatgagtcatgactgcagtaaaaaaaatgtgtaggcaacagctccagggtttcagctgaactgaagccaaactgccaaagatgtgaagctaaggtggtgaatcatgagagcttccaatccatgtttttccaaactttcctatgcaaccaacacaatcatatcatatgaacattgcacggtgggacagcaagctgggtacattccattgttccaaaggtgaattatttgaacaattccgtaacaactgtgttacctaaatacagaagcgccttcttcgacttagaaccagtcaggacttttatttgtaagaactgttcaatagaaacaagtgactgacagcatcagctcttggttattttgtccggttattcatgaaagattggttgggaatttgtgggatgatagcatgggtttttctttgttatggcctacaagggtccagggaatgtgccattctcacgttgttcgttccaacgctcaatctgcacaaaagataaaacacactgtgtcatcaaggagggtctctgaaaacagtgacgctttactagagcaatggtttatggctaaagcatcatagaagcaaataatattggaaacatagagttttaggcttatataaggtgacaattgaattactagagaggcatactgtagattataatggaaatctcagataaaaaaactgataggcatgtcagtgaagaaagtgtaacagaaacttcatacgccataggaatacctagatcatcataacaaagcaagccacagaagtattactgaaaaaatcgatataagaaatgcatacccattcacttgggcaaagtgatcgataatattttgcaaatttttcacactcaggagcaccctctccttttgcagctacacacctgttatatgagcatgctcaaagtaaatagtttaattaacaccaaggtttcaggtatgaggaatctgaaactgaaagatctcgatcatattcatacctatgatattcaatatagcgtgtgaagcaatgccttgtttgatttgttgttgggaaacgaaaatcagcgggagccgtctcaatctgtatattatatatggtcagtactcaatactgaacaacaaatgtgattgcttttccaatgataggtggtattgtattgtaccttaatttctggcttctcatcaattgtttcctcttcagcctcattgctttcctctgtagcagcattgctcccctcttcttctggcttctcagaggatgctgtcatctcgggagtttcacttttgtcctcaacaacagaagtggtgtcctgagctgctggtgtttcagcatctttctcaggaacaacttcagccacactgttatcagaagatttttcagaggatgaattttccacagggacctcgtggggtgggagtgtgtgttcctaaaaaataagatggagttcaatattgtttatcaaccatggaatatcaattacagaaggaacagcaacacacagaagatagttgggctcaagtgcgcgtctacattaatgcaagtgtcaaattgttgctacccacgggatactcagggtaacagtgttctaggcttaattttggtaatattttttcacagatatcatccaccgaaattttgaggaataattgtgcattgtccagggcctccatatcctttattacagtacttagattactttttcttttttgtgaggacagtgcctagattacaattggactatgcagcggactcatacaagattatgggttcagtctcaatatatcctaattgtaactcttccaactttgaggctacacacctaagtacgcaaatgctcaacaaaaacataaaaatagaaaatatgaattatcctttgaatgacattttgtactacctccgccccactggaaataaagtctttttggcacggaagtagtacatttagcatcatatcagctttatcataaactcctaatacatgcaaaagcatataattttataagctgaatgtttattacttaattcagacaaaataaagggggttaacttcaatcgcattgctcatgcataatttgattaaggcaatatcatacggctacacggtaagtttgtgagcacggaatgatggccaccacatctttgaagctctgtacgcgtctgtgcagcaccaaagttacacggtagacaactagtcaacgatttggacaaggcaatcgaaggggaaaaaaagagatttactgacggcgacagtagctaacgcctaacagcagtcgcaactgagccaattcagaagacggaacgagttaattcctccactcaacccaactaatgccctgtttagttacaggagtgaaaagttttgacatgtcacatcggatatacggacacacatttgaagtattaaacatagtctaataacaaaacaaattacagattccgcctgtaaactgcgagacgaatttattaagcctaactaattcgtcattagcaaatgtttactgtagcaatacatggtcagcaattaggcttaaaagattcgtctcacaatttacacgcaatttgtgtaattagtttttttttctatatttaatactctatgtatgtgtctaaacattcgatgtgacatggtgaaaagattttacgtgggaactaattaacagggactaaacatgcacacatgcatccaagagaaatcccaccgctccaaacctactcgcacgaagagaaatcccgccactccgaacgcgcgaaccaatccactacgcgatcacagattgctgggatctgagcgcgcgcgcgtgcgccgccgccgcaccagtccaccggagcaggccgccgcccgcgcacgcgcgcgtaaccacacctcgagaggcaaactagcaaggcaccaaaatctgggaagcgggaagcgatagggatacgggattcccatacctcggcggcgagcgtcggggccttgccttctcccgccgccatgggcgcctcgcgagagagcttccggaagcgagctgagccccgtggaaagagagagaagcgtacgcgtctccgaagtccgaggcttcgagctgtgtcgttcgagaaggtaaaagaagagcggcatttgtgggttttgggccgcgctacgacaaattagttcactggaggcccagagagttggctttgcacttggacttgaactgacgccttctctttcgcaacaagtctaatggaataagttcatctaaggtcccttaacttgtcaacgaatccgatttccatccttcaaccgcaaaaccagatacaacgggtccctcggcggttttgatgccggttttggctgacgtgacgcctacgtggctaatttgacttggtctcgatctgacgtggcactaatgtggtgcttacgtggcaatttgatccgaaaaaataataaacctcgtgagacccacttgtcagtttcacacagaaattaataaaaaatggtggggcccacgtgggccccatgtatcattcccacccctcttcttcctgtcctctccccccatctcccatctcttcaactctctctcacatctcttctcctgcgacggtggcacgggcgattcgggacggcagcgggtctagtagtcctccggtgccagcggctagtgcgcgccgccgtgcggggtggcgtcggcggacgggatgacgaggtactcgtagagaagcccggcgaggccggcaccgatgaaggggccgagccagtacacccagtggtgcctccagtgccagccgacgagcgctgtgccaaacaccctcgccaggttcatcccggtgccgtcgaacggccctccggcgagcatgtgtcaagagatgttgcattaacagatagcattgtcaaatacatgcttgataacacaggcaattagcagagaatgtactagtgttagactgataaatgaggatgtatacctcccggaagtcagagacgtcgtcgtcggggttcaggtacctcgtggaatttgtcctcgttgccggagtagtcgaccacggtgtcggaggcggagtcctgcgtggagacgaagctctgggcggcgaccatggcgatgtccccctcctcctcctcgccctccctggacagcggccgcggcgacgccttgacgggggcgagcaggtggtcatagtcgacattggacagcgcgcctcgctcgcctgcttcgccgcccacccgtgccgtccgccgcccggaaagaagagagaggggagaggggaaaggaagaataggagtgaggatgaagaagagagaagggagagggaggctgacatgtgggccccaccattttttattaatttctgtgtgaaactgacatgtgggtcccatgaggtttattatttttcagatgaattgccacgtaagcgccacgtcagtgccacgtcagattgagactaagtcaaattagccacgtaggcgctacgtcagccaaaaccgctgtcaaaaccgccgagggacctaatctgtacccgtttttatagttgaggattcgttgtatctggttttgtggttgaaggacgaaaatcggattcgttgacaagttaagggaccttagatgaacttattccaagtctgattgcttccgcccaaagtctctttttagcacttatacatagaaatctaaatcaatcatgaatgttctagttttcaccgttttcatattataagatgttttgatcttttttaagttaatttatttaattattttgcgaacacgtaaaaggattacacgtcaatatattaacaggaaaagagtttttgttacacaaagcaatcagccagactggcttatgtctaaaggggggacttgaagctatgaactactacgacggttaaaaacgcaactccaaacagcgggagggggcagagccacgctacactcccaagaaatcccaaaaaaagtaacaccggctaaagaccacagctggccctccgagcggatggactctagaaccactgcaaccgaagcgagcgcagagtcgaaaaccctggagtttcgttccttaatttatttaattatgataaatttatagataaacgtagtaattttgaatttaatgaaaataatttagtgtgatagatgtgtcgctatggtatatctgcaccagggtttttgcttctatagaagaaaaatcagcagggctgaattattttcgtatacggtctaagtgaaaaaaaaatcagaattatttaatcaaggacatacaccgtcgctaactcgctgtcaaccgcattttttatgcagaacagagaacagacaaagccttcagaaagacacgacggacagtttgagttaacagcgaggctcaactgtttcccagggtatcagcggttaatcggttattagcgacaggacgacgatgccgcgatcactcgccgttgtcgatcaccttggcgccgtccatccagatgatgcagcggatgctcttcccctgcgtgagcagctcgaacgccctgttgatctcctcgaaccccatctcgtgcgtgatgaactcctccagctccagctcctgcagatgcaagcatacacacaccggttaattaatcagacacaaaagatatgtagtattttcgttttaaaatatactccctccgttgtaggttataaatcgttttgactttactcaaaatcaaactactttaaatttaatcaaatttatagaaaaaaacatttttaatccaaggcaaacgtattataaaaatatattaaagtattgatttaataaaactaatctggtgttgtaaatattactatatttatctacaaactttatcagacttaaaatagtttgattttgaaccatagtaaacttataatttaaaattagggagtatattttagcatgaaaggagtaatatgaaccaaacaaattaattaaaatcccgttagatcgatcgatgtggatcaccttgtccaggtacttctgagccagcatcgggatgtcgttcttgggcttgatgccgccgaagagcgacccgatgaccgatcttccccggaggatctcgtgcgacgggatgctgatcggcgccttgttgccggagacgccgagcaggatcgtcttcccccacccctggaataacgtgaaattccgatcagcttgctgctgctcttagggcctgtttggggaggtttaaactctgagaagcagttatttggtagacagtttctgagaatctgaaaaagttttgaaaaagttttgaaacccagtttctccagcttctaacttattagttcattttttaaaatctgtaactacagattctcagaaactgtggactgtttgtggcagtttctagcagaagcagtttatgagaaaaactgcagctgacacaaagctccccaaacagagccttggtatctagtctctactgcacaagcagagcaagtagctcgtacatttcgagtgctttggaaggcttccgccatgaccgaagtcgagccgatgcactcgaagcagtagtcggcgccgccgcccccggtcatctccttgatgacctcgctcacggtcttcccgccggtatcgttcgggttgatgaagtcggtcatgcccagcctcttacctgcaacgcaatgagacgagttagccagataggagaatgattctaaactctcttagggaatattcgttcattatttgtatataccacattcaatgattataaaaaaattcagcaagattaatgcacgatacattacttcgcagacatgcacaatttgctcttttgttgtaattcatagaagtggaattttaactcacatatttatgtagtgatatattatatattaataaattatttttataactatttgaatgacatgctagaaaaaaatatcatctcgaaaatttaaaatcatttcccgacgtacttaaccacccaaaccaaggtaccgtttcatttgtgtgatttaaatattaaacagttcaaattttcgtatgaattaggcaacataaattcttcgcattccagacgggactgaattcaaacaccgcttcgagcttaattatcacgaacataccaacgtcgaatttgtccgggttcaggtccaccccaataatcctcttagccccacgcatcctcgccccttgagcaacctgcagcatgcagtagccagcacacagtcgtacattaggtcattagctcgatgagacgtcgacattgcattaaaattagatcagcacagagacgatcgatctactatgaccgtatttagttcactccaactgccctcaacttttaacttttcattacatcgtatttcaacttttcatcatatcacattacatccaaaacgttgctacacatataaacttttaactttttttaaaaacttttaattttttttagaactaaaacacaggctatgcatcagctgcagttgggcaccggcaactctggtccaagccaaacacgaacactaacttctcagtttggtggtctatatcagagttaagcactgtcgttaattaccgctaacccaacggcacccaggccgaacacggcgacactcgagccgggctccactgctgccaccttccatgccgcaccaacacctgcacgcaccaatcaaagtcgcagtcagaaatcgatccgataacacacgactgcgtgtactgcgccaatgggagccatgcatccgctactgtagcggcagagaccacatgccaaacaactgcagttaaggctgagttcaagtaggagcacacatcttgctccgcgtcttctagagctagccaaacagttttagtttcacctaaaatagcagtgtagttggatagaacgttgttataaaataaattagtgaggtggagctgggtttaggtccacccctatagttcaatttttttgagagagctcaatccagctccactcccattttaagtggagctgaaactgtttggctgagcttcagctctagctccagaagagatggagatagagctggagctgtgctaaaccgatcctcactccagactcaactcacgtagctaaaattaggagttgaaactttgccaaacagaccctacgtatattggcttggccttatacacaacgaaaacaagttgttagtgtatgattaaattgagaattaactattctaaatttgaaaattatttttgttttttaaaacttctgtagagaaaatatttcataaaatatatcatttagcagtttggaaagtcctctcgaaataagaaagttgttgttttgaaccgatgaatagaactcaactataaaatacttgaggcagaaaccactttaaagtttgtgtttttttcttcttctgtttttaccggtggaaatgccacaactgaggaggcatgccatcgccggtgggaatccaacatcgagcttgacaatgtgggtgatgtcaacgacggtgtactcggcgaagctggagacggagaggaagtggcggatgggctcgccggtggagacggaggagaagcgcgtcgtgcggtcgcgaggcatgaggccggcgacgttgggcagtttggagcagaggttgctgcggtcggagaggcagtcagggcactcactgcactgcgcggcgaacaccggcaccaccatgtcacccaccgccacctcctgcacgtgctcccccacgctctccaccacactggagaaaataaatgtatgataaaattatggcacacggttgagctacagctaacaattaacaagtattagaaaaaaaacacgaataatggacggttttttatatagaaaatatctctatttgtaattatttgaaagtcaaaggtagtaaatagagtatgatgaaaaaataatataaaatcagcttatataagtttcaaaactcaagttgtatttgattgtgaccgataaacca

SEQ ID NO: 15367 - DNA, 5410 bp, Oryza sativa
acacatatacactcctatcttaaaaaaaaccttcaaaaacaagagacaagagagaaacttgctagaaggaaagagataaggaataaaccggtaaaataacccataaagtaattttctctaaatcatatagttgggatgagtaactttatgtgtaacacattgcggataaatggactcagacagcgattgagatctgcaccacaactcatcccaactcttagaactcctcaataggtgattccagaagtctgatcatagctgctagtacgagcctaaatcaaactctctttttttacggttttaaaaaaaaacttttttatatcaatttgtggatactccatagtcagacgatttctccatcaagcgttgctgattagtagttactcactccattctaaactgatctacatataatttttttaattattcctaaataatctacatatttgtgttcatttattaagtctattcgttatttgtgcattggagtaaatggacattgatacatgcatacatgcacacaagtatttataacccacatgtaatatcttgatttgctattggctagaaaatagtgggaatcgtgcatgcattgagtttgatgctagagtaaatatagtatgagagagttattagcttttcttggtcttggtgtacctatgaaatatgtaaatcaatttggaatggatgtagtatactccctccgtactcgtaaaggaagtcgtttagaatagcgacacggtctccaaaacacaactttgacttcttgtttctataaaaatatttattaaaaaatgatatatgtatacttttatgaaagtatttttaagacaaatctattcatataatttttatagagtaaattgcatcaatggtacacgaacttgtcaggtgggtgcaatctagtatataaacttgtaaaacgctcattttgatgcatgaacttgtttgatgcgtgtgaacaaggtcaaaatcgcacggcaaggttaatcttactaattttgttattgatttaaactctatgtaaacatgtgtctaagaaagataaacatataataaggcgtaatgatcgcataacaaaaataatgcaagtagtaatgcaaggataaacacaaagaaagataaagtgaaaactaagtttgcaaatataactttttctactatgtgcacggacgttatctattaatttataatttataatgttcaacatagaaaattcagtctagtcatgtcattttagccttagcttgcacgtaccaaataagttcatgtaccaaaacaagcattttacaagttcatgtattagattgcacccacctgacaagttcgtgtaccgctgatgcattttactctataatattttcaaactcaacaacttgagagttattcatgatttagggcctgttcactttgatgctaaaaaaaccttaccaaattttggcattgccaaaattttagtatagttgccaaaattttgtcaacttgctaaaattttggcaagatttcttatatagttaccaaaaattggcagcaaactaaatgtagccacttttttgcaacttttactaaaatttggtaaggttgaaaatggcatcaaagtgaacatgcccttatattcccaaggtttgacttaaacattgtcctaaacgaatttctttacgagtacgaagggagtatataattgtgatactcctatctaatatctacgctcacctagccacctcaacatgcagctgtgtccgttaattgattgctgcattgataggatgttagaggatcaaacttagtggtttgtcacactaagggcacccgcaatagttatctataggctctctacaagagatccatatcagcatatttttctacttggaagagattaaatgaagagagagagcaaagctatctactaacctggagatagtctatagagaaaaacaaggcaatgcattagagagctatagatacccatgtagacgtactattgaagtggtttactattaatctagtctattactgagatgtacatattttataaatagcacattactttactattgcaggtgctctaataactatcacatggttttcggacggcgggctgggcatcgacatccacacattttatctcagctttacgcgcaggagccggaaatcgtcaatcacccgttgctggattgtcttttcgttgttcggggcttagtttttcgcctcactgtaaaatcctctgtgatcgctacgacaagtcatcgttatgtttaatgcttttctaatatattgacctgcaaaacttttacgcctcggaaaaaaattatactgtctttcctggtcaggaaggacgtactcctaaattaaattactatagagacctgactacgattaggtaaaggctaattagatgattagttcacccaaaacttggcaggcaaaagatagagaataaaatgcttagtacggtcaccatttttctaagccaccttatctacgccaatgcgacgactatccctaatgtcagctggaatatctcataaggacacgccaggtagaggttgttgacaatgattattgcaacacaagctttggatgcaaccttcccctacgtccatggattaattcacgattcatatcttcttttgaatggtttattcctgaaatttttcacggtcctaccatgttcaaaaacaatgtcattccttagctgttgatgctgtgtgttcattaccacgctactgatctgaggctcaaagtcatcttaacaccgacgcaggatcaaactcatcaggaagagcacaaaacagtacaaaaggcgaataatactagtacatacgtgcagtggatcggatcagagagtatgttcagaatcagaagcgtggaatgtctctatgtttataagagctatatagtttaatttgtttgattacgtacccgactgcttcatggccaaagatagacggatgattgccttcctacaaatgagaagagagctatgagcctatgagtataacctcatcatagagaagcaaaatagttcttggttgctctcaattctagacggatcacatctgaatttaaatacgcaataacctgaatttaagggagaaagaactgaagaattcatggttaccatacgccagaaggtgatgtccgtgtggcagatggatgtgcagaggatcttgatccggacctcgtgcgcccgcggcggcgccacctccacctcctccatctccagcggctgcccggccaccctgctcaccgccgctgcacgccgccgtcgacggcacagaacgtctcgtcagagaatcagccaacgacgccattgcaaaactcgatctcagatgctagctcacctctgcacctgatggactttgcagcagcagtgttcatctgctccatttccaggaagctagcctctcccctctatccttgttggtgtttggctgctactccaacttcgtggttgtcttatttaaagatcgcgttggaagctggaaaacgaaaggcaggcagcttcagctgtatatcacgctatgatatactcgtatatcttctgaaagcgagtggtcgtgaaaggggagcaggtgaaaggggatcaggttttatcgtcgtcgttttttggactttgttgtgtgttgggtacgtacggtgatcggctacgtgcctccctgttcgtcaccgctcatgtacatatgcactcatgtgactcatcgtgttcacgcattacatcatccaaacgcatggcccgtctggtactacagaaattaactgggctggaggctagccatcagggagtggaatccaagaaatgtttccttcagattttgtgaacaagaacatttggtaatgttgatgttgagggaaggttgtgacttgtgagggtggcgaagtgggagttgtggcgtcagccaattaggccattcccaacccaatgactataatagtgtctatagtattaaataagctgtcacctagaatgaaaaatgatgtggcaagtgaataaatgaggaaagagaaggagaccatgtcttgcatgagacatggtttctacacaatatccaagacatcgtgtgaaataagtagcattaaatttaagtatagaatattgatgtttgtataggaatagtagtgtctagtactagttttttttagtaatgtggagtttatagaaactatgtgtatattttggggaatggccttagacaaggcttagcagcgataaggcatgatgtgtcgactgatcgtcacctgtagcagtcttgaggtatcttctcttgtagtgtttttttatcatatagtaggagtagtagcgtgcctttcttctggtgttcaggtgttggcgtcttcaggccggccgtccatcagtcgttgtcaccttgtcttgtcttttgtcttccccttgaggttcactctatctgttcactccttgaaatgattggatgtgtctttctaaacaaatcatcataagttgagtacatgagttacaattaggcccattaagcttggtgaaaaattttcaccgtaggaataaattcacgggaggtccttaacttaacagcgagattttttaaggtatgttaaccacaaaccagaaatgtgtacccctaaactcacacaaactaagcacacaaggttctatagcagtatagatggacggtttcgctaacgtggcatcctaatcagcaaaacaaaaaattaaaaaactgcgggacccacatgtaagtgagaaaaaaagggacccacatctcctcattcttctcttttcttcgttcttctctcatggtcccgacgaaatgaggcacgccgccgccatctcccgcggtcgcggcggcggacggcgggagcatgcgcgcgggcgacgacgtgggcacaggtacggccaccgccgcggcagcggactggagcgagcgggcgatgacgttggagtcacgcggagaacagcggagaaggcgagtgaggcgggcggcgaccttgctcccgttcgcgtgaggcgtcggcgtcaccttcatcctccgcagcgatttccccgacgagctagcggaagaaccgggtcggcgggcaggcggcgtcgaggctaagcgtcaagcatggctccgatggagcggcacgtctcggtgggcgggtggagcaggaggggcggagcggcggctggcaaaggaggagccaatcggccacaccgcagtcatgctcttccacgcgcccgccgctgtccatcgtcgcttcgcccgccgccccccatcatcgctctgccggcatcccggcgccgctccgcccgccgtgctcgcccaccgccgctccgctgccgcacgggcctctgccgctcccgagggcggaggcagctggatccgtgcgccggcggaggcagtcgcccacgagctcgtccaccgcgagggtccgtggaggcgccgttcttcattgc

SEQ ID NO: 15368 - DNA, 4032 bp, Oryza sativa
gcaaccgcgacggcccacccacaagccagtgttcgccgggggctccccatttggtggcttcagcggcgacggcgctgctctccgaaactgctgccacactggtcgagtccgccgccgccgcccgcatctgcccgccggcctccctcagtgaagatgagaagagagaagaggagaaagaaaatataatgtgcagctgacatgtgggccccacatattcctttttattttttttgctgactagatgccacgtcagcgaaaccacccatctatttgtgtgcacggtttgtgtgagtttatggatacatatttctggtagttaagggacctaaaaaatttcgctataagttgagggacctccggtgaacttattcctttcaccgtataggtcccatggcccatgtgttcatcttacatgggctaggctttatactttcctgtccaatgtgaggcggcattttaattcagagcaagtccactttacgttcctcatattcgtatcgagtttaaacagtatcgttaaatctcaataccgaaattcttaataccacaaagatgcaaaactggataaattagatacacggcagtacggatgattggtttcgttgacatggtatcgtagttagtaaaaaaagttttaaaaaaatacgaagcctacattgtaagtgatcatcttaccttctttctttacttcctctctcctcccttcaatccctcgtctcatccatggtacgaactacaggaaccaagatcaatctgcacatacaccaacccgctaattgccagcacgcaacgtagaaaagcattgagcaatcaacgagataattactgcaccgaacacatagattgaatgcatcagacgaaccgaaaccaccaagagacacgtaacaaaacggataggcctcctgtacacgatcgaatcgggagaagaaatcacctgggacgcggccgtcgacagaagactgaactcgggaagacggcaccaaagacatgatcgattcaagagacgggacaaacctggggacgcgaccgtcgtccctcggcgccggcagcagatcaaacacgaggagaatggacagcgccgtggaacgccttgggcgctccggactcgggagcatggttcacagttccgacgaaaaccgatcaaattccacaaaatttcgttaaagccgaccggtttacgcaagcttatcggtaaactcagagaatttgtattcaatttttggtttatgaaatttgttcggaatctattgacttttcactggatttcgtgaaaacaatcattatattagagcccgaaacgaaaggtcacatcggaatcgtaaaccctcctcgggaggcggcatggggtaggagagatggcgtgcacgcgggtggctgccagcacacggggatgtgcctgcgtccaacacggtggagcacacgccgaggcggcacaggagtgatcgccgtggctaggccggattgagatccccacgatgacgatctcctctttcctttggataagagaggaataaggtgaagtgatcacttagatatggattccatatgtttttttttaaagtttctctttaccggctaggatactacgtcagcaaatcaatcatccataatataatgggatctaatttaggccaattttgcaagttagggtgccaagattttcggtattgcaattcagatatgcaatttaaaatttatgaactcgacacaaagttgagggatgtaagtatttgcgattgttgggctgttcacgggttctgttttgaagtcgaagtccatatttgcgattgaacctgggctggatggcgccgtgacttgggccatacgggactatgttttggaagaagcacacgtagcatagaattgagcaccgcagtgacacacacggacacacctagtacatgcttttgtaacactcttacaatagacaaaattcagaaataaatcattaaacctaaaaaagttgtatgaatcatacacatgcctatgcaagtacccgtaccaaaatttcaaggcaaacacttccactcactccaggttgataatacttatcgttttagataagggcacggttttcaagaaacaactttgaccattatttcttattataatatatatataaatgttaacgatatatgattttagtgaagtacttagtatttttgaagactaatctgtgcatataatcaccatatttcaaaaagacaaatattttataaattattcacaacgaaaaattttaatgttttatcttacccttgtttaaaaggataagagtattatcagcttggagagagtagctacgaacctataaacttatcccggaataaaaatgtccccaatatcatcatatccggatatcccctgtattagaccacggtctatcatcattcattttccgaagaaaaaatatccaacgttccgacccaccaccaccaccaagcatgcaccggccaatcgtacgtacccggtccgccgtcctccgccactttcctccgccgcccgcctttcccatccccaccaaaaacacggtttccccttttccccttccgctgccgacgtccgtagaaacaaacggcagctaaccactgcactattcctctcatcacctcgtttcgttggtttggaaagacacactgccctgcactgcactgcgaggcgccgcgaccgcgaccgcgactgcgaccccgaactttcttttcgttatcccgcgcgcggcgcgctgccggtagactagaccagtggttggttggttggctggccgctcgatcgatcgggcgtgcgtgcgtcaaatgcaaacgcgagattgcgttgcggagccctgcgcgggacggccgggacgtcggttcgcgagtcgctttctctcatctcttttcgcggcgcgttcgcctagcgatcgacctgagctagccgcgcgcgcatgcacggtctctgccaccggccgtcgtccttgccttcttggtttcgaatacaggataaggataggcatgcgtgccatgcggggtaaaacttaaaatgcgagccgtactaggtgagaaaacttcggtgtcacacgtacgcttggcacgcatgcagtaccggtccggccgggatattttggaacacgtcacacacggtcatggttggcgatgctgacacacggccatcggtcggttcaggttcatgtgttgcctggaggacgtatgtatgcgtccctttcgtccccagttaatttccacgttatttttcacgtacgctggccggccggttcaaacttttactggagtacgttgcgaattgccgcgttgacgcagcgtatacgtaagtgtatgtagctggcgctcgacgggtcggacggtgccactgccatgcaaggcaaatccgtcgctgtttttctcatttttttactgtcatcaacccaagccatgtacagcccactggtagagaaaccatctttggtcggtcgaccaaattccacaatagtcccggttgcaataaaaaccgggagtaaagatcatctttagtcccggttaaaatttttttgatctttagtcccggtttaaagaagttggtgggtagggtcaggctccaattatctttagtcccggttggtataaacaaccgggactaaagatctatttttacttccggttgtttataccaaccgggaccaaaatagactgccgagcggcgtgccccaattatctccttgcggtgacccctctccttttttttctctcctctttaagtctctcggtatccgcctccagcgcctgcctgcgatatgccccttcctcccctggcccttccccttcctccttcccctctctgctcccccttcctatccccgcctcctcctcctccttcccctctctgctgcggccgggcggcggcgaaagagcgaggcagctgcgcggcggcggctggtggggccgcggttgtgcggcggcggcggcggagcgaggcggccgcacggcaggcagccgtgcggcggcagcggagcgaggcggccgtgggcggcggtgggtggggctgcggccgtcggcggccgcg

SEQ ID NO: 15369 - DNA, 34777 bp, Oryza sativa
ctctctttggtctcggttggtgttaccaaccgggactaaagatcccctctctttagtcccggttggtaacagatcgatctttagtcccgggtatttgaaccgggactaaagataacgatctttagttccagattagtagtcccggtttgaaaaccgggactacagggggttacgaaccgggactaaaaagcaattctccaccggtggccggacgctctcacggcaaggcaacacgtacgtacgcacgacgccacggcgtcgagagggcggggggggggggggggggaactcgtggattctccaccggtgacgccgacctttgctgctcgcgcaaacgcacgatggatcgatcgaaacacgactggttcaacgagaccatcacgtcaccgatcactaccagcagcaacggccggtttgccctttgcagacggagaaatttaaagaccatgtggcgattgagagcgagacaaatctacgccagtttctcgcctcctcaccccgtccctgtctctgcgtataatatcgtactagataattaaagagacaattttacgccatttttttttctttagtgtcctctctctatctatgcctttgtctctgcgtagataattaaagagggaaatgagaaaaatagagaaaggacgtgcacacagaggaggccttttgtttgatgctacctgaacgtgatgagaacgtccgtgggcctctggcttaacgtatgatagccggtgcagcaagctgaaacgaagggctggtttggtttgaggtctaaattagggttattaacatttgacaattttaatagtgtttagtgtctatttggtttaaagccaaattttgacatatcaaaaaaacagaccattttaatagtgaacttaggctattttggcttcaatccaaacacaattttgttttaccaaaattagtcatgataaacttaccagaatttagcattgataaaatttagtaatgcctatttagggcccctttgaatcgcagggtagaaaaaacggaggaataggaaaaacacagtattctgacaggaattgaagtgtaaaacagaggattgcaaaacacaggaaaaacacagaaatggtcgtttgattggtgcacaggaaaaacgcaggaatcggatgagagagatagactcaaaggaaattttccaagaggttggagctcttgctaaatttcctgtaaaatccacatgcaatgtgacatttcataggaatttcatagaatttggaaagcttcaattctttaaatcaaagggccaaatagaaaaatttcctatagaatttgaatcctataaaatatctacataaatcctttaatttaaaggggcccttagaccacaaaccaaaccaaaaggaagtaacgaacacgagcaaaggaacaaaacggtcgtggccgtgggggacggagatatggcgtcgacttgggacggagaaaaatctcaatgcaatgttgtcgtttatctggtggactgcagctgatctgcccaattggacgagacaccggggtatggctatcaaaatctccactgccagtgaagatacgagcaacgagagagtacttgtgatggctatcaaaatctctattgtagagaaccgtacatttatttttccatttttttctatttttgtcttgaaacttgtgcaaatttagcttaattgggagaggccacgtagtgatccgggagaagtgtggcgctgtgagctcgggttgccgtggcgggcggtagagcgccgcatgcgctgcggcggacaactaccggcacacgtggagggccacccgcctcctctcctcgagagtctcctccactctgccacttgacgtgggcccagcggcgccgcggtcaagttggtcaagttgtggcgccctatcgaccaacggctttgtttgcgcggcttctcttcgtctgataattgccacggcggatagccatttttgttcaccttaaatattgatgaatctggtcatagggtggagggcgatgagtaacagtgatagtctagcctccagtttttaatatagagttaattgaatccatatcgttgttgccatattataaaactgctacgactgttcgcgatatcgatttgagtgccagtataattttataaaattggatcatgccatcgtcgtgtctgttacgctctctttcttccttctcttcttttcttcttccctatcggtcggtcgctcttctcctttcccgagcatgaatgtgtggggacagtgataggaaaagtcagcattggcggatggcaagccatgactgtccacggacggtgagatgtcgaggcgataccggtgatgactagtgggcatgggtgtgtgtggtaagaagaaaagacggtgacaatgggtggtgagccatggttctcctcatgcggcgagagagcgagaggcgacgccgacaatggcgtgacatagctatgcgtgggcaacggcgagagggtgaggaggccattgcatctccttccctatcatcgacgagctttttcggctaatccaattcctcctcatcgatgatgcccatgaaatcgacaaggagcatcttgggctcaccgtgcgggatgggggagtctgctcggaagattggactcgccaatggcttcatgcccacgaggccgccgattcattccttaaccagatccgataaatgagaccgcggtggtcgtcgccgacagagaaaagcggtgggaggctcgtcatgcctgccgaacgaggggaggatggaagtgaagatggaaaacgtgacggcaatatcatagatctaattttatcaaatttcagtggcactcaactaatatcgcaaattatagtgtcatttttctaatatgacaaattctcaatttatggatataattaacccaaagaaaccctttaatatatgtcgcagtttaattttctctcaaattttaaccaacaattattcgattagctagttaaactaaattaaaaggaatactgagtactaaatttcttatcgaaagtaccttaaacatatctaatatgtttatcgatttacttaaatatatttagtgaagactaataatcaaatgaattaaaaaaaattaaatgcactaatattttttaaaaaattgaggtccgagtagtagcaaactggttcggttgagctcaatattgcaaaatgctccggcaggaggacctgggtactacaatcaaatcattgatgctcggatggtactgcattattatgaatggccataatatgcagtatgtccgtgattgattaggggtacataacagcattgaaaatgtagacctgcatggaatatttcaagcccaaaaatcaacgggcagacggttctagagtgaccaatcttttttttaaagaaaaacaaaaataaataaccgtacattcctgaaattaaaaaaaaaactgtcagttcaggtgttcgtggctacaaatacagtatcgttagcgttagctatgaagaatcggtcagaaaaaagggtttgctcaagataatgataataatttagcactaccctggctggctaagcaactaaactaactaatactcgtatttattttcagtcatgtcattagcccacgaagaaatggttgcttccgtgcaagcagcaaaccagagcaagaaacgctttgcaccagagagattaaaaaactatcagtatcacattattttactgacatttgctttccacttcaagacatctgctaattgtatattcgatggtttggtgcctgacagttagagtatcctaataataagccatggctgggtgatgccacgaaccattctgttctagatgcgactaccccatctactgggcaacgcaacaaagaggaaaaccttaacaaattttaatccagaagtttcggttcctagctgaatttttagagcaggtacaatagcagattataagccaattataaacacatttcgagaaaataaaaaagaaaagagatggacagcaggctacagatttatagccagctgtagcacggactttaagatgcatatgtatatgacagatgagaccagatattaattatgtagtatatgtttatatgtaactactgtatgaattgactattaaattgactatagatgatttggagtccgcagttagctttactactaaacttgctcttaatggaatgttccatcccaaagttcatcattctgtttggttagcattagagcaggtacaatagcagactattaaccagctataaacatattttaatgagataaaaagataagaaaaaagagcagcgggctataaatctgcagccggttgtagcacggactctaagatgcaatgtgtgtataatagataggactatatactaatagtatagtaaacaattattgtataaattagctattagattagctatagatgaattagagttagtagtgggctatactattaaacttgctcttagcatgcggttagagtgacagcaacatcggttcatcgatcaagagtagattatgagtggattataagttgtaatagcttactagtgaaaaatattttacgagtaaaacttttatatatacacatccataaatttttataatttttaaaataaatgcattaatgatacctaaaatccacttaaaattaagttttaaaatttaaactttgacgtcgattaatttgttatacgtcaatcaataagaccctttagctattgcacctaccgtatttttcctggatataaagtaagatcctgggatcaaagaaagcttcgcaatcacatgttgagaaaaggagtgggctttcagaagcaggagcagaaaatgatgtatgatagactagttcggtactgcagttaggtgcccataaagaagatcttccggtgattgcattgggaatgttcggttgcatttggagctagtatttggctatagtattatactagtattgaacttgctttaacagatttcttcagcttaataatttactgtttgaatttgttctacattttgagcagctttgatggtttctttgtgtagttttttcaagtataaaccaactcgatcaaagttaggaacagtacagatagaaggcaacaatgtcatatcagaggagagaatcattcctgtgttacgtggagtataaacaatctgcaatactctggtcattgctacatctgacaaaagtcgttgtgttaccacttaccaccatgtcgttcaagcagagctggagaatcttttcctcaattttctgttcggttttcagttccaccttgcctcttttggtcatggtagcgccacgtggacataccaaatccaccattttaatccagaagatatataaaatgtgattttcttaagaggaggtttggtgaaagataccagaagattttcatggcttcaaagctgcatgcaagtgagagaagctggcatagagagaaaggtgccctccgatgcgaccgatttttgttcagatcgacagcaacatcaaccactttttgttcagttaaatccattcttctggtcgtctgtttttcttgcagacaactttggcatctttgaaatgctgaagggctcgatggattggcatatctttgacggatcatgaactcgatgacggaaatggcagattctactggcgtatgttcgcggaataggacgagatgtcggctgttgatttacgcgcgcgtgtgaagttgttttctgcagttcagtgcccgtttgatcatttcccattggtcgagagactagtgccgtgtttagttgtgtttagttgtaaaaattttgaagtatacgaatacacatttgaagtattaaccgtagactaataacaaacaaattacatatttcgcctataaaatgcgagataaatctatcaagcttaattaatacatcattagcaaatgtttactgtagtaccacattgtcaaatcatgacgtaattaggctcaaaagatttgtcccgcaatttacatgtaaactgtgtaattggttttttttcgttcacatttaatgcttcatgcatatgtccaaacatttgatgtgacggaatttttagaagtttgaagggaacagcctaggagaaaatactgcagtggtgttgggtgattaggtcaaatgcttcggcagttctgaaatactaaggaattatagacaagacattttgcaaaagaaaaagcattaaaaataactaaagaaatggatcacgaggaattttagaaatcgccaatatatcacggttttttaccaacttgtaaaatgtattgggatctagtagtatgagagacataagaaacaaggcaaaactagaaccaagccacttggtaatgctaatgttcgtctctatctctctactccctccgtaaaaaaaaaactcaatcctagatttgaacacgtgtgtccaggttcagatctagaattaggtattttttgacagagggagtagaatttaacttgaaatgaaagttatatgattttttgaagagacaaatgtgtctattaatataacatactccctctataaaaaaaacttaaaaatcttattctaggttaaacttttcttttttgggattaagagagtattgacgtacctagcttataatattggtgattcatatgctggccctattcgaaggcacttgctgccttagccgcagcgacagttcaaaccagtcaaaacagttgtagccacaaccgttgtggtagctagtctagccaaacgtaaccactgtcatgatagcaatacttgttcagtacacttaaatagagtaacagaattgtatttgaattttgtcggggccgattatagttgactactagcacataagtaatcaattgttttggtaacttggtaggagtaggatctggtatagctgtttggattgatgataattttcattggtgtaagtacaagtagcactaagtgattacttcatgattagagatatctaccccctatattaaaaaaaagaaaaccaattctcactataaatcttaatatatacgtgttctgatttatctttttttagacggagtagtatatggggagcagtaatagcatgtaagtgcattcttactctctctatctttaaaaaatcaatattataagtctgaatatgcaatgcatctaaatttatttttctaagtaaggtttttatggccaaatttaccagcgaggcgaccacttcagagtgagagcgagcccaccagtccaccacgacggttggtacgcctacgtctctctctctctctccctcctccccacttccctcgactactccacctccttcgcctccgcccccatcatcaaaagcccccctctcctctcccctcctcctccccttccacaccgcaccactccacgccttcctcctcttctctcgtctagcccactcgctggtctctccaattcttggcttctttgctctgctggattagcagcagctgctctgcttcttgctctgcccttgtctttgggctttcagggcggtgtgctgaggccgagcggtttgggcggtctcaagaatcgcttgtgcgtgcgggggagttgtcgtgggaggtggggatggagaggtacgaggtgatcaagggacatagggtcggggaacttcggcgtggccaagcttgtccgggatgtgcggaccaaggagctgtttgccgtcaagttcatcgagagggggcagaaggtgaggcagagatcgcgttggtttaccctctccccccctttatctctgttgctgtgtgagtatcttgtttgcttgcataaacccagttcttgcaggcgggttctgatcagattcttgatttgtggaaatttttggatttttagtttagggtgcttgtgcacggaaagggtttatcctaatattttggaggaaatttccttaaaattgttgctgttgattttattgatttgactaattgctacttgatattgtgtatctggttgactggttctgcccccatacagtctgatcgatcgcttggaccatccattgtgctaccgttcctttgatctgcaatactccataaaaaatcggactttttttctatatatttttgagaacctccttaattcactccttaatatgtgatttcttggccttatatcacactagactgttcaatgcgggtgactctcatcttatcgctgtttccgattacaacaaagaactgaaatttgcaccagggtgctcttgatctggctctattgttagatgtttataagtaaactttgatctgctaaagcttctgtccctcatttgacatctgggttatgggccaattcaataaaacacatgttgtggccatgtgaatgctttgctctgcccaatttacaaggtcaccttttgggtcctgttaaagttcattgaacgctccatttcttgttgattcgtttaaggcgtagtagtagttaaatgaggtactttaattcgatttctacttagtatggacacaactaacatcgttaatcagtgccaccattatgttattatgttaggacttgggttcatcgatctgggtttatgttatgttactactcttgtgttctagaacacctcaattttcccagcgtattattttggacctaaccattttctgttcccacctctcgcctctttagtgtcttcattgttaacatttcaccgttcttttcaaactaggtttcttcaaccttttgggttctacagagttttcttatatggtgtctgattgtctttgatttgaatcagctcactttttttttgtttttctttcatagatcgacgagaatgtccaaagggagattatgaaccacaggtcactgaggcatccgaacattgttagattcaaggaggtaagtcgcatgaatgataaaaactttgaaattcgtttctgcataccttgtttttagtacgctaaattttctatatttttgttgctgaatgcatttaaagttagccaaaagatgcccatattcataatttctccttaggttctaaaacctgttaagaaaacaagcatttcatattttcactggaaaaagattggcaatattctggtacaattttcaatcttccaaaagattattgtaaaattgcataaataaattttcatacttgaaagattaccaagatgaaaatggtcttctgtaatgctcgactgtgaagtctgaactattttggtcagtaggaaagcgatatctgtgatctatccatcaattctaataggacaaatggaatatgtaaagaaaaaagtttatcctagttgcagagttcaaaggactcttcttgtattgactgtgactcatacctttatggtctaaacttctagtataactgccctcagagctttaggagcactattttgtttacttaagagaatatgctatatgtgggcgctgaacttatttggtagactttttgtgtagattctatatctaagcacattatgggtgtttccttttctcttcttctttccctacacaagactagaatgccacttctttaaaccgtttaggattaattctgttggatacttgcatgtttatcaacactcagttgctaatatagcttgtcctagtgccatgcccttgagcttgggtaagtactttagtggctgagacttgagggcatcatgaggccatgacttctgtgaaaaagctcataattgctcctaatcattcattaaatgactactggtactggaaatgaaagtgacccagcaggatattatagcctcttgttcaaatcttgaccgtgttaagccttgtttgcatttaacagaagccaaattatctgaaagttgcattattcaactatttgatggtagtttacattcattgttgcttttcatattgtcaaacatatatttagtagagactagctttaaggagttaggtggataattgcaggtatcttgttaatacctctgagcattagaaatggctgtcatattttctaagatttaaagctgttgtcataagattatatactcaaagagaacacttagtttttcaggttgtgctaactcccacacatttggccatagttatggaatatgctgctggaggtgagctattcgaaaggatttgcagtgctgggaggtttagcgaggatgaggtagagaatatttacaagtcatgatacttaaagattataagatgattcaattttgttgatggtttattcaacctatcgacaggcaaggttcttcttccagcagttgatttcaggagttagctactgtcattccatggtacacaataatctgaaatcaaattgttgttagcaactcaaatgctctatatcttacataatgatatattgccttattgtgtcagcaaatatgtcatagagatttgaaactagaaaatactctcttggatgggagcatagcacctcggctcaagatatgtgattttggttactcaaaggtagtcagggaagattatggcctttaaaaatcgctggcttggcaactgaactcttatacttactctcgaattttctttgcagtcctctttgttgcactctcaaccgaaatctactgtcggtactccagcttatatcgctcctgaggtccttgctagaaaagaatatgatggaaaggtagtttctgatttgctatttctcatttttaatgggcatactcctactatcaaagttccgaatctcaccatatacaatttaggttgctgacgtttggtcatgtggagtaactctatatgtgatgcttgttggtgcgtacccctttgaggaccctgacgaaccaagaaacttccgcaagacaattactgtgagttacccaacaaccatatatacctatgagatccctcattccatcttgttgacctcagctcatgctgcatcttgatgtgtgggaataaaagttataagatccttgcagcggatactaagcgtacaatacatggttcctgattatgttcgagtttcgatggaatgcagacatcttctgtcccggattttcgtggcaaacccagagcaagtaattcgtctctcaaaccaattgttcctctagaacaaaacattacattttgctctgtcctcaccagtcatttcttgcagcgaattaccattcctgagatcaagaaccacccatggttcctcaagaacctgccgatcgagatgactgacgagtaccagatgagcgtccagatgaacgacatcaacaccccgtcacagggcctggaggagatcatggccatcatacaggaggcgcggaagccgggtgatggctccaaattctccgggcagatcccgggcctagggagcatggagctcgacgacgttgacaccgacgacatcgacgtcgaggacagcggcgacttcgtgtgcgcattgtgacgaggccgtgaacttgctttctcttcttggagtgtgctgctccttttgttgtgctgctgttcatttctgagagctccattctgttgttgtgtcagtgtttgtaaacgaggtgctgtggataatctgaactcttttatatgttggtgttcttagctgaattctttgcgtcctgcctgcttccctttgagctatgtgcagtttcatcagtctcacaatgcattctcaatttctcatgttttgttatcctagctttagggccaatttagtaatctctatatgcgttgcagttgataacaaagttattcattttgttcattgtactgaactctttcccccgaaaagttatcatacaaggagatgcaaactgttgtgagaagatgaaaatattggtagcctaaaagatggatcttcttggtgaacagaaacacaatcttatttttttccttaaaaaagaaaaacttttaaatgaaattgtaatataattacatcacaactataccataactattataattataaaacttatgcataagtattaaaaaatatatacaactttttacccaagttataatagatattagttacattgtacactacaactaagttgcatgtgaatgtttttgactaaaaaaatgcgatagctttttagaaattccgtaaaaaaagttaaagaaatatactaaaatggattttcagtgtgtacgcagaaaattatccttatgaggccttcattgtgagcccacaatttccagatcacccaggcctcattttcatcataggccttcacacatggatgagcacattaaggcccattcaaaccatgcctcaagtgtgggcccaaacgagactgaaaccaagagataggcccattccaagtgagaaaagccagcccattttttccctccggcccagtaagtccaatccaacggtgaaggcgatcaacggacggctcagatcgagcctcgcacccgcggcccagaccccaaccccttctctcctctaaccctatataaactccacccatcaactcacgccgctctctcgctcaaaaaccctagccctcgcgccgccgccgccgccgctcccccgcgcactcgccgctcgccgcccgcgagctcgcgccgcttcgcaaccatgaaggtaagacgctcctcgtcgccgttgctggatcccccagatgagctagggattttatggtagggttagatttttttttcgtgggtggcttctgattcgtgtggtttccgccttcgttttcagttcaacatcgcgaacccgaccaccgggtgccagaagaagctcgagatcgatgacgaccagaagctgtgagtattctcgccgccgctcccccgtttgtttcgtttccccaatattagagagagtggtgttggtagtggcaagccgaatcagcgcgaacccttgtgttgatgtggtccgttgatttacataacaaatcgcatttctctttttgtggttggacttgtgttgatgtacttaggtctaatttttcttagccttgggggatttggatgccgtttaatgtttgtagtagacggataccattttttgtgattgggctctgtgcttatgtacgtaggtctaacatgtctcccctttggggatttggacgccatttgtggctgttctactgctaatgtttgtagtagactggattcattggattgcgtgcctctgcacagaccaactgtggaatggtgatcgttcctgtgtgaatcaggtgtacatggcttaagattgtgaggttgtttgacattttatcattatgtggacctctttgcttatatttgtgaggacatggagttatactataatatttgacttacaggttgcaagagtaactaacgtatatattgtgccacttttcacttagagcatggacatgcaaatctagatagcattttaagttaacatgtttcggtattcttattgattaaattgtggtgattggatagtttcatcagtacttgcaatcctttgcatgagtatagagaaatacaaagatccattctttacaaagccgtatgatttctagttggacttgtttttgtatcttacttcagtgcatgttgggggcacaattaaactgatttctgtgatatgtttttagtcaacttccgcaactaaaatgcggcagggagttagttttcatgacctgtaacaatgtgggtgcctttcaatgtctaccttgttagctgatgactgaacattagtttgagtttgttctgtaaaattggatatctgatgcctttgtatgtactgcaggcgtgcattttttgacaagaggatctctcaggaggtcagtggcgatgctctgggcgaggtaatatcgtgaggcctctgatgtttcctaattactgttacctagtcttaagatgttaacatatctctctcctttttctcaggaattcaagggctatgtcttcaagatcatggggggttgtgacaagcagggtttccctatgaagcagggagtgctcactgctggacgtgtccgccttcttcttcacaggggtaaaaaggctctatttctattattgactttcggatattcatgcccttgctctgaccatattatgttacttgtatggcaggcacaccttgcttccgtgggtatggcaggcgtgatggtgagcgcaggaggaagtctgtccgtggttgcatcgtcagccaggacctatctgttattaacttggtgattgtcaagaagggtgagaatgacctgcctggccttactgacactgagaagcccaggatgaggggacccaagagggcctccaagatcaggaagctcttcaacctttccaaggatgatgatgtccgcaaatatgtcaacacctaccgcaggacattcactaccaagaatggtgagctttcctgcaatgtttaataatctacctcatttctagtatgtcctgctcctgatctgcattgatcttagtactgttttaattttcttatggataaattcaccatattatattgtctgcatgtttgtcagttttcaagtcaaaatatatcttccaggtagctttctgcttacctacctaatggtgttgttgtgttgcaggcaagaaggtgagcaaggctcctaagatccagcgtcttgtgactcccctcaccctccagaggaagcgtgccagaatcgctgacaagaagaagaggatcgccaagaagaagtcggaggctgctgagtaccagaagcttcttgcccagaggctcaaggagcagagggaacgccggagcgagagcttggcaaagaggaggtccaagctttcttctgctgccaaggctgctgctaccaccgcctaagttggtttagagcttgagatgttttaaaatcgttcattcctgagttataatagcccaagaacctcttgcactatgttcgatcaatccaccccagctactttcagatttctcgagtaattggtgcaattttgcatgaacatgctgccttgtttggaattcttttttgagtaccggagaattaccatgttagtgtgttggtttatgttttgaaggtggccttgttattctgttgctgtgttgatgtttggacgcaattgctggattggtacttggtagcatgctagaggttttttactctgcttcatttgagttgctgggttgcagttgcaggcatcggtgtaaactcaactcgaagtcgtttgctgctgcctatagtccaggcggtgtaaattcaaccttattttttttgtaaaatgaaattttaatttcaggagagcaacagacagaccaaactcttaactgttatgacctgacaagtttaatttctaccaaaatttgtaccgtcgttgtcgaggaatttcttcttgccgttcgaattcgatttcttcggtattgggttggtccggtctcaatccgttccgattgtgtcagtcttgggccataaagcccatgtgttacaagcctaacagcccaattcgactggcccacgacttttgcaggcgggcaccaattccgggtgcactccgacgcggggcgcgtgatcaaatttcttttcacactttatatcctatcaaaatttaataattttcaaattttgttatattttggtattatataaattcagtagtgctaaactagtttggttcacgcagaaaaaaaacatttgaattcgaaaggatttgtttattatgggaaataatcatataagggaacatatgttatacatatatagaagcttttgcgtgtacacgccaactaagaaaatatggctggttctaaaacttctacacgttttaaaatccaataggaatgcaaagcatatgacatttcagctctacgtttatctctatctcgtattcacaatcatatgtttcaaaggtaaccttatcaaatcctttttggtggaaatttccgaaattacaaaatacgaacaagcccttcagtactagcgttggcgtactgcattttgcccatctcgcttggccaagaaagggggacaagggggaaacgcatgtcgcagcctggcacgttccaaacttccaatcgcagagaaaaaaaaaagagaagcagatagagaggcatcgatcgtatctacgagtacaaaagtaaccaagcaaaccatctagctttattttctcctgtccccaaggccaaacagcacagagctgaggcccccttaaaaattcatcagaacacatccatcaaaaaacttattacaacacggcgagtatatatgctaccatatcctcgacaactgcctatagtgccaagaacactcaacaaccaccatacaaacatttgacagaacacatgcagatatcaccgccggcgagttgaaactattctaccccctcctcccagtttcttttcccttcccccgtttcagcagtttagaaagccaatgggggcaatggcaggttgctgttgaccccggaccgcatcctcctccgcctcagtctctcggcgatgatgaaggcgagctccagggattgcgacgcgttcagccttgggtcacagtgggtgtggtagcggtcgctcaggtcatcgaaggtgacggtccttgatccaccgatgcattcagtcacgttctgcccagtcatttccaggtggatacctcctgggtggctaccttcttgatcatggacatcgaagaacgcacgtacttcagcctgtgaaacacagcaatgttcatgtttatttgaccaatagtccaaaatgacgctagtttaacaaaggttacagttccgtttcagcagtggtacacttttcttctcataccatagaattagaaacgcctaggatttttgctgatatagcatatgcccaaaagtgtcacattctcactgacataaacagatactctaatgcactagatgggaacttgggatacaaatggccaatgcactagacaggaactttatgcatatagcataccgagttatcactcaattttcagtactgttaaataactgtgcagtcgaagttggggaatgagggtaattccttatgtgagattgaccggattgttgcatcatactaggaaaggatactagcaaatatggaatgctgtagcagaaaaatactcaccagaatggaatcgaatggacgagtcttcagaccacatggagccttgatggtgtttccatgcatgggatcagtaatccatgtgacaatctgtccagagttgcggacagcacggataagatgaggcaatttcaccctcatgttctctgcccccattcttgtaattatggttatccttccaggcttgtttgatgggttcaaaatctcaatgagcttcaccaagtcacgggggttcattttgtcactcacctacattacacagggtcaatgtcagtttgaaatgtcaacatccacaaggcactgcaaacaacattaggatttcacataactttatgaaaataaactcaatgctgacctttatgccaagagggttggcaacaccacggagaaattcaacatgagctccatcgagctggcgagtgcgctcaccaacccatagcatgtgggctgagcagtcatagaagaggccactggtggaatcctcacgtgtaagagactgctcatatggtaagaggaggcactcatgggatgtccagaagtcagttgttgtcattatcggatggtcgactgttagccctgctgcagtcatgaagccaagtgcctcatccacccggtgtgccaattcacggtacctatacacaaaatagagacaatcattggataacctctcgattcagtcgttacaagcatattttattctgtaacgtaaacaattgcatatgtagcggcaaatcgataatataccaacagcacttatgcagtataccaatgagctgctcttatttgcaatttgcaaataccaccaacaaaatggcatttcaatgtcttattatgatggcaactttgtattttgtcggaacaccatcttttacagaaaaagtcaaaacaacattctaacaataaattctttataatctttattggacgcatgtctgaagaaaatataaatacgttaacactgcataagtcaacattataaatccaaagaaggttacagatgctaaattagagcacgaccgacgataaatttcatggacgggtagtttagttaattatgtattctgaaatgggtacgcctcagataattgcatgcctttttaaccaacaattccatggtattccataccatgaaaatagcaaaaacgggcagcttcctaacaattattcagaaagttggatgcaaaggacaatgatgtcccgttagcagtttcctcgaaaggaagggacagaaagtgaaagcttctaacaggacaactcaccaactactgattgatggaatcagaactaccacgtgatttttattaaacattgacgagctgcgaccacctaaaatgtttccatttacttattcaagctgcaaattagaatatcagaccattttcaagagcagatgactgggttcatactttcaagaacatgttcaccacccattacttacacggtcacacagattccaaaaggggtgaaaccgtgttatcaccagcaacctataagcagctctagccttatcatgataacgagatatgtggaagcaattcaacactgatatcttttaaatcgaaagcgactttaacaacttccgcaacaaaaagtgctaaaaaatcgtatgaaaaaaaaggggagagaaatgaatttctcacctgtctccttgttcgctgtgatccatgaaatcgaggttccactgcgtgacgcgctgcatggcggcgtaccctcccgtggcgaaggcgcggagcaggttgagcgttgccaccgactgcgcgtacgcgcggatcatccgctgcgggtccggcacgcggctcttctcgtcgaaggtgtcgccattgatgttgtctcccctgtaactcggcagcttaaccccgtccctctcctcgaacgaatcagacctcggcttggcgaactggccagccatcctcccgacctaaactcgcgcacaaaatttggagcagatcgggatcagatctcgcgaatcgcgtgaaggatgagctcgttttggggtttggattttgggtaccttgacgacgggcatctggccgccgaacatgaggacggcgcccatctggagcaggatgcggaaggtgtcacggatgttgttggcgttgaactccttgaagctctcggcgcagtcgccgccctggaggacgaaggcgcggcccatggcggcgtcggcgaggcgctcctcgaggtggcgcgcctccccggcgaacaccacgggcgggaacgtctcgatcgtcttgagcacggagtcgagctcctcctggctcgggtactcgggcagctgcagcgccttcttcgccttccagctatccaccgtccacttccccaaccccaccggcttcttctccggcgccgccaccgtcgacggggacgaggccttcgccgcggcctgcacgggcccgttgctcttcgccgggtcggccgcgtggaccgccgagacggttcgcctcctcatcgggaggaacgtggcggcgagccgcggctggggcgccgacgacgccgcggccgcagcgccaccggaaacagcggcggagttggtggcgagcgccattgctgacgtcagcttcgaggtgaggtaggtgggaggaggcgtgagggcggcggtaggcggggctcctctgaaggtggaggtgggtggggtgaggggtatttataggcggggtcgacggcgaaggggaggaggaggggttggtggatgggttggatggtggttggcggcgacgagggtgtgagaggagggaggaagaaggggtggtggggaagggtagtttcgtagtttttcttcgtatctatatgacctgacttggaaaagatactttaggggttaggtggcgtgtatgacaatgtgggcccgtgacgcagggtcggtggggtaggtcttgaccttggctcggctcggctcggcttgccgcctgatctgctaaagcttgagccgctccgttacaaaatatactcctcgtcccaaaattctggtcatcctgtgaaagtgctgctaaattagttttggaggtactataagtaattataatttagtacttgcaggtactataagtaatttcaccggcctcctctcctctccactgcaccaccaacctgcaacctcgtttggggcataaagtcccatagagcaaaaacaattgatagcagtataagatgaccttataccatatgggtctacttttctgcttcaaatgctaaacgatcactttttgggacaatcacaaatgagtaaaacgacatattttgtgggacggatggagtagtaatcaagtattagatttggcataaattagtatcacgaatatgtacaatcagattcatactaataggttttgtataattcggcgctaggttgttgtattttaggatgaatgtaataatgatttgatgtcaaaaaaacacattaacagagcctgctataataatcatgttcccagtacaattttggcttggctcggctcggctcagttggaacagctaaaaatatcgtacggcgtacagtacagcgccacttgtcaacatctatccacaactgacaggtgggccccgccgcttcccgtgcccggcaggttggcccccacctgccatcgagacgaccggctcgtgaaagtcacctgtctgggtggggttagttggtggcacgaatggccccgggggattccggacccagggccaattatgtggctctttgtgtggctccctgctcggccacatggtttcgtttcgcattcactttcaaattttgacaccatacatacatgcgtgaaaaattaaaacaatttggtccgatttcgtacgaatattctgcagtatcgtacgttcgacgacgtctagttcgcatatttccgcgtcgtcttatgacaggaagccatgttacttgatgctcgatttaaattaggtcgaaatcgattttacgaaccaggcaatgcaatgtttttggggtgatttgtgtgcggcaccacacgcacgtggcaccacgaagataccccccatgtgacacaattgggaccagatgttcttctcttttctttctttcattgtgaggaggtgaagatacttgtctccaaatataagtagttctgaaatttcttttacagagatcaagaagagatgtgaaattaaataaaggatggttatggtcagttgacatagaaaagtagttgaagaaattaggccccctttggattcaaaggaaattcgtaagaattttagagtatttcattcataaattttttttctctgtagcctttaaatcaaaagaatgaatcctatagaatcctataaagttcctatgaaatgcctctttccatggaagttttggaggaaatttaacataaggtagaacctcatggaaaaaatatcatttaaatctttatctctactcgaattcttgtgatttttctacggtccaatcaaacggtcgtttatgtgttttacaattctttattttacacttttgtttccgttagaatcctgtctttttttttctattccttctggggtttttttcacattcctgcgagtagagaagcgaggctaactgagttgcatgcatgaactagttcaacataaagcttatttagttcttactaatcagttcaagacaagaggttaatttgatcacatttttcaatcaattcaatagaaagcttgttaagttaatatatttactagttgtggtttgtggccaaagttatccattcactattctttttttctctcctgggtcatcataattcatatgctagtgacgctcctaccatttagcgaactgttataaaacacaggaatataattctgcctactaattaaggttcaaacaatatcataaaaatagcgtatgtcaatgtgaaaatgtgtgttatccgtataacatcaggcataacacgtggtaatatcatttgtctaaaaaagggagcaatttaattaattagtgtgttacgtactccctccataaataaaaagcgaatctagaaccggatgtgacatatgtatgcccagattcgtaatactaggatatattatatttggtagtaggttgattttctatgggacggaggtagtatatgtatatttcgtggggagtgcggagaagttgcatgctgccaagcacaaaggtggctaccaaagagacaaacaaaatgacacatccgttttcctcacctaataccacatcatcatcatcacccacttgacacgataagcttaaaaattagccatttgccttctcctactccttagcttagcttcctccccaaataacagttgatcacacgtgcaccaatataattgaaaaattagtatgcgaccgatcgacttagtgtaatgtgtacatagttacacacgaccaggtaataatgcggcgcacgaaaaacaaactcgatacagtatcgaaacaaaacaagaaaaccaaaatgacgccactacatcgagccgattcaaattcaaccccagcaccaatccctcgtgccaaaaaaaaaaaagaaaaaaacgacgcgtgcgttcgcgcgaatgctcacgaaacagacggttttggctcgccgcgcgccagcaaatctctgaaactgccactcctatggaaaacggtattactcattaacaggtaactagttaagtattagttaaaaaattaaaaagtaaattaatatgatttttaaaattaacttttctatcaatttttttaaaaaatatacaccatttaactatttagaaggaatgatcgtggaaaataagaaagtaaaagttgagaaagtgagagaaagagtgtattttaaaattacacaaatcctacgagggcacgacgagtactactccaggacggaaatgtataaaaacgtcggtctccgcacggcgagggctcaaggcgccggcggtaaactgcggccgattcacggcgacgaggctgcctggaaagagtgggtcaggtcatgttttgcattttgctacgtgacgttatgacggaggctttgggtcaatgggccggcatgtttgaagagcagtagtagctggtaggcgacttgaccaggaggggacaaccggggagatatgcacttgaatatgccgtattgtgggggatctaataatcctcacctaccaaccccaccagtagctactattcctatattgtttgacccaattatttactattggatgagcaacatcataaaaaaaaaagtagctagatcactaccattctgaattatagttattctatgctcactcgtagttatatttttatgctaactactctatttttgctcctttataaaagagagtagtggtttcgctgtcaattcctattatttttaaagaaaaaagtgacacgtggagctagagggctcatatgtcaactactcatatcaattctctattttccgtgggaaggaaaaaagattaatgtgaggttaaaaaggttcacatgtgattaacaaatatgtacaacaattgagagatgtcactaaaattaaaatcccgttgcaacacactgacaatatgctagtattaattataacttaaacatgcatcgagtattttgttgttttttttaactcaatttcgtttttaagtgtttttgaatgaatttcaaaatcccgcgacaagctgtgggatatccactagtataacaaattatcaatgacccattggtcaggtaaagaaggcgacggctgatttgatcccatcaattactgtagcaattgtgtaaccacatgacatgtcccacatgcatagcaagtgcattgcatcagtggtgatctgacaatttacagaggaaataattaagctaacaaagccataaaggacaccataacgtcgctttgatcccttctgcggattgattgcacgcagcatgagccgctagctctgtatcagtgtagtactgtagctatcagacaaggcaacaaacaattgctctaacgtttgcaagttcagacttcaagagggtagccagttagccactagccaagcttatctaatctacacccttgggccttggcaaacaggctctagtccggcccattattcggatatcgacggcccaattataaagcccacgaatggtgcggcccaatagcggcgcctccaagcaaacagaattggaggtcttttgctcggcaaaacgcaaaggaaatcatatgatatgatatgatatccatccatccttctcaagccgcagctttgctcgttatttgattgggccacatgatgtaattaaattttaagataagcatgtaaaataccaacgttaaaaaaaaggctgtctatatatcatgtgacaaaatcccacctcttatcattcgaactttggaccattgatttaatagctaaatggtgaataggtgcgtgcccgcctcatcgtgcgatcactattccgtgctatacaggtcatataacatacatttccgtatgtatatgtatatgtaaaataaatttatatatcaaaagtgtatacatatatgtgtaaatttatacatacataaaagtctgtataaatctatatacaaagtttatacacaaatatgtatataaactttatatatacttagtatacttatgtttaaactttgtatcgtataattcaaagtatatacatacgtatatagagaaaatactagaggggaacccctgcgtggggactctccacgctcgcgctcggctgggcgtgtattacgtgccccggaccattgatatcttgtaacaaactgatatcgtagatcaaattcttattcatggatcgaattcttattcttattataaaagtacatattctccgtccatacgatgctcaacttttttttagggaccatatgatgcttaacttgacgtagaactttactttattatgcatcaggtccctccaaaaccttccatggaggctaattttcacatttgccaattatcagtgaaactaggaaaaattataaaaaccacctcaaatgtcactttatgttgcaaatatccctccaccctaaatcacctttgtttaaaatttcccccaattgccgttgctcattcatttttttgtggtcgcaaaccccacatttactcatatgaatactagtaggcaaggagtcatggtctccactcatatcggccacgccctatatgatataaccgtgggttcgtggcattcgctggaatggcgcacaaacgttattggacggtggtgttcacaagtcttcactcttggacatcttgatcactagaagatgagttgttgcgcttgtctcctggcagaggtggagctaggattttaagttgttggggtcatggcattcaattgtactagtgtcatgtttgagaggactttaactctaagtatttttagctcaaaattcttttgtagctagagatgtgagtaagttgggattgtttcattttactaaaaaactgtttaaactctatattctacaagaagttagagattttaaaaaggtccaaaaaaattaaaagttataacagtataaatcgagcctaaaaacaatgtatttttggggacataaaagcaagttatgaaagttgtttaatgctccctccatcttaaatgcaattacctatgcccttctccttcttttttttaagatattggttgagtcccttaaaaaaagattaagagattggttgagactgagaggtatgtgaagaggtagttgtattttaagacaaatttgaattctagatatatctatattttgtgatggagtaaatggcttaaaaaaacacagctaacatctagtatactattagttgattaacataactattggcctagtgcagtgatacacacaccaaatagctgaaatagatcattaacataccaaataagttaaattgtggtattagtggtgttgtggtgggttgacagtcgcataacaaagctaatacagtgtgcttccatagaaacaagctactataatgttaatgttttagcttttatcaactccactattaattgattagcagaactattggcctaatgcagtcatacacgcaccacatagctgaaatagatcattaacataccaaataagttaaattgtggtattagtggtgctgtggtgggctgacagtcgcataacaaagctaataaagtgtgcttccatagaaacaagctactatagtgtcttaccaaggtaaattcagagtgatatctgagtggtaaattcagagtgatatcttatacgggagaatttaaaattcagagtgatatctgaggtggtttatacaattttcctataaaaataactactctttccaatggaatatgaagtagctacagattaatgtcaacgatgagttggcaaagaagtcacaacaatccatgctcaatctcaggtatccaacacaggattatctaattccgaaccatggatggagtcaaccttgacgcccacatgtgttctcgtttaacagccacctgagcagcatacgcaatgcattgtgtatagtaggtctgcatttgcagatagtgagttcagtaatttccatactcggttattggtcttctaggtttatacagaacaacgggctcaacaaagacttgcatatcggcaggaaagaaagctttagaagtgactattgactgttttttatatagaaaagtttttcccataaagaatatatattgttgtccatatgaaatgcctacaattaatccttttatctaagtcaatcaaaattaagatcaatgcattactttaacatcaaaataattgggttcaagatctaaatttggtacggacgtttgcatttactgctaattattcttttagctatagacgatgctacatcgataatgatacgtctttggtaattttggtccaatctttcgaatgtgcttatagatgtagggtgggtgttcatgagggtgagtgtgcttaaaagaaaatgaagaattatatttataccattccaattttgtctccaattttcttttatgttgaggtgggatccaacaaataaattattctgggacgaaggtagtaacttgtataaccttttgaccaataatttttctaaggcaattataacatgttttttttctaaatacttattacgttttgatttgtacgacacgtggcaacatgcggggcacttttttttttaatccagctcctctgactttggatagaaaaagcagagaagaacagcaaaattgtctgatgctacagtaaaaacaatattttgcagtaatctattatctatctatcttctattatctatctatctatctatctatctattatctatctatctatctatctatctatctatctatctattatctattatatactaaaagtccattaatcttcctataaacactcctaagccgccatgtggcgctcctacaagcactcttaggttgccacgtggcatgctataatctcaccgttgattttcatttaaattggtggacccattattttaaaccgttagattagatctattaaaaaaaggttaatacttcatgtgtatacataatccgtttacacttacctaaaaaaaagtcagcataccaggaaaacgtactatgggccgaaaaaaatatacctttacgtactatattcatttgaaaaacaaaacaaaggacgtacgtaccgtttagcgatggaaaaaatacctttacctaccgttcatttgaaaaaaaagatgtacgttaaaaaagctataaaaccctaaagaaaattatatgtaaatatcagaaccatcatcgaaaaacagactatctttttaaataggattttctatataaaaaataaaatttattacttcacaaatatggttacgtgatgcttctacaagcactcttagaccatcatgtgacactgtgtaatctcgccatcgattttcatttaaattgatggacctgttatgaataatatgtgacgaaaataaactagacgctaaaatatatatatctgagacatgaacacttagctaagtagtgtattaatgatatattaggcttattttatccgcatttatgcaatttcatctattaataggtagtcagcttttaaaatatatagtgataatgagttgttacgttaatagaagaatttatatgtaatcgggacaaagtgttttttttttaatctgagagaaattattatcattgaagtatactaaagtctatgatctatctcacgacgtagaaatgtgagatatggcttcttttagcactatttcatagaacaataaataagatgcccgcgcaaccgcgcgggcttccttaaaagattgtcacggtcgtatgtatatttagcgatacatttcttaataatcaacctcactcatttcaaaagagaatattttctctatgccataaaaacttaagcagtactgattaacaatacaaacaaattgtctctactcaaaacgtaaaaaaaatatttttatggaaagaattattttcttcacatctatcttctctttctttcatgaagggcatcgagcagttagccagttaacacaactataggagggacatacatatgattgagttgagacagacccaatggagtccaccattgacaatagtactcaacttcctacatactaatgcaataagctttgaggataccgatagtgaaataggacttagaattatgctccacactagctttgattggcacaagtacgtcgctacgaaacccatgtttgaaggcaatagagaaataaattctcggtagctctacccattagagggtatattcatgtctaatttttaacagtattatccctttaaccaatagaagcagtatttttagaatatttatttatagatttagaaataagagttaacgtaaacatttaggtatgtagtggagattgatgttttatgtattaatgatgtaatacgcttactttggtgatacaaatgtagttctgtttattaaaaaggcatcaagcaaaaatgataattagtaatagtgacaataggcgagtttacgtgtaatctagacaaaagtgatttttgtttgaatataagaaacattgttatcatttattaaagtctacggtcaatttcacgacaaagtttttttttattataaggtgaaatctacaatttattatatttattatatgcatacagtgagatatgacttaattctatttaacattatttctatacataataaataaggtgcccgcgtatctgcgcgggcttcctttctagttcactatagaaacagcagaaaacagtgaaaaccactattcacaactactgttcaccaaactactgtggtgatcgatctcgtccgttcgctgtgaataggctaaaaatactctgaaagtcaccgcactgtagctctctggctttacacacatgtaaagtcagaggatccaaatcccaggggtgggggtttgggttgctagtactacagtcctgctatacaggggcgtagacagggggtggtcctggtgggctcgggactaccctgattttggcccaggatatccccacccccaaaagcccacaaaccttggttcttattcaagcccagaaaaacaagctcacaaaccttggttcccattcaagcccagaaaaacaagcccacaagagagaaggaaaaaagcgctaggtttggccttctgggagtcaaggcatctgacgaccacgacgccgtctctactcgtcctcgtcgcctctgctacgcgcttgcgccgccgcttcctcgccaccgccgctgccgccgccacttccctagctcgatctacggaggccgaatggcgaagcgctagaggcaccagtccccacgccgcgctgcctgggtgcaggctgcttacgccgctcgccggggctcctcacatggcgccgccaccggccgccggtgccaggagctgggagcccaggaccctggcggcctagccctaattgatccttgcctcgatgttttccctccgtctaccccttggaatcccgtgcttaggtgagtaaatcattgtattgtgatttgtgaatcagtgaatatgtgaatgtgatttttgatttgtgaatcatcggatgtgaatgtgttgctatttggtactattgtagtatgtaggatttgtaaacatgtggttgatatggaattgctcttttgtatgttagccttaatctagtgatgaccaagaggagaaacaatatatgatttattgaatcattgatttgtcacatatatcaagtgagatatcttttatgaattaagttagtaaagaagacataatactaaaaactttgatggctaagatattggcattgtgattttctatttgtgcccaagatcttttatatttgcaatatttatgttgtaatatttgcacgtgtgagcttgcttgttaagttagtcaaatattgacaatataagacaatattgttacatttctattactttttcattaaatttgtactcgtatataggatttacgacgtttgaaaatttagctatgtgatgtgtatttgtgagtaggactacacagcgaaaaattcctggctacgccactgctgctctatatatcaagccgaagccgaagccgccttgacctgcaaaggcagagcagagcagcgcaggcgagcaggttgcggagaagtggaagccatcagctgcctagtgctaaagccatggcgtcgccggcggcgagcaagccgcacgtggtgctgatcccctacccggcgcagggccacgtcaccttcgtccacaccgagttcaaccgcgcccgcctcctccgctcccgcggcgccgccgccgtcgccggcgccgacggcctcccgccgccgggccagccggcggagctcgacgcgacgcaggacatctgggcgatctgcgaggccacgcggcggacggggcccggccacgtcagggcgctggtcgagaggctcggacgggaagccgccgccggcggcgtcccgccggtgagcttcgtggtggccgacggcgccatggggttcgcggtgcacgtgaccaaggagatgggcatcccgacctacctcttcttcacgcacagcgcctgcggcctcttggcctacctcaacttcgatcagctcgtcaagcgtggctacgtgccactcaaatgtagtagtaacagctaactgattaaacacgatcattactggttctaacctctcgccattcacaggacacttgtgctacatccttagttaatttgcactaatttgggatcataattatatatatgaaaaaatggatagctagaaattaggattaatgatcagaagatcagtagttcagtacgttacaaactctacttttttacatgctccaagaagaaaattcagaatcaagttagccgtcaagattttatctatccaaaaattgtttgggatcatcgatcacccatagatagccaacggtacgagtgaccctatgccatctagtgaccaatcaaaattttcatggatttgtttttgagtccaccacattgagcatagctttgagatatactccctccatactcgtaaaagaagtcgtttaggacaatgtttaagtcaaactttagaaatataaatcataaatatctctctagttattaagtttgaaaatttaaaacttatatgaatagatttgtcttaaaaaatacttttataaaagtatatatatatatatatatatatatatatatatcacttttcaataaaattttttatagaaacaagaagtcaaagttgtgttttagaaaccgtgtcgctgtcttaaacaactttctttacgagtacgaagggagtacttacaaaaaccaaaacctgttgaccagatcaggccccggattgacaatttgacattattgtccaagcatttcggtacatgttatcagcgcacgctacggatggagagaaaagcactccacgtagtttaaaatatcattttagtccagctatgttgtcattagtgacatcaaagtctaaccagcagttttcctttccttttttttctactgccagtacacttcatttttagatatgtgatgttatcgacttttaatatgatgttcgaccattcatatgtaaaagctactatagcagaaattataaaaatataagttatgcataaagtaactttaacgataaaatagacaaaaaaagtatacttaatagtcatatatttaggtcccccatcatttattaggaaataaaaatgaatttgtaagtaaaacttttataaatgtgttcttggtgacttaaaagccaatattaaaaagaaactatattgaaaatattttaaaatcaatctcaaaattaagattgaaaattcaaaatttgtctttttctttagctgattagaccatccgatgggagccttaaaattagaggtagtattaattatacaaaattatcggggaaaaaacacttaataactatcaggtaacacactacaaaataaatgaactttatacacatgatcatacagaaaagcactgtaattatcaggttaagttacacaccgaaatatgaaccacctttaattgtgtactgtgctatacagatgagagttgtttgaccaacgggtacctggacacccgcctggactgggttgccggaatgatcgccggcgtccgcctccgcgacctgccgacgttcatccgcacccccgaccccgacgacgtgatgctcaacatcaccatgaagcagtgcgagctcgacgcgcccgccgccgacggcatcctgctcaacaccttcgacggcctggagcgcgcggcgcaagacgccatccgcgcccgcctccccaacaccatcgccgtgggcccatcggccagaggtctcgccgccgtcgtacctcccttccctcgcctccagcctgtagagggaggacggccggtgcgcggcgtggctgaacgcccacgccgacgccgccgtggtgtacgccaacttcgggagcatcacggtgatggggagggcgcaggtcggggagttcgcgcgcgggctcgccgccgccggcgccccgttcctgtgggtgatccggccggacatggtgcgcgacgccggcgacggcgacggcgagccgctgttgccggaggggttcgaggaggaggtggtggcgagcgggagcgggcgggggctgatggtggggtggtgtgaccaggaggcggtgctgggccaccgcgcgacgggggcgttcctgagccactgcgggtggaactcgacggtggagagcctcgccgccggcgtgccgatgctgtgctggccgttcttctcggagcaggtgaccaactgccggtacgcgtgcgaggagtggggggtcggggtggagatggcgcgggacgccgggcggcgcgaggtggaggccgcggtgagggaggtgatggggggaggggagaaggcggcggcgatgaggaggaaggcggcggcggcggtggcgcccggcgggtcgtcgcggcggaacctcgagagcctcttcgcggagatcgcgggcggcgtccaaccggtaataaatccagtttgaggaagcgcaacgcaatgtgttttgtgttggtttgtgtgtgacgtgtgtcgtgcgcttgtggtgtgttttgtggctttttgcgtgtgtcgcgacggatgaatctttctctgccgtactccccttttacttggatcactgacgtatgggtttgatgatctgtttccgtgtggcaatagatcgggttgtgccagtttatccggggaaactgtgatattgtaggggttaaaaatggtaacggtaatttctgccaaccggcgtttgtttttaactttctaccgactaagccatatgaaaatggtaattgaccgaaaaaatggtaaaggtaacaaatatggaaatagaaaacgaaaatggttttaccgttttcgtattcttgtgaaaattatgtttcttataatatggtaattgtttagagaggacaaatctatcctggagatagacaaagtcactacagtcgcctcgctgtcgacgggtacgttgcctaccaccgaaagcacagagccgttaaatcttggaaaattccgtacaggcgcttcgctgtcgacgggtacgttgcctaccactgaaagcacaaaaccgttaaattctgaaaaattcgctctcatggggagtcaaacccaggaactaaggtactgctgagactcttgtaaccactagactacaaacccttttgcaatcaaatccctaacttaagtgcatggctaaaatggagttaatatataatttacatactacagcttaaatttatttgtacatataatatacttatgtaaagctaaatatatgtttttatagtttaatgtttccgtccgtattattccgtttccggtgttccgatatttccgatatcgttttcgtttccgacattattgttttcgattttattttcaaaaaattttaattatagaaatggaccaaattgttgatattgttttccgttagtttctgactgttttcatctctagatattcacatcgcaaaatgggacatttgccgtttcggtttcatgggaagagctgcgtctgtgtagttgttgcctggtggggctcgacttgtacttgtactcatggacaatataaatcgtaaaatcgtagtatcatatatattctgagatggcgaaagcagtggtgtgacgtgtttgtgttggttacttggtttgtgtgacgtgttcgtgcgcttgcggtgtgttgtgctttttgcgcgtgtcgtgatggataattctaagggactgtttactcctcattttaaagaaaatcccttttaatatactacaaaattttgaccattgaattaatttgagattcgtgcaaaccccatcaaaccctaactacttttccttcccctcctcccctgccgccgcaaaaaatagctcgctcctctctcgacaccgcgcgcgtcctgcgccgccgccccactgtgccaccacctcggcctcgcc

SEQ ID NO: 15370 - DNA, 15580 bp, Oryza sativa
  unsure (1)..(15580): unsure at all n locations
cgaggcctcttacccctgtccctcctaccctgcgccctaatgtgcccgtgggagtacgtgagtcggtccgggggtaccggcacggcaacccgtcctgcctgtacaggtgtgacctctggctgctcctgagtgtgcgcctctgaagctcctccaagctgagaggagcctagtacgtcgtgtcggtctgcgccgtgcgagtcgtcgtcgtagaactggctagtaggaccagtccaaccggcgtgagacgaagaggctccagtactgaagatcccgagtgcaaatcctgctggacaaggaccatcagtttcgtacatgtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcttgcgatgaggaaatgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcatccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctttcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactggataaacttataaccgcagncgaagttgcacttaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatagataccacgcctgctcctatcaacacacattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttcaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgataatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgttgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgccttcttcatctcatccttatgagcatatcttgcaccctcaattacctcgttctccttatactcccagggtacatgatcaccctctgatataacaagtccagagaagtccttatttgcccaatcagtggccattacatcactttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggagccatgtccgttcaaaagccatttccacataccgtctccaagcatcagtgctgtccatcggcattagttcccaaaaataaccttctgttgcacgactcactacaactgacactgacattgtgtagacttcttggtctattctaaatcctcttaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgtttttttggatttttagtgaatataatgaaatttcacagaggaggtactgggctttatagggggagaggcaaaaatcgccctcccccagggcggcaagggggccgcctgcaaaattccatgccccctcgccgcccatttgcaagcggccccccccacagtacaaaatcgccctagcggagggcggcaagggggccgcctgcaaaattccatgcccccccctcgccgccaatttgcaggcggccccccgcacagtataaaatcgccctagcggagggcggcaagggggccgcctgcaaatttcgttgacggccgtcgcccgagagcgaacggctgtctgccacgtcattttcgccgccctctgagagggcgatttttccagagggcggtaggcgactccttccgtcaattttcaaaatggaaaattatttttgtaaaacttttaataaaaaaaattataaataaaaaaaattcgcctttttacggtgaggcggtgcgctcccacggatcgatccatcagaaaaataaatgggacatttaccgttttggtttcacgggatgcgctgcgtctgggcagtagttgcctaatttggtgaggctcgacttgtacttgtactcatgggcaacatatgtggtgtttggctgtgtttgagttccctttaaacttccaaaaaaatcagtcacgttaaatatttaaacacatatataaaacattaaatatgaataaaaaaacaattgcacagtttgtatgtacattgcgagacgaatatttttagcctaatgtagtgctacattaaatatttgctaatgatagattaattaggcttaataaattcgtcccgcagtttacatgcgaaatctataatttattttattattagtttatgtttaatacattaaatgtgtgtctatatacttaaaaaaataattggctgcggaactaaactcgacctttgttagtaagataagccgtaaaatcaatagtatcatattctgagatggggaaagtaatggcggtggagagatcaatgtttgtaccagatttgaagattggatgtaacacacagcacaacggggtggtttcgcagttggctagcgcgtaagtctcatagctatacgtgagtgatcctgaggtcgagagttcgagcctcaccccaaattttttttttcaacgtgacgcacaacaaagcgactcgtaaaataggcccagcacatctgcccttgttaaatgaatagaacggccgaacgcgaacccccggccatcctgagtgcctgtttggtttccaggacttatttcaactccctgttacatcggatgtttagacactaatttagagtattaaacatatattaattacaaaacccattctataaccttggactaattcgcgagacgaatcttttgagtctaattacgtcatgattttaacaatgtaatgctacagtaaactataattatggattaattaggcttaaaaaattcgtctcgcggattagctctcatttataaaattagtttttttactagtctatgtttaatactccaaattagcgtccaaacattcgatgtgacatgggctaaaaagttttagccccatctaaacaccccctgaattgctagccgttttcgtgcagcgacgcacgggctcgagtgcgtcagagcaccctcgtccgttgcattgcatcggtaatatttttggtggttttctactcactcaggactcgcccgctggtgagtggtgagcgctgcggccgtgtacttgcagacgcttcgggctgtttcactttattgccaaaatcaatcaatttaacggcttccacatctcggcctgcctaactgggtgatcctctgttgcatcatgcatgcttgcgtgaacaagaggatcacaaactggccgaaatacctaattaagttaattttacacggtaagagagagagagagagatggcacaggcacgattgactggcagccgtttgctttccgaaactcgattcttcttcacaccgctcggggttgcaccgtgccagaagatacaccagatagtcgaggatggatttgttggatggtgcaagcctttaccagtttgtgtaccagtaccacacgaagatgctcacgaggagagacctatctgccgtcgacggaagctacacctgcgaaacggatcaaggaacatgagagatcacccagaaatcgtatcatgacacatatgcagtttgcgaaaccgcaagtttggttgcaaatgtccgtttcagtaatgctatgaaaactgctcgataatgactattcccaaaaaaccgctgaaatcatgcacattcaaccaagctattgtattcatgtgttggttgtcttataaaaaggttgatgtcctacaaatgcccaaagtttgcattattgcataccttctcatcgttcaaaggttcggtgactccctcttggaaaaactcaatgatgttcctgcacacatccttgggcttctcaaggttgaccgcatgcccagcatttcttatcactactaatcgagaactctcacctagatgtctgtcaatatgttaaagtcaatatcattactctgccaatcgatcctattctttgtgtactccatggagaaaatttgtgtttcaaattgaaggtagcgatagcaaacctcttcagtctatgagccaactccatggggaataccttatcccgctccccccaaactatgagcgctggctgcattaagtgagaaagaaaccatcttcaaatgtttcagatgtaagtgtagtagagtttaatcacatactaattggtacctggctaattattggaagatctgaaagctgcctttcactaatcaaagcatataataactcagttttttcttggatataatccgagcccattacctgatacatacgaaaaaagcaacatatgtaactcaatttctttttcctgtacataatccaagcccagtacactatttattgtggtttatgtgctactcaaatcactatggagagagcgcccaaatcactgattattccatgaatattcttgaaaaacatatcatctgatgaaagtaactgagcaagagctcttcaaaatactcaatttttgggtattttgctactaaaaaaagataagctgattttcaaaatactcaattgtatatgcaaatgcctgccttctatgtcttcaataatccataatatgtaaagcatcacaaagaacaaaatttgagatgtttcgagctttactaaagtcgagttggctcttgttacagatcaagcaaaccttcatcccattttcgcgaacgcgcaaaaggattgcacgtcaatacattagaagaaaggagttatagttacacaacgcaatcagccataccggcttatgccaggggaagagagaaaaagcaaaattaaaaacttgaagcttagaaaaaactacggtggctaaaacacaaactccaagcaaaccttggagcaacttccagtatacattatgccccatgtatgccagtaatcaggttcaattaacaagttcagcatgtgggcgagaatcattctttcaaaagataatgaacctcatcttcataatcgttcactcttttgtttacaaattcagttttctaattcctttttgacccaggaggttgatgatttctgtatttcacaagactgtatccttgaatgttacccgtcatttagggagtgtctaataagatcaaagcatttcttttagaagtcccatctttaatttgtaaattaacacatttcataatgtttgcagtttatcacatggatgaacatctgtcacgccctgaagttcctctccttgctttaaaatttgttaaataaatcgcccgaagaaattgttcaatttaacctagagttgaatccctaaattaataaatgcaaataataatcggaatcggcatgtggaatttttcttggattctacatgtcaaaatatgctaacaggatttttagtggaattttcagagccttggaaataattttaaccaattaaaataagcaaagtgcaataaataattcctggaaaatcctttttttccttttctcttctttttcttcctttttcctccctttttcctcttgttgggccgtcggcccacttcctcccgcgcccttcctccttgctgggccggcccactccctccctcctctctccgggtcaccgacaggtggggcccacctatcggccccttcttccacctccagccgacggcagcgccgccgccgaaaccgccgcccacgccaccgcttcctccacatccgcgccccgctctgcgcccacacgccccccacgtcgcccgccccacgccccgccatattctgtccacgcgcgcgcgcccgcaagggcgggattcaattcgaataccccccactctctctctccacctcccacgtcgtcggcgagaaatccggctgcccccggccacgtccgcccctcccgagtccctataaaacgctccccgtgtctccctctctctttttccgcgctcgccgtctcctctcgtgctctctaacgccgccgcgccgttcgccgctagcgccgccgcttgccgccgcctccggccgtgcaccgccgccactatagccactgccgcgccaagccgccaccgctactagcttcgccgtcgcgggagctatcccggccgccgctcgcttgccgcgcgccgccgcctaccgctgctagtcgtcgctagtgccgtcgccgcgccgctccgttgctgctgttggcctcgcgagatcgaggcccgtctcgtccatcccgcgcgccccgccgtccgccgcttgccgccgccgtccgccgtcgtcttcacccacgctggccgaatccctggtgaggactcactcttcctcttttactcctccttccccgtgtgcgtcgccgcctcctgtccgcgccgccgctttggccatgtgccgccatctcctcgccagccaccgccatctccgcgccgccggtcgccgccgtcggtggccgctcgccgccgccgcatcacctaaccggccggctggtttgaagccgagccgagccgaccgggcatctccccctccccttgagccactgcccggtggggcccacccaccaaccggtgccacctcctcccccttgagctgctgccgggggggtcccgcatgtcggcgcccgcccccctttgctgacgtcatccgggatcctttattgcgcaataaaactcagtaaggcttttcttttatagtaataaacacagataatcttctaaaattcatatctaattcatccgagctccgattaagtccattcaagtctcagtaaattcataaaaatgcgtagaatccattaaaaatggttttgtttcctgtttcagtagtcttataggctgttttgcttgtgtgctttgtttgtcgcatagatttcggtcgtttcgtcgatccgcggtttctcgaagacgttgctgtggtctcatcagtgcgagagcaaagcaagccatacattacgattgatcatattgtacccaatttacaaatgtcccgcatttctattaagtattgcattgttttacaatatcacgtgggatgggtcctactactcagccatatcttgtttaccttatgccattgataacttgggtattaagatgcttagatgttggtttagggaatgcttagccatgcttagttcaactagtacacaatggaggaatcacattaatgcatagactttgattattggcaatagctttggattagtgccaccgcaagggtgttagttaattaaaatacactacatggtgggctgtgggtgcatggttttgctagtcgtgcccatggcgattaaggaccggttcgcgggatgccctggaagaatttatcgtacttgccacaagccagcatgggcaacggctgggcttgtagtgtagctttcctctagtcgacgtacccaggcgagggtgggcgtgatggagttgggtcggccagggtgtccggttgatcggcttccggattcaccgcggtacgaaaggggggctgcccgttgcctgctggggacgggggcgaaccctaaggtgtggtgcgatcggttaaagggggttatgtgaagggtcctgtcacggcctctttccggtatgtcgtggtggcatgtcggcgcacggtaacgtgtcgtggggctgcgtcttgtgggtacagttgtacacctctgatcagagtaaaactattcgaatagccgtgcccgcggttacgggcggtcaaccagattcaccgtgattagtctcacccctagtttagcttaatgaactggtgtagttcaggtggttggttaggcctgttgcaatgtggtgtagcgttggatagtgattggttaatattgattaattgctacaactattttactgctttcaactgctgcttttaaatgctagctttatgcaaatgaacctctagcctcctttggttataccctgcatcataccttctcttccggtatgacttgctgagtacaatgggtagtactcagtcttgctctcttttcccccaccccagagttgaagttcttctcagttggagatctctcgatgaagttggtttcgtcgctgccgtcaaggatgtctgtggaatggagtcgcctcgctgcatgagtcaagtcttcaggcttagctcgcttttatccttttccgctgcatttgtaatcttttgtatttttgtaagacgtggatctgtatgtcaacaattgtcgtttgtgtaccctggctggtcctggacaggggtttaatgcacattcagcttagaaattatggttcgtaaatttttgggcgtgacaacatcccactagtataacgatgctaaacaatctatccaacctggtattgaattctccccaacaccagaaaaacttgtttctcttcttttcctgctagcatcagccaacattcttgagcagcacatgaatggatacccaggataactgggtgaaattagataaaatgttctcaaccaagccatattttacttgaaacaatttccactcttttgagctgcatttgccattactaaagagaaggaaatggttgcatggtcaaatgaactcccaactgctagcaaaatccagttgcaatttattaagtccaaaatatgttcgcatttcggtagtctgggtacaagtatatttattgagggcaaaacactaacaggaactacaaagaaaacttaggtgagtttgaggagagggggattgagaagattgggaagatacacaaaacgaggtgagccattagcacatgattaattgagtattaactattttaaattttaaaaatggattaatatgattttttaaagcaactttcctatagaaaatttttgcaaaaaatacaccgtttagtagtttaggaagcgtgcgcgcggaatacgatgtccttttctcacccaatccccagaactcatcacaacgaacgcagccttagtcagtgtctgaagtatacacaacagatacttgaatgtacatgggtaagcaaagaactggtgggcctactaaaatgcagtatcaaatcaagtgctctgttagtttttgaaaaaatcgagttgtcactaccctggccctacacatgcaagtgtttccactgttctccacatttgcaaactatgtacatatttaagcaaacggacaagacaaagcgaaaatgacaatatgtttctgttaagctactgacaagtgtaaatattttgaggctctgttggctcaatcaaatctaagcatgtattaaactagccacatagaggacattcagtgagttggtgtccattagtccatcataaggatggtaatattaatacattaagtgagatgttctcgccacaaaagacaaactgcatttatccccttgccatttcggttcaatacacttttgcctccaagcatccctcgtaatggcgtgcaaaaacaagattagcctcgtgatcgtgagatgatcacgagatgcctcgatggctaatcagcaaaattagcctaacacagatgtaagatgctactttgtatacttctatatggaatagaattcggcataattccctaacaactgtagagagcacagcattctagaagtgcctaaatttttttcccctcttgtgattctataacttcatctaatgcccgatagcaatgtaatccagggattgatttcgaaccaattttaaaaagaaatctcaaagataaaaaacgaagcggcctaaccttaatgtaatcccagaggaagcaggagggcataatgcagggtggccgcacgaatgtgagcctgacgaggcgccgcacctcctccggccgccgcggcacgagcaggtccgccgcctccccgacgccggccaccgggaacagcccaccggccaggtccttctcctccaggcaaacccccgcgcacaccagcaccaccctctccaccgcgtccgggtacatggccgccatcctgtagcccacgaatcccccatagctgaccccgaccaggccgaacctggcgaccccgatcgcgtccatggccgccttgatcgagcgcgcctggaaggcttcggagcggtcggcgaggcgggtgtaggaggcgccgaagaagaggaggtcggggacgatggggtcgtagcccgcggcgatgagggggcggaggtagggcgcccactgccacgtggcggaggcgccgaagccgtggaggaggaggagcgggttccgcggcgggttggcggggacccagacgtgcacggtggtgcccgcgtcgtcgtcgactccggtggggagcgggatggcgagcgggcggaggccggccctgaggaagcggcggctgaagcagcggtcccgcgccgccgcgaagctgaggatggacgacctcctcccgatggccgcggccggcggaggtgggggtggcattgctcgccgccgaccgccggagagagttgcgcggctaaatttggccgcccaagcgtggtggtggtggtggtgcagcgcgagtgcgagaagagaagagaatggcacttgcttagatgagaatgagattagtgctcgtcattgtctgggtggttaagctgctttattacggttttaacagagccaatcaccgtgtgtataacgtgggatggtcacaggatggaggtcggcgcgtcgggacgtggcgttttttttttttttttgggcagacagaaactagtgctacaaaagccggcggcccactcgaatcgtcgaatccaaaggaacccactgctcctcgatgcggagccgcggagaagacgcccactcgtactcgtggggttgtgcgggcagcgcgcgcgcgccacgtgccgccacgcgtgtcgcggttcttgaatctttgagacgccatttcgtttcatcatttttccccctctacgcagaggcgccggcggccgtcgacggagccgcaagcggtaagctgcttgtttctctcggtggacttcaggcctcatcctttctcagccaaaatttttgaattttaattttaaatttaaagttgattttaggattttattaatcgtagtttatttttcatcctttatttttagatcattaaatacatgtatataaaagttgtattcacatttttttttcatttgcaaatatacccattttgtttttttctcttattcgctaaacgatggggctattcgtcttagaccattaagaacatgtatataaatcttagaccattaagaacatgtatataaaaattttattcacaaattatctttcatttgcaaaaatacccatttcgttttttctcttattagatatatatataaacgatggggctgttcgtctaaatgacagggctaccctgagcctgaggccagaccgccagaggaacttccctgggaagaggatcttctcatttactttcctcgctaatatatggatttgttagataaaagaatttatatgttagtgacacaagttacgtaagttaaaaagttccctatctggctgcccaggcttgacacctgctagaccgctagaaactatcagaagatcaaacttcacgctcatatcagctggagggaaagtacaatcacaccagaaataagcctggcatcacgttgaacaagccgttcaaccctgatcatgcgaaccacgagtagcaagggatcaacacgcacttgtttatccaaccaaaggggccgttgttagttgtaagtagtaactaagtagtaacgcacagtgatgggcgatatactggtgaataacaagagtgtctgataaaacatgagactactgtatcagataaaccattcattctgtgcaaagaacattttcatagtgctctctgtatcaaaacaagacgcgctactgagatcaaggggaggagaggagaaaaacgaagaagaaaatagggctaggaatattgagctgagctgagctgagagtggcatttgcccattacaaacctccattagttacagacatcaacctgtgatggggactgttccccaatccccattagacgtttcgtattggcagtgtataataaaatcaggcaatataaatggccaagaatggcaatgtgatgatggtactctcccaaaaacttctaatccatacatgagagcaaaggcggagaggaaggtggattccactagctagatacgtacatccaccacttgtaaaggccaaacccatagattgtcgtaagcatagccatccttaggggatagggcttaaatctgcaggggagaagataaaaacatggtcagtcagttttctgattaatagcacagttatatgaagctaaatcagcagttgatctaggacaatggaattaactgtctaagcatagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15371 - DNA, 633 bp, Oryza sativa
tgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttctacggtaacaatccaaatatgccctaaaaaataataaaattgtattttaccagtcttgagattttaatcttgtatagttttcaatataaaaagatttgataactattgatatttatacaaaattaccatgccccctaaacagcccatttgcaggcgagccccccgcacagtacaaaatcgaccctcgcggagggcgagcaaggggggccgcctgcaaatttcgttgacggccgtcgcccgagagcgaacggccgtctgccacgtcattttcgccgccctctgagagggcgattttt

SEQ ID NO: 15372 - DNA, 164 bp, Oryza sativa
tgctgggccggcccactccctccctcctctctccgggtcaccgacaggtggggcccacctatcggccccttcttccacctccagccgacggcagcgccgccgccgaaaccgccgcccacgccaccgcttcctccacatccgcgccccgctctgcgcccacacgc

SEQ ID NO: 15373 - DNA, 5423 bp, Oryza sativa
  unsure (1)..(5423): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttctatttgaaaatttgaaaattatgcaactctaaatcttccatcacccaaagtacattgcttgcatacatcatattccatcaccaaagtcaggttagaagcttttggctcgaaggacattctcgtctttttgaataatctctagccaattaggctgaatgggtcctctagcaaattattagctttttacagtgttctccaattgttatacatttttcgatgtctaccaacaaattacacaaactttgagtatcctgtagcaaaatttgtcaaaaaaaaaaggtacaaacaagcattgattttctcataactccgcatatttagctttattgcaaaaaaaaaaagaagacaaagaaccttcaaaactttctaaaatatattataaacactactactttattgaatcatctccaagaaaagagtataagctttacaagaatatatcctatttatgtgaagtactaagatctttacctaaccaaaagaataatcatgtacacgattttgaggcagctcagactgaaaacactcaacaatgctaacatcacatgaagcctcttattactatacaggaaaaagaactgctccagtttgatctaccctgcaaaaatcaatacaatcagtctaccaattgccaacaaacatagttaaaacataacgtctgcaaagaaaggaaggaaggaacaggagagaaaacggtcatagaaattcccgatcgaccgagcgccgtttccgtataagggataccgtttctgaccgtaccgtttttggctatcttaaaattttttttctaatttctttctgcatcgtattaatatcgatattgagtagttaaaatgataaatatggtcaattaccggccgatcgagcatcgtttctgaagagatgctaccgattccgatcgttttcgaccgttttcacccctaaataggacgaccttgttctatctaaataaaatggtaataagctctccccctatatggactagaacacttcaaagttgcctcaccttaaaatgtatcaagatttaggggaacatcttcatcaggcttcgcttttggttgagtttccttgccaattagtttcagaggaacatctagttcaggggggctctgcacatatagttatttagataatcagtgatgcactaaacaaactatctttgtcgaaatgtcttgatgctcgaaacattcaaagtaccatgcaacgtatgagtggccaattgatgtcttgaaaaaaggaatgttgcttgatgtcatttgcaccagcatttgaacctatacgatttgaaggatctctctgaagtaatccatggattaattgctttgctgcaagactaacctggagaatcatagtgatattaataaatgagaacaaatgaaaactaaaatacaataacgaagtgtaagataggcataaacattttcttatctaacacatgctaacacatacccttaacatgatatcttacaggcttgctggacagattgtaaattggactcaacctttgtagttgcaaattgaatacagtatgcaaaaaatattggcctgcatgacaggaaacttcactggccatttctctaaaaaagaagttcttaccggaatgctactgggaaatgtaaggtctttgtgcagtatgttataaaatgtctttttcctgttctttcctcggaaaggtgtacgcccatacagcatctcatacaatagaattcctatagcatgggaattgatgttagctggatgtcatcttattattagcataatgcatatcaaacaatataataatgccatatcaaacaagttctcatggttaggtacttaggtgtacctgaaaacacatatctagtacttacacatcttataattatctagagagactagggatgtattggtgtggtagatacatatacagatctcagaaataaacacatacggagggcagtgtaccttcgggtgcttctaggcatttgacatctaagcagcatggttcaattgacacatggagaatttggataggttggagtcagcacataaacccacatgttctaatcatagcacctaccggtaccttttacacggaggccacttccatggaagggctaggcatgagaggatttttagaagggatattacaccattcaattttatgtttgttttgatccctgttatctagttaaactgactaacctacttaatgtgatgtaaattaaaaaagtgtgatatagatcagttatagcaggcaaaagtttgctgcagtgcaacttgtgacatgagttttgtttaattatgcatagcagtgtagcacaaaacaattaacttaaccgctaattatttagtcaaagtggtaatatggactattctctgggtggaaacccatgttcaaaatcttgtttgaatggcacatggattattatgaataatttgatgagattttagttgaacctcaaacatcttttaggtgattgctataagactataccaactaccaagaagatcgaataaataaaactaactcttttaatccattctgtgcaattcttgtaatcaactagttcataagatgacccaaaaaaatatattaggttattgcttaccgagagcccaccaatcgattgcacttgtatgccctgcacccgttataacctcctaaaacgatgcaaaagttagacaacaatcatgctacttgctgagaaagaatcagagaccaacattgacaacaagcggtttcgtaagatgaactgaaaaatgaaaagcatacatgtaaaattaactaaaagataaaaaggctacacctgggtcttatgataatgcatatcaagttgaaattaaaacaattactccaacaataagcataaagaaaacacaaggatcattcttactggagcgatatactcttcagtaccaacaaatgaatttgatggagtggaaggttctgagacaaatgttggggggagaaattcttgtgaccttcttcgttttaatgatgtggaattttttatcacctgcaggagatttaaccaacatcagggcaatatcaagtgttttaagtgcgatagtttcttatgaacaacaaaaacacatgctggaaaccaccaacaagtactcaatataaacatgttcttgacaccattactgactttgaatactatgcaagtggaaaactcaaagctcattactcaggaatgaagtatatttttgttttaaagtttgcgatcacacattctagcatacagactataaatgaccaaaaaaaatgaaggtaaatggaattagcaaatattctataaaaactgcagcaagcctgaaagtttattccctcaacttacgtggggttttgaagtcgtcaaaaatgaaagatcaaaatcagtcagtacaatgtgcccatctgcttggagcaaaatgttttctggcttcagatcacggtatataatacctacagcaggaataacacatgcagattagcaatctttgatctcataataagtccaatggcaaatcagtatctttaatgaaatagaaatagatcgccgattgttaacagtaaacattattaatacttggtttcactcaatgaatctgttcaaaagataggagcactaaattatgtaaacacatctatacctaggcaatgaaggtactcgagaccaattacaacctctgcagcataaaacctacagaacggatcaaaataatgttatataataaaagagagagtaggtgagtcgaatgatatagttaacataagatgataaggattcatggcaagaatctcaattatcttatttttatatttctttactcctttaaatgttccttgtgggggtggtggtgagtctgcctcacataactagtcaaaagagaagactgaaaagaatggatatcgaagacttctggtgggtgttcgagaaaaagactactggtagtattctgttacatttctttcttctttttttttttcatacatgtagttcttcaatcctacactacatgtatgtgacaaaattatttactagaaacaatttcattctattgagcctcagaaacagtatatcacaacaactgaactcaacagctgtttgcaaataatcattcacaagttagcaaaagcttcaaacattgcaatccatgcaaacccagcataatttattaagaaaaaagcaactttatcatcattatgggaaaactacatacttggatagtttctacaacagaacataattgtttgtatcaaatttgggggaaggaataatctggctggcagatccaagttcaatcaagtagttcatatttacttgtttgtctgcccatggggtttacatggcagtaaaagcaatgcagtagttccccaaatcagtttccacagttttatttatcataagctagtaaaatagattaaaaaatgtaataatatgtaagatgtaagtacttttgatgacacatctttaggtggccaaacctattacaggaacaaatattatttgtaaaaaaaactatattccatacttgggaaattatgtaagagatacacttcaagaatgaaagaaaaggtaaattttgaaaacatcatgattttcaaatagtggtatgtacgaactgacccagatgcaggaaattggaacaggtaccttgcacattcttccctgaaaattttcatgggttgcctatcaagcactgcaaagagttctcctcccggacaaaagtctgttatgagacaaacatgtgttggcgtctgaaaatagacaacattagtaaagaaccttgtggtttttaaattagctggataatgaaaaactagtatggaagttaatacaaaaactactctctgatgtttgtgaaatgatgaacaccttacagaagccatatttaactgaaactatgagtaattattttatttaactagcaatacaaaatatctgggataaagcattggtcataacaatgtcagtctaacctgaaatgaagtatacaatgttgggagaaatggatgatccaatagtgcgtatatttctctttcaatacaagctcgatgtacctgcaagagagagggagttgaagtaattcttgcaccttatcgtactagcaacagcaggaaaaaggttgatcacatccagcatggatggaaatacaataacaacataccagcatgctcatgttcatgaattaaaattacctt

SEQ ID NO: 15374 - DNA, 39219 bp, Oryza sativa
  unsure (1)..(39219): unsure at all n locations
atccaaactagacaaacctatgactgacgtaaccagttttttatgatgcagtcaaagtaaacattttgtttctgacagcatgctttcagaagatataccaaccatctatcagttagcaaaaagacatcgtatagaagattgttcaggacatcttagtacctgccagtgtcaccacagccgagaggttttacaggcttgaagtgtttcaagccaatcttctcccctaaatttgtagcctgcatgccaaataataataaaaaatttatggtttcatagaatttaatttgggagtttcagttaatatgtttcccattcaattttaggatgcacattatcatatttttaaaaatcagagactattaagagcttagggtgctaccagcgtccagccatttagtacaatccaggggtacacatttgctactttggaacatgtgtgattacagtcattactttgcatggattcatgtactaattcactggaacatgtttatagtcatgcggacagcacgctcaaactaacctgggtgctggttagcgcttttgacggaccatatataatataatgcataaacttttttcttgaatatgcaagagagttgcgtatcatttcattatgaagaagagaaaacggaggaacggggagggacccctctcctcaccaagaccccacaggcctaggccttaacaaactcaaaacctgaaaccgacctcatcccggcagagctagcgacctatctatataatgcataaaatgtctaaagcgtttgcatgttgagcatctttctggatgatctgtacatgtaaacaaaaatcgcaaaaacagaaactacatgatctatcgtgaaactaatattatacagagtgcaaacgtacatatctagttatgagatacacactacacatcctcgttattcacatctagatttactaggtggcaaaacatcgcaaataatgagaccatgtacactttcaataagcttagttatgaactaagttactgcctgaaaatgggtgaaatgcagcatcatacataatatgtgctctcaattacctccatcatgttctacagtagtcctactttcagcataatagtaacaaacatataggcgctggacaacacaccatcatcccttttctgccttgctttctatttaacaaatattaatgcattcttgccaggaaatctggttaaaaaggataacatgagacactattggcgttaacctccaagttcacttactcagctagtcagaggaattcttttgctataagcctagcattatatattatagagtattatctaatttggtacagtttgactcattgctgctgcagtaatagaatttgcgcaccaaacaacaaaattaacgtaccttttctatagctatccaagaagggttattccgtttgtgaggttttggagaaacacgcattgagtgaattgcccacaaatcctctggtctctgagacaaagatagattgtgttatgccccaacataacagagaaaagttaaataaaatacttctctaactacaatattcatataaggtacattaccattttttctcttttataatttagatattagttgtttacagtgtgctgcacaatggccaagtgcaaacagatgcgaggagcaaaccaaaacaatcatttaagtgtgaacgtcagcgtgcatacacacggtttgaagttctatatctctgttgaaaaattttatttagggccacaagccatcgtatcaattttcacattagtcacttataaaatgtttctaaggttgctactaggacctggtggttattgtgctcctgttggtatttcttaaatatttcatcactaagattgaatgaggtttccatttcgccaaataatcttcagttctttatgaagattgatgatggtacaaattatttgtcaccattaaggatttaatccattattgcatagtctagtatgggcccatactatttttcatgtcttgttttgaactgagcaattattgttggttctacattttttttttgggcgcaaagttggttctacattttcacattgctgacaacttccatcaagaactaactactaataaagtgaaacaacaaaaagcagatgtaccttaccaagttggcatcaggaagctccctgactgcatcatccacattctctgctgtagctttgacctaattggacaccgtatgaaaatgaattagcatatttcaaatcttaaagcaatgctacaacctacaagtctgctcggcgtttccaagtttcagtatatgtgaatctgaagcaacaataatatacagggaattattatacaatttactggtatactgaagtatgaaactaagccatccaaaaacacaacatgttatggacctgaaccaactaaacagtatccaactgattgagacgtaaccaaatcaaatgctatccaactgattgacccagtctctagattcatctcatcttattcctaaattaaaatattatacaccaatttatatttgagatcattgaaatggaaattaatacagtaaactggcctaccaatttggcactctgtatctcagtattctncgaaaggcggttcctgaggggttcaacatgatcacttccatcaagtngcacaccaatgaagtattgaagctccccctgcactcacagatgtgcaatcactaccatgtagtaatcatacccactactagttaaaaattgcaagctccaaaatacttgggagtagcattnggcacagatttttcagataccttctggtcgcgcatgggttgaaggtggaacaagttccagaacttcttccctgatcacacaacaatccaaaatcagacaaaatcatcagagcttctacatcatccaacagtactactgtatatcatctaaaatctcaatatctatccagttcaagagagggattcgtgtccagagtttggagcattaccgctcttggtgtagttgattagctggaccgtgatctccttctgctccctgatggcctccctgatcttgtccaccgtgccctggtcggtctccggcccttgaaggaatctgccacaatcagcaagaccgcaactataaattcaaatgcggaggagaggaaacaattaaattcaccaagcaacaaggccatgggaacagaagcacaaacgtcgagagttacatagcacgaccgccgaccagccatggcggcgcgtgcgcgcgacgctagtagcccacaccaccatggggggcacggtcgcggagataaccttctccgccgccggcgcgcgcgacgggaggatgcgaggttagccgcggcaaggaggggtggatgcggcggcggatcgcccgtcgggctaggcttacgcaggccgcggacgacggcgacgacggcggcggcggtgggcaaagccgctccgccgttgcgattgggctgggcttgggcttgggcttgggccttgngatatgagcctagtctgacccaagatcagatgtcacgagtaccgtgtttagtaggtcacaagtccaatttctgtcacatgttgcctgcctttgtagtggtgattttaagtgcactgtctaacttcagtcactatactactataaatattttttaaaccctttttgttttttatttaggcgataagtttagaaatgctatagaattttcttaaatttcacaaaagagaaaaataacatttttcacgaaaggtaatatgcttttttttaatcagcacaatctctagggtggaactttctagagtattttttatctagagaattatgctatcgtatttatcagggttatggataccacatacctaatagtagttgattaaatctcggcaggacccaccacataccatgtcttatacggaaataatcttcgaatatagaaggagttccgcataaggaaggatgaatagagttctacatggaaacgacaaggactactcgggttgtatccatattggttttcctagttctacatggacaaggggacacctattggtataaatacaagaccccctaggaagagaggggagacaatcaacatacacggaacaacagaagccacaacatacaagccaacatacgccaagacaaacgccagatatcgacaacagagatatacctggatcgaccctatccggttcctacagaggccgactgtagggatctagcgttgtctctgatctcgccggacacgaactcgaggaggaagactgccttgttgtcgactacgagtcagaccttcagaccgccatatcgacaacagttagataggctaccccaaatattgtattggtgtgattatgatgaataagagcaataccggcttcggccaacaggatgtagggttattacgtgacagcccgaacctgtataaaaatccctgtctccatctcttttacttcagtttcacgtataccctagtaccaacgatccccatactatgcaaataccggaatcgcgacatcaaacatcgacagtactgtaaaagagttttggcaccgcttaaacttttgaattatccataatcctcacgttaagatatctataataaaaaacatatgccatactccctccgtcccctatataaggtattgtgatattttacttatactgtttgaccattcatcttatttaaaaaaaattgaaattattatttattttatttttgacttactttattatccaaagtattttaagcataactttttgtttttatatttgcacaaattttttaaataagacgagtggtcaaacagtgtaagtaaaatgtcaaaatctcttatattaggggacagagaaagtatataacattaagtttatctactcatgcttaaaaaaatgcatatttatgaaaaccaatttacaccatcaaccaaacataggcggacgaacatcaagttttttctttatcctaaccacgacaattaggttgtgtgtgtttggctcaaagggatgggaattatccttcacacacacaatacacaacgactcattatcatatgatttattaaatattaactaaaattttgaaaaataattaatataattttttaaaccacttttctatagatatttttttttaaaaaatatacagtagtttgaggagcatttgcgtgaaaaacgagagaatagagtacaccaaagaaacacaaccttacaaattacataaaccaactcataggcaggcatgtaaatatattataaatatagatatggattctaatccctcgagacaacactttgcctctattcgagaacccaacagaggggagataaagtttcgggtattcgtggcacgcttcttaaactgttaaaatgtgcgattcgtgcgaaaattttctatatgaaagttattctaaaatatcagattaatttattttcctaagtttgtaataattaaaattcaattaactacaagttattatcacctcgttttacgtacaacactagttgattcacttgacaaacaataaaaagatgtgagcaagggggttttgaactcccgacctgcaattccttcccaggatctcttcccgcgtgtactccgtcagctccaggaagctatccgacgcgaagatctgcacaacccccccacaccacacccattctgtcagtcaccaccagcacacgcaaacacgccggcgaccggcgagaagaagagaccggcggcggcgaagtggctgcttacgatggggttgtccgggatcctggggtcggtgatgacgaagttcttctcgatgcgctccagcgtggtggccaggtcgatcccctgccggatgtccttctcccgctccgcccgctcccagctgtccgtcctctccaccacctccggcgccggcggtggcgccggcgccggctcctccaccaccgccggcgcctccctgctccccaccgagctcctcttcccgatcttgaacctgccaaagcatggacagacacaactctcagtgtcactgccgtcccggcaatctgtcgaacaggtggggtgcgagagtctgaccccatgagggaggagcggccggacttgcggccgctggcgagccggctcaggcgggactcctccttcttcaggtcccagagcggcgacttgaaggacccggctcctcctcctccgcccgagggagtgccgggtgccacgaccggcgacatggcggccatcttgtccgcgtcgctcatcttgggcggcgtcagcagcgccgcgtcggccggcgcgcgcgccccgcgcggctgcttcaccgtctgcaccacctccgtcatcgacgacatcgccttgtccttctgcctctctgcgctccacacacgccaatggcggcattggtaagacaagagaattagagaaacatcgaggaaacagaggattccgcggcggcggcggcggtgctcaccgtcgtagcggatgagcgacaccggcaactcgttcggccgcatccgcttgtcgctgagcccctccgtgtacttgctcacctccacctgcatcctgttcgctcatacccgaatcagaatcgcagcccagaactcgaatgcaaagctcatctcatctcatcaatggcgacgaacgactagtgcttcgcttacttacccgatgaacttgatgaccttgccgttgtcgtcgcggatgggggtgacggtgaggaggttccagaacggggcgccgtccttgcggtagttgagcaggcggccgcagaagctgcggccgtgcttgacggcgtcgcggatcttggccacctcggcggcgtcggtgtcggggccctggaagaagcggcagttgcggccgaccacctccctgggggagtagccggtcatggtgaagaacccctcgctggcgtagatgatggggcagtccgggcgcgtcgcgtcggacaccacgaacgtctgctgcaggctcgacagcgcgtccttgagctcctgcgacacccgcggcagggagtcgtgcgacgcgcgcccgacgccgccgtccaccgacgacttgccgctccccgtgccgccgctgtcgcgccccgccgtcgccggcgccaccggacgccacgcctgctgctggtgggcgccgctgcttccgctaggcgcatcctcggcgacgatctccaagccggcggtggcgccgccgccgccggaggtggggaacgccatccacttctccaccgcgtcgactatctccttcgagctgctgctgcccgccatggatgccgatgagattgtcctcggctatttatcagcgaaggtgtagcaatcttggccgtgcaaccatcgattcttgctgcaaacaacaccaaaaaaataataataatcagaaaattcatacattacactcacatccacccaaaaaggaacaaattaatcatcacaaaaccatgcaaccaacccttgctccaacaaatctaggacaccacgagaaaggcaaagatacctaaacagaaggattcttttgcttatctagggagtactataaaaaaaacccatccatttttttcactgttcaagttcagaaatgtaaagaacagcaacctgacagaagaatggtacaccaatcaaaacacccctctctctctctctctctctctctctcttcactgttccattaccctatccacttccttatctgggctactggtctaccacttcttccaactcaacgagaagccacataaaaagggaagtaagacgagagagagacaaattaatcagcaacctctcttcaggcagcgagcgagtgatcgatcgattcagattcaggcagcagacagcagagtactcaggtcactagctaggctgataggcttggatcgataccaatccaatcagtcaggtggcgccggggagacgagggaagaggaagaggaagaggaggaagcaagtaggcgacagaaagaatggcgggcgtagcagcagcggcggcaggtgaggataatgcaatccgcgagcccgtgagcgatcgagcgactcacggtcgtctcgccgggattctgtggccgcggcgcggccacctcgccccccggccggtgacggcatctccgcggccctcccccagaaattattgctcgggtggtggtggtggtggtggtgagaggggtgtgacggcgacgggcggcgacgacgatctttttggggcgggcctgcggccacgcgggtgagcacgacggtagctccgacggattgagatactctacattaaagcccatgtttagttttcacgcaaaaaattttcaccccgtcatatcgaatattttgacacatatatggagtattaaatatagaaaaaaaaactaattacacaaattaggtgtaattcttttaagcctaattacaccttgatttgataatgtggttatgtggtgctacagtaaacatttgctaataacatattaattagatttaataaattcgtctcgcagtttacaggcggaatctgtaatttattttatcattagactacatttaataattcaaatatatatccgtgtatctgatgtgacacgctaaatcttttcacccctaaactaaacaaggcctaaatcagataattttaagtcattaatatgtggagctcatagtaaagaggtcccacatataagtagctcaaagtcatgtagtaactcaatccggctccgactgcctgatcgaggtgggcggtgaagagaggggttaaccgaaatcaacgcggcgcaggtgtgggagaagatgactggagatgacgtagtacgggacgacagagagcaatcggtggtcctccgtaccgtcgctggatgaatgaaagctgcacacgttggtgtagtttttcttcttttctttttttttttatcgcaacttgctggtacaagttcgatctccaggacaaactgtatcatacaaatttcattaccgattggagtcaaaatgtcaaacaaacactcacttgggtctaacgagtgtaaactggaacaagcacaactttagaaaaaaaggccaaccactaacggctagcgcaaattatttttttagcggaaaacaattttcgttggtggtagtgtaaagagacccattagctaaaatatttttgagtaaaataatccactacttccgaggcccgccagatgcctatctgggatgcccaattgaaataacactgtccggcccaattgtgcaactgggatgcccatctttagatgtgggattcgaacttaagatctctcactgcaatcctcacgcacgttaccatcccacctactacacacatctgatttggatatatatgcttcttttttaaactaaccctggaagcatctttagtccgtgttggtaacaccaaacatgactaaaaatatctttagtccgggttggtgttaccatccaggactaaagatcaatgtttagtccgagttggtattactaaccgggactaaagatccctcatctttagtccaggttagtaatagcaaccggaactaaagtgatgatctttaatccaggttgttaacactaatcaggactaaagatcgttaggggcctgacacggtctgatagctattgaactgtggctaaaaatgatctttagttccggttgggggcctgacatggcctgataactattgaaccgtggctaaaaatgatcttcagttaccaaccggggctaaaaaccataaaagtgccgttgggcttttgaaccggggctaaagatattctttagtcccgattcctattcgaaccggggcaaatatgatttttgccatccaagcaaagatcagttctctagtaatgtgtcactgaggccacttgatttggatcgagctgcctcgtcccctacgtcattgccacaatcgagccctaccacagtccccattccgccaccctgccctttgccaccaccggtcgctggccgccaccaccacccttctcatcaaatcgagtgaaggagatcaggtgagggaggtatggattgagaggagaggtgtgagagttgaggattaaaagagggaggggaaaagagacttcatgatttggtttggaagcatctttttatgccttttacgagtttttaggtagtgttccttagaccccacttggaaaaatcgatttttataagtgaggtcttaagagaaccgcacccccaccaataaaaatctattttttctgaaggggctaggatttcagggcctctcgttatttttacaagcatgactttttagtcctccggtgaaaataaaacccaagtgtcctgaaaaatcatcttttagtagtgtaaaacacgtacatagaccgaacttgattacgaacaagctgaggtattacactccccatcctccttgcccccaaccccttcacaggccgatgcccttagtagcatatcactaatcggcatacgactacccaatatctcccatcggtgctacggtactatgtgtgttccctccatgtggccaacacatacacacaccatacccgtgcaacgaagcaactacctaggatatccccttggttctacagtgatgcattgtgtcccctccacaggccaacatgtacgcacacccatgtagcttcagttgaagctctggtaccaactataataccctcgcctccaataatcgtattaggtgagctccacatgttgagtgggctcatattcggaggtactatggttggagtgacatgggtgtataagctagccttaacctatttaaactttcaatgcgagactattctcaccaaacgaacagttgggactaagggcatccacaatgtgacgcaaaagtagtccatagggaatataatatttcattcagccacctattaacattgtgcaactagtccatataaagaaaataacaaaaggtacctatatgcatatggactacccatatggaataaataatattatctatctctatttctctctcatcttctaatgctatcttgtatccacatacattgtggagattgctatattaaagtctatttgtgtgggtcccatctatatggatcactttagctatatacattggtgatgccctaatgggtctaaaattggaactagaatacgcacataggccaaacctgattgtggaagtgctagggtattactgctactttgttgtataatcgtgtacgttggctagaccgttggatgtcttgatatttgttctcgcaatcccaacttatcgtgtgctttattcctatctgcaatttaattagatcacttttatatatcattcttgattgttctttgactgttggcaagtaggcaataataaggttaatttctgtctgcaagattaacaactttatgaatagatatatcgattgctacagtgcaacacaacatcttgtttgcttgttattgaattgttaacattttcttcacaaaattatagttatctctcctcatcagaagatcaagccaccataagttacataactcacctctcttcctcgtctccgatctattgtctttgcccccacctcctaaccacatagacaaatttctcctatgtgagcaacgttgacaaaccaaccttctcttctcccatggctgagccggggccataaccacctcacagtgacctaccgtggtcacctcctattgcagggatttcaagccatacagcttcaccctaccccaaaccctcttcccgcctctgctcttaaccctgctgaactaattcagcatgctttttggagtaagtcattgccaatgtcgcatcaccactagaggaaatcatgcatcgttgctagaagaagccgcaggtgagttctaccatcagtatcccgcttctccctctcccatggctagaggttgaaaatggcaccttgaccgtcagggagcaaagtcgatagcaaaaattgatctaataattaccctttttccttcgaaagagaagttaatgattagtttttaatgaatgaaaagagaagttcatgattagttttgaatgaattgattctagttttgtagataccatattgttgtacacttgaaagatgtggtaccagtcgttgtacatgatggacttgtttttgggagatcttgcgatcagactcttgtatggaccattcgtttagtgtaactaaacgacacataagatagatacagtgggggtacaatgttcaaagaaagccgtgtatcttggagctgtgctcactgtcaagccttaatttgtatactagaaaacagttgtaaatttgagaatatctcctttcagactttgccacagatagagaacttgtcgggggaatgatttcccttgttaatgcatggacagcccaacataatgacctaattagctagagccaaatcgagaatgaacaaatctataatctagagtctagataagcataaaagcatatacatgtggtcctatgaaaaatataaaacatcgcatgctaaaacttgcaatttcgtattgttgtgcaaatcaaattaaatttagatgattgatagaaaaattaggggactggaaagtataaacaaagtgatctcattgcaaactttgaattattttttattacctttattgatggtgagtatggaaaattttttgcaagaattttacttgaaataaattgttttcactacaatttttgtgaaatttctcgcgttttaaaggaatcataattattatattattcctcagggtaattaactttaatgataagtttttatgaaattattgattttaagtctgcatttttttaatcatgtgaaatatggacacctatgattgcaacgatgatatggacatgctttttggcagttttgtcactacagagtctttttgcagaccattcgttaaatactaattattatggcacttagaacagacacaatggagagcactgttcagcgacagcggcttatattggactggagcactactccttgagcattggtctcgtgctagtttgcatgcctcaagaatttgaaaattatctcctttaaatcggttcctgattcccctaaaaaaaaatcgcactacaagaaaaatactctgtatagacatttttctagtactgtagaggcacttatcaaatgcctttacaacaatgtagaggcattttaaaaaatgtctaataagtgtcttatggtgaattgtctctacaaacgaagagacattttataaaatgtctataatatggtagaggcattttttagagacactaaattgtaccgcaaacatataaaaccagtccaaaaaagagaataaaatagtttccttgcttttgataagtcttgaactcatgatcttttggttaaatcattttattcttcgatacactaaccaactcaactccatgtcattacttgtatacttgttcctttaattacttatatttagtcgtttagtacacattatcattctaaaaagtgtctctatatagtttaaaatgtctcaacaaaatgcctttacatattagacgcattttatagtgccgaaagaatgcctctacaagataaaatctaacaaactgatataaaaatgtctctagagtaaaagttttctaggcaatttttaaagtgtctctataaagtgtctctacactataaaacttctgattgtagaagcaatttacaaaatgcctctacaaaagtgcctctatacgaggtttttgttgtagtgtaaaagtgcctctatacgaggtttttgttgtagtgtcggttcctgactgataaattgttggacaatagttttcttggccgacctgttcatgacaaacctgctccaaaaaaaaacattatttcaatgaaaatagaaaaatgtattgggtttcaaaaaatatggcaaaactatatagcgccatgttgtccatttggtattgaaagtccatattttcaagttgaaagtcagacattccgtgttgaaagtcgaactacctgagcatcaattttggtgatttgtgcaagtttatgattttgaagaaattgcaagacaggtttgatcagttgaatatttccatgagtgtatataagaattctcagaagtttcaaaatggtcttgggatgtcctaagcttaccattaattatcgacatcattgaagagataatgcgatgtagaaagatgtctgattcttgaaacagtaggttcttttgtctgaagaccatgacaaactgaattaacacctagaaatccaattactacatcatctagcattggatacgaaggtacgttactcagaagattgagtggatccaccacgatggtaattgatgaaacctacgtagacaatgcttatccaaatgagtgccttccatgaattctgatcctttgcaaaataggtcctccaacggtaaaactagatttggattcttagcaaaaattagttccacatcgttgtagttcgcggcttttgctgtatatatatcgacaaagaaaatcgctataaaattatttttttaacatgatataaatgcatgtgtttatataaacgcgcgcgcactcaccctataaataattagccgtgaatgcgagcacccataccaagtttagaatttgaacctaggtggttaggttctagcacaagaaacctaactaatttagctacgctcatttcacaaatcacgatacactttaagactattattaggcgatattaccaaatacattatatgtagcatgttgacatagtcttcatctgacatggcgcttacgtggaatcacatacagaaaaaaactaaataagacctacatatcattgacaattttttttaaaaaaatctatggcccatatgtcaaccatagtgtgaggcccatatgtcatcttctctctccctcgcttcttcctcctccctatctgtgtcttcctcctattccatcttccccctttcttgcgtttgactggctggctctctcccatccccacttctccacagtaacgaggatgcattggcaacctcgacctcttcgggccatcagtgagctcgggtgctccaaattctgtggctcttggctaagagacagaggcagacgatggaggtagggaggcagtggccaacgaaacctagacgcctctgtcactaacttcttcctttgagctccgtgactcttagcgtatagatcgaggcagacgcagagaaagggaggtagtagccggtgaaccccatcgatccccctctatcgttgaccttcgcctttgcctatactccgtaccgaagcggcatccaccgggggatgacacttcatatgatgcactccccgtcttgacgctcctctggctccccaccgctactctcataggttgtgagccaatgggcaaggagcagcacgacgcgacggccatcggtaggggagatgaaagcagtatgatgcgttgtggtgtggagaagcttacggttgtttggcagcgggggtgcatatctggttagcgtggttaaggtcatgggcaatgtggcggagctccgtcatcggcgtgccctggacctcttcttcccctcccgcggccaagttctctctccctaccaccttgactctgctgtcctaggtgccttcttccagccgctccccaccgtcgctctctccctacagctgcctggctcgactcgtcgctcatcttgagaaaagagcaccggtagagattgacggagcgtggggctcctcaccggaagaccgcgcaggtccccctttgccggttcggccgggggcgctaagtgaggttcttcaccctcgatctgtggaatgttcgcgagagagccaatgcacaagacacgggcgatgtagacaggttcgggccgctgagaagcataataccctactcctgtgttatggtggatctgtgtgtgaaggagttacagagagctggagagcaaaagagttcaggctctagaacccctcttcctctttctctcctctacgagctcaggtattctcagagtcgtccctcctattcttgttctggatctcgatcctcttcttcggtgggcaaggtcctccttttatatctcaaggggataccacatgcaccacttctacctacccttcttttgggtggggatccaccctatcttaaccataacttggctcgcgcctttgcttggaagctaaatcacagcttgtccttgagtgaggcccagcgccgtcactcgcctgacacaggggatcaccctgtcattcctccattaatgggcggagatttgcaatggccgctgtccgaatgaccctccgatgggatgggtcatacctacctccagttcgccggaagcagatgcaacgtgggagcacggtttgtctgctgatgacgtgaccagcgtcagaccagtcacagaccggtcattcttgtccaccacgtgtcagtttagcatgccgcacgtctgtccttcttcatacaatgacttccttgcaatggttgcgatgaagcctggaatgtatctggccgggactggcgtgctaactccaggagttagcacgccggctccggctagggacgagtgcctggaggctctcatcattccgacgggacggggcgaggcgtgtgacaggccgctgctgccacctaacccgcgatccgaccggtctgtgaccggtcacggaccggataagcgagcgcgctgcgctgcattaaatgcggcgtggcgcgctcgtccaacccgtaataaatgcggttaggtgagcgccgctgtgctcacctaacccgcacacgtggcgctaacaccacagggggtcggggcgccccagccctcggggccgaaacgggagcggcccgacccctcggggagacagagggaggggtggccacgtcaccctcgggcccgacccccccccccccgagggggtcaggccacgtgggtgagcgcggctgcccaagcctctagtcacgatactcccggtcccatgtcaccgacagagatgaaaaaaaagaagggtaatgatatcccactgaaatgtgggtccattgtattttttctttttatttttatttttggtgccacgtgtcctacactcaatcggtttgaccagggtcaaacatgccacatcagtgaaaccactataaatactgccgtgggagttattttgcatagtttcagtaataggaggcggttgtggggtaggaatcatatttgacctacagttgggggagttaagttagactttttacaagttaaatcacaagcccatcacaagctcatcatggttcccacgtgataggccttaggtgtagctcggtccggtggtcaagaattggcccattacatatatcccttctccttttattgtttttctttcactaattaaggcggtgaggtcgggctggtttattatgatgcggagagataatgtggtcatggttaattggagtacccccaaagtgaacggagagacgcaacaaaagaaaagggtgttagggtacatcgagatcttccgatttcgatagtaaatttatctttacttctttaggtttgttttgtggacgctccttacctactgaacaccgatgacagttactgtcaatgattttcatttctggtgagagatattcagtcgtgatagttggacttgtagtcgatattttgaatttgttgctgaatactcacatgtgtttttacaggaagcgcggtgaacaagttcaaaattagcttctactacaagggtgcacatgactggaaaagtgttttcattatctgaaacgacgttctctggtttctttgatgtcatctaaatagttataaaaaaataaaaaaaaatcatgtcatctaaatagttattattatcttttaaaatatcaagataaattaatatgagatatatcatttgacttctaaaagttataaaaaaataacaaatatgattaggaatgtctagtttcagtttaatattttctttttaatgcaacttgtagtcgaattttaccttgcattttgtgaagtgatatacctcatattaatataacttgtcaaaaaaaatttcaaaactttttcataactatttatgtggcagataaaaatcaagcagatgtctactcaagatatgaaaatacatcaccatgatgattgggaagatgattcaactatattccatcaatttaactatttctcaatattaggtatcgcaattatccaaatattatttttatatttaccttttttcccttacaaagaggtggttactcaacaatttaccacttttgcccacgtggtataccaccatggcaacccaaggtagaaaatagcgtgggacccataaatggcaacgacgagcacctcgataccaaggtcgtggtccctttgggctcatcacctagtggacggagcaatgatgcgaatggagggcgtcatccgcggcaacgtggacggaggaggcagcggcccgactgttgtggcaggcatgggcgccacggcggttctacttggcctgtgcgaggttggcgtcatggacagagagcgggaggcatcatgcacctctagtagcaccaggaccccacctcgcccgcacacaccaccgtcctcgccacactcctccgcacccacagtctcgatgacttcttcgtgcttcaccgatctcacatcatatcggactccccgatgccgcattcaccacctccacctcatctcgcgttcctggactggcatggcaatgggaggtcttttgtttagttcgatggtgtaatagcgctggcaacaacgtggtagcatggcttctatggtatcatggtggcacgacgctttgtgtgagtggtgcaccatgcaatgaggggttcgactagggaggcttggatggcctcagagagttggagctgaaaggcgagccgacgataaaggagatgactgaggaggatggtagggctagaactttatgcaaaagttgacagtcaaatttggtacttaaggattgtcaacaagatcatatcattttaaatgtatatacttccacatatgtattgtatgcaatattgttttaaattattgactgcacacattcattctagtaaaaataggacagttaggtatcaacaaaatgtgctacaacttgcaaaatgatgtgaataaaaattttcacctacactctttgtctaaaaaacctaatcctatctatattcaaaccaaggattgaattctctttggatagaggaaatatatttatagtattttatagtactttaaaaatagagtagcggtggactggtgacggtggttctacgtaccgccccactaccaactgcctacttctttttgaaaaaaaatgaataggtagggctatagggcccatatatcaactatcccacagactatctaccttttataagaacaaaaaaaagataatgtaggccaaattgtctacatatcagtaataaatatatataaaatgattaggagataatatataaagaaaatgatgataataacgcatttgataattttctttagttaaaatcttgttgcaacgcacggacaatatgctcgtatttgtagaaatcttgtgaaccctattgaaaggaagacagccagacagggccgtgctattgcagggttccaaaacctcgtacaatacaaacaatcagcactcagttgcaactttttatatgaattgtgttagtgaaggccaatactgggattgccctttcacacaaagtagttcagagatcgatgaatcgactattctaatttaacatgaaccaacttgcaactgagctcatgcatcaacatttacattttgtcttgcaactaattaaatttaactaatcaagccatcgactcgcgcacacgagcccatctcacgcgcgcacagatttgctgccgccagtttcttccccctcgtcgccgtcattgccgcctcgtggcgcacggttccgccttcgccatcaccagagagaaactcggtgatagctgcgggagaaagaggaagaagaggagaggagcgaggaagaaggggagaggagcgaagaagaagcaacgactgacatgtgagacctcagtgtcatagagttaaaatagggtgggtagatggtgaggctgttggagcgagtaactagtttgactagccaaatcagatggaaagttagctatgtgggtgtttggagagtccgatttagatatgctgttgaagatgctcttaatctttgtcaattgggtcaattaacatgcatgccagaaagaaattaaacctaaggtttttttttgttttattcgtcctaatgagccgacctaaaacttttttaccaaaatgaggaggtgaagtactaaccacattggggagaacaaacttttcgtaaagggcaaagaaaaataatgattcgtgaataatcccaggtcatatgagatctctctttttttccactcatctcctaaaagacaccgtgcaatcgtgcatgctacgaaaaagatctaaaagctagataacactttgctgcatgtataatccactatatagcaagaaataattgatgtgtggctctctgctctcttggaacaaaagacgaactcactaacaccataacattggcacaaaaagatactatactacctccatttgaggttataagatttttttaacattgtccatattcatatagatattaataaatctagacacacatatatgtctagattcattaacatatatatgaatgtgggcagtgctagaaagtcttataatataaaatggatgaaatggaggaagtatatatatattaatcgatcttgaaacttttgttttgcgaatctatagtgcaactacatctggaaatcttcaatggattcctgagctagaaggatttaataattacacaccaagcaccacttggattattgattgaattagcttttgaataatatgccttttcttcgattttgatgcaagagcaatacgaggttgatctgacacattgtccatgaaagcacaccatacaccaaataaaagatagagtaaatttaataaatcctaagttttgaggcatcggtaaagtaaaatcaaaatctgaggtattaccatttgtttcataaaactctaggttttggagtaaaatgtttaaaaaaagcatttgtttcatgaaactctagattttggagtaaaatattttaaaaaagcatttgtttcatgatcgaaactctaggttttggagagtaatatgtttcaaaaaaccataggtacaaacttatattgttccttcggctaatatatttatccatagtaactgtaaaaaaaaaggcatgagatatttttcagcacatatgcacattacttgtattttcaataaatgttggttgtcgacagttcgatcatttctatgtatattaacccgttaatgtgtcattattagtggggtattgtattgaatatatttgcaatagggaaatgaggatgtgaagaaaaaagtaaagtagatgagagcgatgtgtatttagtatactatgagagcgatgtgtatttagtctactatgtgtatttagtctctcgcaccgccgcccgtgagagaaagaggggaagagagagcaaagggcgccgccgtctccatcatccccacctccaccaccgccgcccaccgaccatccgcccccgcgcatcgccgctacacgccagccgcgcgggccgccgctcgcagcacacgcctccgcgtccgcccccgcgcacccgcgccgccagtccgcccccgcgcaccgccgctagccgccagccgcgcccgccgccgccgcctcggcgctgaggccggcgcctccagccgctgcccgtgatagaaagaggaagagtgagaagagtgaggagagtgagagagagaagagagagagaagagcgtatgacatgtaggccccacattttttatatagaatgctgactggactgccacgcgtacgccacgtagaccaaaaccaccgtggattgggtcgaggggggtaattcgtccagtttgtatagttcggggtgaaaaatgtccggttttgtggtttaggggggtaattcagatgaccgcgatagttcgggggttaattcgtactttttcccatatataatgatgaaatacatgcattttacataaatatggagtttctttaaacgttttacccccaaacatagggttacatgaaaaaaaatggcaattcacagggattacaatacggataccctaattaaaactgggattttataaaatttactcataaaagtaaaaataagcttgtacatgtgcgccctttttagtgtgggaatgctgcgtttaggccttgttcggtttggagggcattgaagatgattgaaggagattgaaggggaataattctacaccataatagttgtgaataaatctcctccattccctctctcattgggattaaacgaatgatgccttaattgggcacacacaccatcatacgcagcatagcaaacatatacacatatagatgttctcgatgtaaccacgcttacaaaggcctggtttagttcaccaaaaaatttccaaaaaacatcccattgaatctttatatacatgcatagagcattaaatatagatgtaaaaaaactaattgcatagttaggggggaaatcacgagatgaatattttgagtctaattagtccatgattagccataagtgctacagtaacccacatgtactaatgacggattaactaggctcaaaagattcgtctcgcggtttctagacgagttatgaatttagttttttcattcatgtccgaaaacccttccgacatccggtcaaacatccgatgtgataccaaaaaatttcttttcgcgaactaaacatgcccaaattatcaaaggaaccaaagatcctcctagatcaggcgtgtgtcagacgtgcccatgcactaaatgacatacaacatacatgtatatatgtgtactcttaactttgaaattattatatatgtaaacatgagatagagtgtcaagtttaggacaatctatataaatactatagagaagggaagtactgcaactagctagtgatcatagaaagccgtcatggttgatctcatcacatggagtagcacatgcttatacaggttgtagcatctgcgccgagatgtgtatcatgtgagcttaattagctcttgaggctttgcaaaatcaagtatataaaacccatttttttaagtgacagtgcaaaagcaccacatgcatcgatcatatacacacaccagtttaattatcttggtctaggcaatgcatgtgtgagcttgataagatgttgggcgtatatatgtacagatatgatatcctggaatttagaaaaacaatggatgggaaaagagaagataaatggtgttgccggctaagcggctaattaagccacaatatgtacctagcctagagaaggaatggagaattatcagcaagaacatatacatagtgtgtcaacacaaaggagggagaagatatatatatgtgctgtaatgaaaatagatgcacaacggagacacgaattttacgtaaaaacccttgcgggaaaaaaaccacgggcaccaaccgacaatgatcagtatagaggagttggatacaaacgcaggggatacattgggctatcgcaccctactcatgcgactttcaagggatatataaaggagaaatatatgagtcctaatgggaaaatacttaagagtcatattaggaaactaatcctaatagtcaagttctattatgaaacttatccgaatatattgcaggccaaaaattcgaatcacatatttaacatgcacacatgtgtacatatatacagtatctgcagtttaatttgtgtatagagctgtaaacatacatgtggcgattgttttttccctaaaaacagaaaagaaaggaacaatacatcaacattaataaatgcatgtaactttaatgtatattcaacaaagattatgtaaattatatctcttaaaacaatatatagtggcaaacaaaacaatagctacacagaagttatgtttggcaagcaactagaaatgtttagcttgagaaaccaacatggtaaaccttacattcgaaaaatttatttatatgactaatcgcctttcataaagattcatatatcatataacacaatatccctgcacacgcatggttcctaataaagtgtaataccccttgaaatatagaatggattcaaatcacatgcatatatactatgctagctctgttctcaaaaggatggcgtcctgaaatgctgtgtcagtccatcatttcgtctacaactaattataagccataatgctcattagcaacaaaaaaaattatagtaaaacttttacatatgtgttcttgacgacttaaaagtcaatattgaaaataaactgtgttgaataaacattaaaatcaattctaaaattaagttttaaaatatttaaattttggttgcagcaaagctgaagagcaaaccatggagctaacaaacacatgtataattgactggttgccaatttacattttccgcctcctaataagctagcatttaatattgtagcacccacagatagtcatccggaaagcagtaaaccagaaaccagacacattttgtgggatggtggcaaaatgtgtataaaaccaacgggaagcacatagctagcacacgaatttaggtacctataacctgccctcctcatatcatgtcatatgcgagataccaccaaatagaaaaataaaatgtgtatttacatttctcgcttactaagctagcatattattaagagaaaattgtgtgcccctgagtttttactcatccctttcatgccctttagtttttgttttcaatcacctttatagccattccttagactacatataacagtcaacttaaaaagcctaagtcttgtgttgaaagcaatttcaactcaaaaattaacatcgaaagggatagaattatttgacacccaaattaatttgaaaacaaaaattcaaattttgaaattaattctagttatgtttgatgaagttttcaatgataatttcacttgtatctcttcatagaaatttgttcaaatttgtttgaagttgattttaaattaaaatacaaattttagtttaagatagaaacagtgatgatatgtgtcattttcccttttgtaatttcatcaaattttattgcaattcatttaaaaaatttaaattttattgttcaaattcggggtcactcaactttctccctttaagttttataactaaagattttcttctagatatattatgttcttatctatgagtgagagacaatataatcattagaaaagctcaattgagatgaactaacaaaatgagtatatacagaaaagctcaaaagaaaacttagggctatgtaagggataagacaaaactcaaaagcatggaagagatagagcgagaactgcaaaggaaagacaaagatttttctctatttaataatagagcgcacacagtttatcattcggaaagcagtaaaccggaaaccagccacactttgcgggatggtggcgaaacgtgtcctaaaccaataggagggacatcaccagcacacaaattaaggtatctataacctgccctcctcgtaccatatcatatgcgagataccgccaaatagctttagataatagaatagcttaataaaacaatgtacttgttgcagaagtcgaggaaaataatactgttggttctcacattatagtaatgctctctctacttaatttatcaagtgtgctgtcagggatgacaacaccatggcaccatcagtcatcaggacagcccaccacctttgcaaatagagagaaaacggtacaatgacaggtataaacaaagaacggatagcttgccgatgttaccatttagacttctggccaactaaattatacttcactaattaagctctaataagaagccctggctgcttaaaccagcagcagctaccttagacatctattttggagcaatagatccgccatacatatattaattatctactcgatctctccattagtctccagctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaaggttggtgattatcatcgtcgatccccttctatagttctatatgtatatagctgctacctgctaggtcatgaaatatatcccaatccttcagatttttgtctatatatctcgatgtgtccagctatctagcttttgctttactctagcttagggttttctttgattctttggatgatcttaaggtgaaagacttctgttttttttagaaaaaaataaagaaaatcgatgcatccatttagatcactccttctcccatctaaataatctctatacactattaatttgatgaattgtgtatgcatatattgactctttctgtttagtctggagcattattcctgaaagagaaggagatgcgcagtaggagctggtatgcaaggggctgccagaatgtgagaatatatttctagaaatggtgtatacgatttttctaagttaaataactcacaagttatctctagatatatatttattttgatttgtatattaatttacctcgtttcttagctgaaaatttaggttaatttcccctagatgcataaaacatttgctatatattggatcgtaatggtatagtcttcctttttgttagcatgaaatcaataatagagcggtaccaggaggcaggagaggagcattgtcggttgctgaacccaatgtcagaggctaaggtatgcattctaatataatggtagcaaatttgaggtaaattaaaaattcatttcttgaggtcatctggttttgcatacagctacaaaagttgttgactaaattgccgcactttgtcgtcataaactccattttcccaattcttaactaaaattcctatatattccaatgtcattatttgcaattatcctgacatttctacttatgtattggcagttttggcagcgggaggttacaactttgaggcagcaagtgcaaaacttacaccacaacaacaggtaaaatcaagtccaatgtcaatgatatattacacatacaaccatagctaattacacacctcttctcaagttttttttttacccaaatcttagcataaccagatgaactcaagaaatgaagtcccccgcctgggaaaatgctttctctagtagtgatgttgacctcactttctctctaaattagtttttacttgtctgcaaactatttaaacgaaaacagtgcatactactttattaggatcaaccaatatgaaggtgaaaatgaaatcttttttaaggcccatgtggaaattcatgtttcaaataaaaggtgaaaataccttttaatgcatgattaattctacgtgctatcaattctagtcacattcttatatgacgtacactgataggcaacttttgggagaggaaatctccaacttcacagttagagatctgcagcttctccagaaccaagttgagatgagcctacattccataagaaataaaaaggtataatattgataatacccttttctcgactaataaataaataatcttttcctaattaaatggcgatatatctattgtctctttactaggatcaacttttggcagaggagattctaaaactcaatgaaaaggttgtacttgcatcttcttcttcttgatgaaatagctcatgatttaattggtatcagttcttacatctatacactgttcatgattgaggtaaaattacacgaatatatatcgctctatacttttaattgtaggggtctcttgttcaaaaggagaacagtgaacttcgcaagaagttcaacattgctcatcaacgcaacatagaattacacaagaaggtaaagtttctattcgatctactcgaaacatacaaaaatgtcgtagaatattattgatatataaatatacaatttacatcatcttgattaattaatttcagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaataacacatgatcaagtgttaaaaacagtgagttttcaaatctttaattacgtaaaccgtaaaacctcgctcttgtaactaatatatatttcttcaatgtttaatcaaagttgtcagagttccttaccttttgctagtatcacaaaacaagtagctatttgtttgtgatactagctagtaatttgtgttaagctagctagtaacttgtgttaaactagctatataaattaagtcacaaaatacccataaattaagctagctagcccttcaaattttgttgtttttctctgattagttaatactatggtttctagctagctagctagctagcccttcaaattaagcactgtacagaacttgttaattttctactcatctttactagtataaattatgccactaattaagttcctagagttacttttcatgttcagaagttgcatgcatgcatggcaagttactttaattactgtgctcttgtttaaagaaaagtgttaactttattctaaaaaaaaagtgttaactttacagttacacagatatgtccctcattagaaggtgtaataaatctgtttgtttgcagacatgatggcagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatccatattatattgcaactcttacgtgtcatatatgtcatgttatatttaaacattatgtgcaaagagatcaccctcaataatgttctatggtatgtacatatatattcatatatgtatataaacaagatgatatccactccacacctccctccccctccctcacggccgctacagcatggtgtcgtaaactgtgtggctgcaaagatagctgtgacgaggccttcccttccttcccacatgctcccagaggcatatttcaaggcaatgaaggttgcgactacactgaggtggccagatgggcagagccacagaggtccgtacatttcatcaagcaaaagccagtttcatttaaaaaatccgtttgaagagaagagaggtgaagaaaagcgcatttataaagtggtgtggcaagaacttcggaggtaattaccattaaagtggagtcgcatgagataccaatgcctactggagatgaaactaaggtggccaaggcgagaagaccgcagttggagccaacgcagctcaccacgctggtttgaccgagccctccaggagtcgtgtcacctcaaggggccagtctgactgtgcagagaggtcggtttgaccagggtcatccagggagctcgagggcatcatcttcgtcggtcaaaattgctagaggtcactatattgcccccggaatagagccaaagctaagtggatgcccgcggacttgaccactactcaaagaggaggttgcaacatcttcgtgcttaagaattgaagaaaaaatagctgaaaagttgagaaacaagattcaataagttgtggttgtaaaatcaaggagttagagagacttgagttgagagaaagttagggtttcgagtttagtttgagattttggtgaggagtgctattggtgcactttgtaaacactagttgatgcaataaagtcgagaattctaatctacatcttcgagtttgtcatctaccggtgcttctgggttctgacagtctaaccgcaggtgtgcacctggtttgaccagtgggatagcggcggtctgaccggcgaggttttggcggtctgtccggcggtgaacatgcggttcgaccgactgtgacagggcttcgtcatctactccgttcgaggtaaatcttttatttcgcaaaagattttgggtttttggtttttcctaccattcacccccctctggtaggtttgtttggtcttgtgcgatcctacagtggccgcctccaagacaatagtagaggcctaagccaatggagattgagaaaccgatgatagatcaagacgatggtgaggacaaaaatggaggtgggttactggttattagcaatgattcgctgccaagacagaacatggatgtcaacatggtgtttgcattgccgatggaattttgtgtcatggatgaggctgaaatttctcaagatgtggtttttgagaagtctaatgagtctaaccatcatatgaggccactcatctcaaagggcacattgattggaaaatgatctctagaatgttggtggttggaggtgtcgtcgtaaatttgatgccacactccttattcaagaagttagggtgtgaagttgtggtgaattgaataataccaacatgatgctcaacggcttcaatggtgaaccaacgaaggcgagaacgatctttttttgtgaagcttaccgtgggaaacaatatgttgccaaccaatttcatcgtcgatgtgcaagataactatagcgttattggattcataccaattgttgtgttccttctaccttgcaccagtgcttgatttaatgggacaccgatgagattgagatcgttcaagcagatacatcggccgaggttgcaatagttgacgcgtcaattgagtggtatgggattattcaatgcttattagggttagatatttctaactataattttattagtgtttctaaagatcgttttgtacccattatttggagtggttgcaaaagagagtgcaataacatcagtctacaaagaatgacattggttttgcatcggctgatccactataagagggagacatacataatggatctattgcatggaaaacatatgaaagttgattactaggttaaagaatatgttgatttttttgaatgggaatatcatgaaatgtcgggagttagccgtgagcttgttgagcatcagcttccaataaaattggatttagaccttataagcaattgcctcatcactttaattcaaacatatatgatcgtgtcaaggaggagatagaccgattattgaaggtggaggccatgtaggtattcggagtgagtgtccaatattgtccccgttgagaagaaagggagtggtaagattagagtatgtgttgattttagagatttaaatagagctactcctaaagatgaatatactagacctattgccgacatgttgattaatgatgctttgggacatagagtcatttgctttttggatggtaatacttgttacaataaaatctttatggccgaagaggacatgttcaaaacggcctttaggtgtcccggttttgttggcttgtttaagtgggttgtcatgacgtttggtttgaaaaaggccggtgcaacataacaaagtgcaatgaacttgatcttttgtgatttgctaagtataatattagaaatttatgttgatgatattgttgtcaaatcggatggtatggatggtcatatagcctgtttgcgtttagcttttgggaggatgcgtcggtatggtttgaagatgaatccactctagtgtgctaatggtatgtcatcgaggaagttattaggcttcgttgtgcatgagagaggtgttgaaattgatcctaggaagatagaaaatattagatagtttaaagcgtcagcatgcaagaaaaaagttcaaagattgctaggtcaggtgaattatttgaggaggttataatcgatacttttgttcccatatttcgttgggaaaaagaagccgattttacatgtgaagcaaacaacaagaggcgtatgaggaaattaaaaagtatttatcacctccacccatggtgcttgcgcctaaagttggaactctgtttcggctctacattgccaactgaggacaatgtcattggtgttgtgttaacacaagaagtggattgcaaggagcatatcatcacataggtgggctgtcatcttttggatgccaaaacaacgtatgtctttatagctttgcttatgtttatattatgattgtaccaaattacagcattatctattatctagtacttgcacttgtcaaactgatattattatatacatgttgcaaaggcaaattctaagtgggagaattcacaggcaaatactttgattgaatatgatttggcttatgaatcgttcaagtctttgaaaggctaaatcatagttaattttataataaatcatcttgtggatattacttatgatagtgaggtctatttacgtagtgttacaccatggaaaccttattttgaaggtacttcttgcgaagaggggtagggtatatgtgcagttttgttttcacacaatagagctatttttgaaacatcggtttacttagagttttcttgcacaaataatcaagtatatgatgctttgttattcggcttacaagtattggaagctataggagcaaaacatgtataagtttttggtggctcggaattgatagtgcaacaagttgccggggtgcataagtgttttgatgggtcattaaatagatatttagatcaatgcttagacacattatcaccaatttttatgattttgttattagaacatgttgctagagaaactttaaggcaaatgatttggctcaacaagcatctggttatcatgttaaaaaaaaggagtattcttcatttagaaaaaaacggtgcttcaattcaagagtttggacaaaattggcgatgggccgtctgacagacgcaccggggccaatctgaccagggaggaccggtggtctgaccagcctggcatagccggtctaaccagagaccttacctgacctgatcgacctattatggctagtctaaccagattccaacaatcagctaggtggcacgagttcatgaacaagttggaggccgaattaattgtaaattcggacgtttgtccctaggaattagaaaatgattggagtgtccctttgatagattatttgaaatatccaatttttagggttgatcggaaaatttggtgtcaagcttttaagtatactttgtttgatgatgagttatatcgccgaaatatagatggggtgttattgaagtgcttagatagtgatcaatgcaaggttgctatgagagaagttgatgaagggatttgtggaactcttcaatcagcccacaaaatgaattggctacttaggagggttgggttctattggccgaagatgttgatgatagtttcaagtactatagagggtttgaaccttatcaatggttcgacaatgttcaattggcgcccaccgccttgttgaaaccaattatcaaaccatagtcgttctgaggttggcgtttggatttcattggtcaaatttaccctttatagtgaaaagaacatcggttcatgctagttgcaacggattatttcaccaactaagctgaagttgtaccgctcaataatataactcacacagagctagttttctttattttcaagcatattatttatagattcggtatacctcaaattttcactacggatcaaggagcttcttttatgtctaagaaagtaaaataactttgccgaatcttagtattaaattgttaaattcttctccttacactacgctcaggctaattgacaagtcgagtcgagtaataagggttttcttgaaattagttaagaaaaagattggggaacatccaaagagatggcattaagtgttctttgaagcattatgggctaatagaatatctaggtaaggtgctaacatgttaacaccttttgagttagtctatggacaagaagttgtttgacttggctctcttagatatatcaagtaagatgatttatcggtgacggagcgtggggctcctcaccgggagaccgcgcaggcccccctttgccggttcggccgggggcactaagtgaggttcttcgccctcgatctgaggaatgtcagcgagagaggaagtgcacaagacacgggcgacgtagacaggttcgggccgctgagaagcgtaacaccctactcctgtgttctggtggatctgtgcatgaaggaatacagagagccggagagcgagagagagagagttcaggctctagaacccattccccagagtcccaaccctccttcctcttttctttcctccctttttttctccctccttctctttttttctccctctttctctttttttctcctaggcctgggcctcctttttatctggtcaggggtcactacatgggcctctagctgcctaagaagggaaacatgctttttacaatgagggctagtctacagccggaagtgacctctgacaagcagagcacacgcctcctgccccgctcgcctgctttcccggtggacgcccatttcaaccttcatttaatggccagcgacttccttgccatacctgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacctgcgatctgaccggtctgtgaccggtcacacaccgcgactggtcacggaccggataagcgtgcgcggcgccgcattaaatgcggcgtggcgcgctcgtcaacctgctataaatgcggttaggtgagccccgctgtgctcacctaacccacacacgtggtgccaaaaccacagggggtcggggcgccccagccctcggggccgaaacgggagcggtccgacccctcggggagacagagggaggggtggccacgtcatcctcgggcccgacccccccccccgagggggtcaggccacgtgggtgaccacggctacccaagcctctagtcacgatacccccggccccatgtcaccgacaatcggtcaaggagtataagacattaatggaagataatctggataatgtgttcgataaacgtttgaaacacctttagaagagatagaaaaggataaaaagagagtagcaaaaacctataataagagagtgagcaaaatcgtttcaagtgggagtttagtatgtaaaacaattttcccattagaatctagatctaaggagttcggtaagtggtcacctagttggaagggtccttatcggatattttgaatcattcgagggaatgcatattttattgaaactttacgaggagaacggtttcaaagagtgatcaatgggaaatatttgaagaaatttttcctgagtatctggtaagatgcttaggaggtaataaggccagtaattagattatcaccctaagatcacgtgttctatgtttttcggctcacaattcgacaaaaggcagggtggcatgtcttaccgcccaaatttggcacctagaaaagaaatatggaaaatatggctgaatttggaacatatcgggtctcttccgtgatgacggtctgaccgccaccataaggccggtctgaccgacggcatggggctggtctaaccggcaacatgtggccggtcagactggccgagtctgacttcgagtctaattttatcgagtctcgggtttccccaattttattgggtctcgggtttccttgtaattggtctctacccccgagtaagacatggagaaggccctgtacgagataagaccaacccatttataaaggctatgattggtgcaattgagcacacaatctacttccaacacttttagccaattgaattgctttttcaatatggcatttactttttgcctagtttctagtctagttcatccatctttgttgatttgtatagtaaatcgtctgcctttgttgtaggagtgtgaatcatctttataggtttgtcccaataaccttccattccacccacgagataggtgtttatctctattttatctaaatgagctccgctagccggttttgatttacaaaactcatcttaatttggatttgttcagatcaaggtggttggcgactcccaaattacagcaaagcattggttgtccggtcatgattggcgatgtgatcaaaaaagtttccaataagaccatactcgtctgaacatgcccattaaaactatgacaaaaagtaagatacatatagggtggagctgatgtgaataggcgcctgatcttctcacatagatactattggtttgatttatctacgtgaagacgtgtcatgagttcttcccattgattgtttttcttctgttgttcatcgagtgatacaattaaattaagcacatttgggatgaaattacatggagaggtctagtgcgtactatataactagctaggaccccatgcattgccgcaggcatatgatgaaattagaagttatttcaatcttttgccaatcaatgaaatattctttatacatgtatcgattgttacacgggtttatatatacatgacctctaatcgtttacttatctacctaaagtgggcataactcaatcatcataacataatggaggcattgaatttgtgagagaaccatttcctccattagctaattaaagaggctaacagagcatgcatactcaattcacttcaaatccactgaaagatgtacttgcagaatatggatgaacaaattccttatacttggtagcaccaatagaaaaatctcttcatagaagcggcagcaccagcttaatgaaatacgtatttatcctactcactaattggtgagctgaaataatagacctggaggctatcaaaatataatatacccaagcaagtacattggtgtaaaatcaaaggtgtttttgattattattctgtgatgaacaattggcattggagattattggttttgatatttggaatttatttgcgaagtgattttggagatgatcgggattttacaggcgatctacaggtactgctgattgggtccggtcagaccgggcacgggttgccggtcagaccggcagtgatggagcggtcagaccagcgcagcccgcggtctgaacggccgactctgtgtcgtttttgattttgggttgtttgtttggatatccgtgattgtttcatgattaaggattctagatggatactatgcgtatgtaatactgtcgtttgctactaatgagtcaagttggggatagcttggtcttggaatatggtttctttgtttgttctatgtgtaggtgactcgagatgccgaagagtatttgaggtgatggaccgggagtcggcttggggataagcgacgtacgtggtggtcagagatcatgcgggatactaaggctagagttcaatgcacgtggttggtgaagattccatatgtcatacgatggaggtattgtgtgcgtatgggatgcgcagtcgaatttggaaggagtccaaatttggtatgattggttatgtaaagtttgtttcttgtactagagggtttcctagggtgattagaacttctagtatgagtttggttcatggcttttggctgcctacctcgggtataaatagagggggagcgtgaggcttcccagtatcgctttcgagagcaaatgagttgatagttgagttagggcttcgagtttagtcgagattttttgtaaggagtgctgttggtgcactttgtgaacacatagagaattaataaagtcgtcatctattttaagagttcttcgatttgtgtttcatcgggtttcggcggtctaaccggcatcacactggcggtcagatcggcggcaagcaacggtcagaccggcggtggcagcaggcgacgggagctgatccaggcggtcagacaggagttactacctcggtcagaccggaggtatttaggcggtcagaccagcgcatctacttcggtcagaccgcaatccatcgaatttgagggtaacatttatttccgctaaaagttttcggtttttgggtataccaaccattcacccccctctggttggcttagttattgtgattcgatcctataagtggtatcagagctttgttttcttctttggattttaaccggtctagagtttttgccatggctgctaggttttcaactaagcctcatgttttcgatggaactgatttttctcatggtgtagtaggatgcaatcttacattatgactgaggattatgatattcggagaaaagtcaaatccttatgtgattcctgaacaaattaatactgctcctttaaaaactgaatttgaacaaaattacaaagctcgcaatattcttttgagtgggatttctcgttcggattatgaccgtgtttctcatcttcaaactgcccataagatttggattgctttgagtaattttcattaaggaactaataacattaaagaacttcgtcgagatcttttcaaaaaggagtacattaaatttgagatgaaatctggagaagctttggatgactatctttctaggtttaacaaaattttgagtgatcttagatctgttgattcttcttatgatgttaattatacacaatctgagatttctcgccactttttgaatggttttgacatgtctatttgggagatgaaagttacatctattcaggaatccgttgatatgtctactttgactttggattcgctttacacaaaactgaaaacacatgagatgagcattctttctcgtaaagttgattttaagtcgagtgctttggtttcttcctcaacttctttggatgttgattattcttcatcgaagtttccgcaattgctttgtgtaatgccatgtccgatgatcaactctatcaattcgaggaggaggacctggttttgttatctaacagactttctcaagctgtgactaatgttaggtacaggaaaagaggtggtccaaatctttgctttgaatgtggtggtacggatcgtttggttgggttgtcctaagcttgggagagcaaggagggccagataatggtgatgagaagaccaatgataacaacccgaagggtccagtcaaagggaggaagatcaaggagcct

SEQ ID NO: 15375 - DNA, 2601 bp, Oryza sativa
gtcatgttgagtacatgaaagatgttgtgaaagccaatgaagtgctttcttgccccaaatgtcgtaaaagcaaaggtgtcatggtagattgtgaaaattgtgctaatttggaaaaagaaatttcttatttgaaaaattctttgcaaagattttctgatggtaaaaagaacctcaacatgattttagatcaatttaaggtttgcacacataaccgtggtttagattttaatccttatgctcatcatactagacatcctcctgttgtgttaggtgttggtgctagaagtggtgaaattttggttaaacctgaagataagaacattgtgtttaaatctgctggcatcatctctaccttgagtgcatcatcttcaaaatccaatgttgtgcatgtaaaaccttcatttgttgcttgtgttgctaagccatctgagtctaccaatgtttctaatgatcgtgaaaagtatacttgcttgttttgtgggaaagatggggcatattgttggtttttgtttcagattggctcataaacagaaaaaagagagagagattgcttttgcaaaatcaaagtggcaaaaatctggttgtccctcaaggaagccggtcagaccgctgtgggtcccatggtcagaccggcgaccggtcagaccaactactgagcggtggtcagaccgggcaccggtcagaccggcggtatagcagcggtcagaccagcagtaccacctcggtcagaccggactcggagaaaattttctgaaaattctcaacctatttttgcacgtggatatatgcctattggatcttctggtcatgtgtctcaatattggattcctaaatttttattatcatctaaccccagtactgaggcttcgacttctgctggtgtgtatcctttggtggcaaggaaggagaacgtgtggatcgtgaattctggttgttcgcggcacatgattggtgataaaaattggttctcctccgtcaaaaaggcatccaagactgaatcgattatctttggtgatgcttctactagtgccgttctcgctacaggtttggtaaaggtaaatgagaaatttgaattgaagaacgtagctttagttgaggacttaaagtataatttactttcagtttcataaattgttgatgaagattttgaggttcactttaggaaaactggaagcaaagtttttgattcttgtggtgattctgtgttgaatatttctcgctatggaagagtgtttaaagctgattttgataatcctatttcacctgtgataacatgtttggttgctaagtttgataaagatgtgatgttttggcattgtagacttggacatgttggttttgatcatctcactaggttaagtggtttggatcttgttcgtggtttgcctaaacttaagaaagatcttgatttggtttgtacactgtgtcgtcatgctaagatggttgcttcttcacatgctcctgttgttttttgtgatgacggatgcacagggacagctattacatatggacactgttggtctagctagagtgcaatctgttggaggaaagtggtatgtgttggttattgttgacaatttttctcgatattcttgggttttctttatggcaactaaggacgaaacttttcaaatactttcgtgatttgtttcttcgattggatcttgaatttcctgggtctttgaaaagaattcgaagtgataatggtggtgaatttaaatatgcttcatttgaacaattttgcaacgaaagaggttaattaactaatttggcaataaaacagcaaaagttaaacaataggagcaataatgaacaaagacctgcacaacagcaatagttgtcacatggtatgcaccgtgcacagcaaaatagggggaattgcaggggacaaaggagagaaaaacctaacaagagatgaaagaaaacttcttggacaacaaatattagctcgtcaatctagcagcaattatgttccaactcgtcatcccttcaatgagaatgaatcttataaaaatagctccctccatatccctatcgatcccttaaatcatcatatggctctattggacaacaaaagcatatagcagagtatatcaacgaaacagagcagaacacaagggatgaggaggcaagaagtataataatagaaagaatatatgcagagagaagtaaagagcaattactattgtcctcgtcagatggaggaagcagtacacggtggtggtgctgacaaccctagcaaagttaacccgttcaccctcaccgccaatagccagacaggagcgaccaatcgctgccaggagaacctcgcagcgaagatagaactccatggcaccagattaagtctcaactttgatctctagtagcacgccactatatcaaagagttgcgcaccggatcggccacctcgccatcggccggttcaccaaatcaagcacacttcactggatcgaccccctcgctgtcgtgctagagcaactcgaaaggcaggaggcggtgacgtatgtgtaacaagagggagattgagaggagaggaggatgggaagaaagatggcggccgtcgtaaggcgctgtggaaaggcaggactcttgatttctctc

SEQ ID NO: 15376 - DNA, 7877 bp, Oryza sativa
cgatatactgaagtagagggagtaatcttacttcgttttcagttactttttttcttgtgacgtcgaccggagtatggaaactatatatatggacaacaaaaacgaaggttcagaaaattattatacctcccaggtgctgacagacaccacatttcttgcaagggtcgaactaaccatacaaagcaataatcgtgctagaaatgttctttccgatcgaccagacgagcaagcttagaattgatcatgcataactttattccgtatggaacaataatgttccaggcgtccacacaatacttcagctggttccgaacccaacatctaaattaaccgtgcagtaataagcagcagttaactggaaataatttattcgtgtaacatgtaacagcactgtactggtaacatgtagagtaccttggtgcttaatttattcgtgtgctggccgatttcacacgttaattgcgtggcatcgcgcggagcagcatggtttccacggtgagtccagggccgaaggccatgagcatcccccactcaaggccttcccccgccgtcgccatccctcgctcctccgacctccttcgcatctcctccatcgccaagaagatggtggtgctacgcgtgttgccgtactgcctcatcacctccctcgtcaccgccagcttcccctctccgaggcccagcctctcctccacgccgtccactaccgcccttccgccggcgtgcaacaaccagaacgcctcgtcgtagctggtgaccgtcgtgcctaccccgcggaacgcgctctcgaccacgccgccgatggcgttggagacgtggagcggcaggtcgcggtgcagggtgatcaccaccccttcctgctgcaccttcaccaccacagcgtcgtccgtgccgggtatcacgtcctgcgacgcccggaccagctggaacacggggcgctcgccggtggacgacgggtggcggcagcaacccaccacggcggcgccagcggcgtcgccgaacactgcctgggcaacgaggttgccaacgtgggactcagagggcccacggatgatcagcgacatcacctcggatgtcaccacgagcaccctggcgtcccggttgctctcggcgatgtccttggccacgcgcagcgccgtggtgccgccgaagcagccggactggtagagcatgacgcgcttggtcgacagcgggaggccgaggagcttgatgagcgtgacgtcagcgctgggcaggcaaccggtgctggtggtggcgaacacgacgtgcgtgatgctcgacgccggcttcccccagttaccgatggcgttgcacgccgcctctgcgccgagccgaggtatgccctcctcagcaacctgctgccgtacgttgagcgaggtggacatgtacgccgtcaccgacgggttggccctcagccactcgtcggagatgtacatgtgccgcttctccgtcgttgtcttcttgcctacattgcaatgcaatcacattattactatataattacttgggcaccatgaaaatctagcttatctctctcatatatatgtgtgtgtgtgtgtgtttgatgattttatggcagttaagtttatggatcgatcgtgacagatacagaatggtagtttcgcatgcacttacagatgtttgcaaacttggcttttagatcgaccaagtgattgctattggtaatctcaaagtaataatcagggaatgacttctgctcatacacatgcaccggcacagccgtgccgattcccaagattgttggcttgttgctctcccgccggcacgaggattgttgctcaattcatgtgtcaactccggtgcccccgaggatcccatcaggcagtattggagtggacggcaactactctaagaggaaatgatgtagctatagctttgagatctctggctaccaaagctcggtcttatataggcattctttgatgatgacgggctactgtatatcttttttacaactagctaggacctcgatgctacaagaaaccatctataattaaatcgttttgattaagacgctttagagcaagtttaatactatagctaactactaactctaaattatctatatttaatttaatagccaatttatccaatagttacctataacatatagtacacaattaatacctagtcccacgtgtcatacatatatttatcttagagcacatgttgcacagctggctgtaacccactacttttctctctcatcatttatcttctcaaaatatgtttatagctggcttatagtctgctattgtacctgctgttatatattccccctccatctaaaaaatttgttagaaatattatttcagtcgctaaaacaaaaaaaaataaattaattaacttactatgtggccatattcttttctgattaattaagatttagattttatctcgactttcgttagcacgttttttaaattattaaacggtgtgttatgtgcgaagactttttatatagaagttgttttaaaagaattaaatatatcaatttgtcaagtttgtaatagttaaaacttaattaatcgtgggctaattgctttctattttgcctatactaattgcatacgcgtcaatcaaccgatccgacacaaaatataaaatcttaacaaaaacgaaaacaacccgataaagaaataaagtaaagactatctccgataagtaaagactagtatctccgataagtaaagactaactccaataccacgcgcgccgctgcatgcgcccaccatatatacaggtctcagctcttccatgcaactagcaaactagtaccaaatccattgtctaatcacatcctgcacatggctcagagagtatctccaccaagcaagagctcgagtaccaaaactctgcacagcaagcttctttatcacagctacaaccacatcgagactgcatatgcatcatctttctttttaacgacccgtacgaaactgtgcgaagttatattgatagagcagaaaaaaattataagattacaaccctgtaaggtcgtaaccaggaaaaaggaaaaaaatataccaccacccacacaccgatatcgccaacacaccagcccagaagaaggctagcatcggaccggctgtcactaagcatgactgaccgccactagaccaataaagggacacagaggagatcgccccctaggggatgccaaaatgacgtcttcaagaagaaaggcgacggaaaaaccgccgccgccgtccgtcgggactcaaaggagctaagactgggctttcgcctggcaatcacccttaaggggtgagatagcacgacaacgccctcaggagggggatgacatcgttgtcggtccggccaaggccggactaggttttcactcgccgctcaccacctgcgaatccacgtctgacacaccgatgctccaccaccacacaagctctgccgacatgtgggacccctacactggcgtcccccgccggctagccttcgggcaccgaagaccgcaccacacctaccgccagctcctcctcacacctaggtagccttctccactgtcagccgcgcctctcgtgctaagccggcctcctccaccggacgcgcctatcgcgccaatctggccttcctccatcggccgcgcctctcacgccaagccggcctcgatctccgccgcccgcgcctctcgcgccgagccgggctccgctgccatcggctgcgcctctctgtgccaagccggtctccgacctctccactaaacgatgccacgctggctgttgacggtcgttatcgatcaattttgatcgttaatattaccaaaatagaggagaactagtgatgcttgcaatgcatatacatgtaagaataataatattccactagtattaggtttactaaccttttgcagagaataacaatgaagtcagacgaattggacgatgtcgatgatcagacgataaatcaactcagacgataaatcaatcggacgatgtcgacgatcagacttatgtatgaatgggccaagaactcagaattgacacgatgaattgggccaaaattcacaagtctacgaagtgaagcaacggaggaggccactagcaaaaacttgggctggttggtccggcccctggttcggccgaaccagtgggtttgacctaacctcccgtggcgctgatggatgcagggttttgatggacagctgggattgatcaccaatgacggttgcaggatattaccgaccattccaaccatcataaccgtcattacctgcctataaaaggagttgccattcttacatcacacacacacctcaagcaagagctctctcatattctctcaagttagtttagtgttattaagctagtggaatagaaatagagtagaaatcgggagtccgaaagcctttggaagagttcgggaatggctctagtatctttccttttctcttttgtaagctttgtactattattagaatactcttctttatacatttatgatattgaaatactttccaagtatattaatgcctactttaaattatgttcatgttatactgaatatgttgctagcttatatgggagatgctttggtgcgggtataatgtttgcttacgcaattactctatgtcatgacgatgatattagagtagtatctggtagtttagacgtcgcgtctggattacgggatattattatttggagttatatgctgcggatgagaggtgggccactgatggtgatagctcagtacgggtattcctccgcgcgcgtatataatcctaagttaattccctggggagggtactcctccgtatttagccccggttgtatggtcatgacgggctgtcgtaaggaactcggcagtcaggggcggcttctctccacatgatcttcccacgggataaaataaatacgatacccttggaaaactctcgggtgaaatgctacaatggtatatccgtgcgcttgcggatgaactctgtaaccataatataccaggagtaattctgcgccattgctgggaattatatttctagtaatatcattaagaaatactaacaagcttttctggcgctgttgccagggaagattcataatagagattacctgacctaatactttctaattacctttgtataatcatttccctttgcaagctaaccttggttgtttttacttttgttgtgaaagcagggtagtacatgactgatttcaacttgccggaaaatttcaaagaaaatccagaagctttcttccagagcgtcaggccgtgagccactgctctgcagaaaactctactgacaaagaaaccagccgtaccagcgccaccgactttcaagactatagctgacaagactctccatgagttcgctgctccctctgctgagaatgtggccattggaccacagatcaacatgggagacatggatttcgacttgaagtccagcctcatcactatggcgtaggctagcccgttctgcggcaagcctaacgaggatgccaatgctcatctacagcagttcctggagaactgtaacacgtacgccataaagggcgtcagtccagacaccgtcaggctaaggctgttcccggtttccctcctcaggagagcgaagcagtggttctacgctaaccgtgctgctgtcaacacctgggacaagtgttctacggtattcctctcgaagttcttcccgatgggcaaaaccaagagttcttccagcagacaagggacgaggccattcctgaagcatgggaacgacttcaagagtatgtggccgcctgtcctcatcatgggattgacaactggctaatcatgcagaacttctacaatggactcccatgtcccgcgatcacctggacgtggcagctggaggagctatcttctctaaattggttcgaggagccgctgatttaatagagaagatggtctccaatatgggttggagcgaggaacgactccagacccgtcagcgaggcatgcacaccgtcaaggagacggaattacttgctgccaagctggaccttctcatgaagcgattggacgaccacgacaaacggcctcaaggcaccatcaaggccttggactcacacgttacgtgtgaggtctgcggcaacatgggtcattctgggaatgattgcccagaaacctatgaggaggcgatgtacatgggcaacaacaacaacggttaccatccacaaggcggtcaagggtggaactagccacgcccgtattatctaggaggtaataacaacggtaacttttctaaccaatcctccttgaaggatctagtttttgcgcaagctaaaactaccgatgctctaagtaaaaagctcactgccaatgacaagatctgtcacaccctaaaaatcccaaatttataaattcttgtttaagtggaatttttagaaatgatttaaaagcctagaagaaaagatctaattttaagtaataaattccaatataaaagtgggctagataaaattttattaaatacttctcttgattctatagttcctagatttttctgggatttatttgagccaagaaagtatttttaataaatggaattgcatttcatgaataatttaaaaggaaaaaggttttaaaatccttcttttgaatttgggtcgaaagtcagcccaagtctctcattcttcccggcctgtgcgcgctggcctagtccgccctctctccctcctctctcccgctgacaggtggggggggggggtcgtctgcctcctcccgccgccaggcgcgccctagccgcgcgcaagccgccaccgccccttccaaattcggttgcatctttcccgatccgatcaaattgataggggggaaatgatcccttcgatctcctctatcttttctcctatagaaactttatctaattttgcttggaaatcatcggattcgagctcgattcggatttgatttctctcctctaaccctaaaccttccatcgccgacgccgaacgtcttgggcctagccgctgccccctagcccctataaaatgacccccgagacctccttcgtccgccgccaccttcgccttagccctccaccgctggtagagctctagccgcgttagcccgtgcgccgccgcaagtccagccgtgcgctgctgctgctctggtcgtcatcgtcgctcgggaaggtcgctgtcgtgttcaccaagtcgtcgctgtcctcgtcccgttctccgtttccgccgaagatcgccggagcatcgccgtcgccgtcgacccgaatgtcttcgccgcttcgacctcgctgccgtcgccgtcggttgccgtctgtcgtcgttcgagccctcggtgagttcgccgtgtcgccctctacccgtaggtgtggtccgtttgcgccgccgcgccgtcattcgccggcgagcacgaggtgtcgagccaccgccggtgatgacgtcttcgtcgacatcagctccacatcagccgtagacccgtggtagatccgatcgatctcggccgtccgttttgtttagattagatcttagccgttcgttccataggccgcttccgtgcaacctgtccaccgtgaacccgagcccactgacactataaatccttttttcttttcaaaaataattcgttattgcgtcataatccaattaaaatctatataaatgatttaatccggtttaatatttaaaacttcataactaattcatcttagctcggatttagttggttcaagtctctaaatttttctaaaattgggatctacatgttaaaaatatccacatgtgctgtttatgattgtttatgtactgttttggtgattttgctcttttatgtttagattccgacgttcccggagagtccgattttgcaggagaagattttgaagagttctaaggccagcaaggcaagtcacacacacctca

SEQ ID NO: 15377 - DNA, 39710 bp, Oryza sativa
  unsure (1)..(39710): unsure at all n locations
tttttgaatgtcatcgagtgggaatgacctatttcctttgttatagccttttgttattgattacctatactttgtcacctggttaataattggattagctataacattatatggttttggctaaagtaattaggatgcttagccatgcttagagacactagctcatatgaatgggataattaatgattcattattacttaatgatggattaatggtagctcatgatggttaatcatgataggatgattaattaagatgtcaactaaaacatggtaacggtgggttgtgagcacatggttttgatggtcgtgctcatgacaattaaggaccggttcacaattttcggttgtgaaacattaaccgtgccaaccacaagccagcgtgggcaacagctttaccttttgtatagtgtggttcattgtggggcaccagactgagaagtggcggagataagcctacgggggtcgctggggagtccatggtgcactactttgaattgtgttatgcggagggtattgtcacaatctctattcgggtacttgtcaagtatcgcgacgcatggttgacatgatgttgaggttgtgtcttgtgggtatagtggtacacctctagccagagtaaaaactatccgaatagccgtgcccgcagttatgggcgggtctaacaatgtctttcgtgattagtctcacacctctcaccataataaatgatgctgtaattggtaataacttgcttagctcctggtttggagatagaactgtgcagccgggaatggttgtctagaaatgttgggcctatgcaacgggtatgttgtgtagcgttgaattaatattgtttaattaaatactttactgtttttctaaattctgaagtatttattgaatgccatttatgcaaatgagactatattatgccatcctttattatcccctgcacttgcatatttgctgcgtggcttgttgagtatgtcatatactcatcttgcaatcattcatcagagaaggagttctacagtgatgctgaaggtgtggaggattaggcgtagccctggtcaagctgcttgtgggatggagtcgcctgtgctctttattttattttccgctgcttagatctttattgtttgagaggaactatccatctctgtaatgactttttattcgcctcttaattagattaataattgcactctattatcaatttgttattgtgtgcctcagctgattcctggacgagggtttacacacatgtaagcgtttggagttttggatagaaattccgggcgtgacaagttggtatcagagcctccttaaccctaggttatgccaaatggttacctatagaagccctctaaaaatattgaaaaagtagaattattctcctctctttctcttttaattaaaccaagctaatggcacatgcagattatagtctcttcaattgttctcattcaaaatttactcattattcctgtgttgttggtattgtacatctattactgtactaatggcccatttaccagcaaaagttttacaacattatttattttcattcaatcatgttgaaatatcataaacttagcatgttgattttataacactcttttattttatgtcttttgaaacctgttattcaaaagtgcaaaatttgtgatcctgttttcaactgtttcaacttatcttgcaagattagtttactttatttacctttcactttgattttctgactttattcaatttaatccaaaaacttgtgctattaattggataaatgtcttaactccctcctttcacttgtctttagatgccgcgcttcaagcctgagtacttgtttggtattgagggatttgtccaagagctacgtccgatgtcctttaccataggattcgggactgcccctttgtatgcccagattcctcatgatcgtgatgaagagaagttccgtgtcaaggtcaccttgaatagtgatcgtgaagagatcccatcggtgatgttcgaaggctggagggggaagctatcctcatgcttgtcaggaggcggcaaggatcaccataggagagctccgcgaccgttacaatgatctgttggccgacactgagtatcgctactatcctcgtcaaccctagggaagtgaccgtgccagctatgttgatcctgaaggaattgagaatgatgctactacaagacatttggtcgagatgctgtgggccatggatgagtcccgcgctgaaatcgtgtcagctgctcaagctcgtgaagaccagaaccgtggtaagatctgcaagctggaggacaagctaggttgatcgtctggagaaggaactggccgaattgaagggagaagcgtcaccacagaaggccagggtttgtcttaccgcaaggaagagagctctttttgttccccgctacctgctggcgcccaaggttcgtatggtgacaagagaagctatcccagttccaatggatcctccggtcgttaatttaagttatgatgagaaagaagattcagagcgcactcactcaaaggttgagaggggtgctactcaagatgatggggacgagccgaacgagccttcaatcaactctgatgccaggaagacctagacgtcttgttaagtcgttgctttagttcgttgtgttagtttgcttgtttaagtttggttgtgtgtgagggtcttgcatgtggtttacatcattggtgggatgtaaatgcatgcgtttgtttgctttcgagtgttaggaagtttgagttaagtggtgtgagagtcttcagttttatgtaataatgaaactaagtttatatcaataaaagtcaagttagtagaaattaattccatgtcctaagtaggtttttcttttggttctcttcttgtgctcttgcctatgccagatggtgaacacccgcagcaatggaaatgggcccaacaacaacaacaacaacaaccaacaacaacaacaacaacaatggagagattcccacgcttgcccaagtcctagctcaacaggcgtagctcatgaacatgatgatgcaacaactccagaaccaacagaatcaggggaacaatcatgctcctccccagaacaagtgagcagaaattcttcgtgtgaggcttgccacttttttcagcactaccaacaccgatgcgcctacaaccggctgactcgtcagtccgttaccctgcagggatagcggaggatgtgctaggtaaaatacgaagatttcttcatgcccgatgactttgtggtgttggatatggaaacgggaaaaaatacgccgctcatcttggggcgtccattccttagcaccgcaggagccaacattgacatgggaacggggagtatccgtttcctatcaacgggaaggaggaaaagtttgagtttcagccaaggactgaacaatgctccatggtcaaaataaagtatgggccaaacccgcagaatatccgagtggtcgaagtggagcctcccaagatggatagcttggtaaagttcatgtaaaatttcctggagaaggaaacaacaatgcccaggaaccgttattggaagacgccggtaaaatcaagtacatcggccaagaaggtggaacagtcggctcagagaaagccgtctttcacaccaaaaccaaataaggtgtggaaggaaaagccaaagacgcccactctatcacctccatagacgggtggaaaatccacgaactgaaatgaaaggaggtacggtcttgcacgtcggacctaaaatgacgcgaccttcgccaactggtaaattgatatgtatccgcatgtttattttcaacaatttaaattccttgcatcaatgcatgtttggtttttaaaattgcatttaggattttttttttgaattttgaggaaattcttcaaatgaattttttagagcaaaccaaaataaaatttttaacgaaaattcactgtgccatgaccacactgaccgttagaacccaatggccgaaagtggggccggttgggcccaccaagggttcggtcgaacccactggttcggtcgaaccggccaggcaacggttacctgccacttttggcaaggtaatggctagcgggtcccacatgtaatttctgaccgttgtgggtaccctataaaagccagccggccgagagagggaattccaccccacttcaacatattttcattccctctccaaagtttgctcttgagttcattcaagctttgatagtttccctcaaattcaaacacttagctgcatatatacaagttgctttggtgaaactaaccggcgggtgaaactcttgttattctaatccctgccgagttagtccgttctagctccattatgcagaataaggaggcaattgtctcgtctgttcgaggggtccggctcttcgtcaagtcatcatgacgagtctagcgctcgttcatctgctaatgtctcgatggaggatgccgaagctccgcggcgtctcctgaacgacactgacctcgacctagtcgatgatcaggaaagaaaagcctactacatgctgagtgaccgggagtatgctcacacgcgagaatactctccagagctatttggatagctatggatgctgagtgaccgggagtatgctcacacgcgagaagataggtatggatgttgattttcgtgctatttggaaagctgttggttggcagagatttgctgtggtagatgagcctggttctcatttgcttactttgcaatttctgtgcactctgaaagaaatagaagatggaattttctttcgctttttccataaacagtatacacttacatggaaaggattaagtatacttcttggttttcacgattcctataaaattgatctccagaaagtaatttctgggttcgagaaaaataggttttgtgaagatatttctggtgctccaatttgcaagaaacctaggacgaataatatccataatcctacacttagactcatgcacaaatggattgctatgactttgtttcctagaggtgatcttaaacccattagggaggatgaattgattatcatgtttgccatggtttgaaaaatcaaaattgctcttgtgaaatgtatgataagacaatggttagaaagtataagattttctgctcctgttgagtgcacttctctgattactcggatagcaaaagggctaggggtcgttagtgaccagattgcttttatctcagccgcttgtccgtgtattgacgaaaattatttagtgcaaggacatattctgaaacatggagtagatggatctttaatatactttttccttgattgtacaaatgaaattccgttgccaaatgtggggtatcatttgtacaactgtagtgaactaaccattcccctgcagaccatagaagaatctcgtgctggtagagcatacagggagacacgcaacatgggaaggaacaaacaagaaagttcatcatcctctacacccgtgcagatgtatgaggcaggttaggaaccaactggggatgcacccggatggacccagactccacaccatagcatcggggtctcaagctgggcaagtgccaatgaggaccgatggcatgcacctcatcacatacaatgggaggacaaccaaccccccagatcaagtggagtacctccatctacaagtgaatgtcgctcgagttcctctcgttgggacttgggtgaaatcactaggagaatggatacccttgatatgcagacaggagagatccagtacaacctcacggaacacatagcacagacgcaagaatggtaacaaactgctgatgctcagttcgccaacttcaccaacatgatgcagcaatagcatgatgaccttcaagcgtacttccgcttctaggggttcaatccttatcaaggaccttgagcgaaagacaagcttggggggagactccccccactgaggtaacttgtatcacattgcatatttccctttctaattgcatatttgctttccaattgcattttataaacttgaaaacaatataaaaatttgcaaaatagaaaattccaaaaagataggataggtttgagtcattctagttaagataagctagttctctttagtaaaatgatgaatagttgctctgtgttatatctcttatatatgggttcataggtaagtgctctctcaaaggttaaatataagtagccaacaattatctgcgagcctgaggaaaatgagctgcacttgctaatttgagtctaggttgttgcgagatatgatatagtaaataagagttgcgatgatcctgatcctagtttgacttgaattccggatgttttgtttttttcaaaatgataaaaatgagagttcctcatttgatataaattcctacagagccaaaactgtgctatcatgattgaaccatatagattttggttacttgccattccattgaactttgtcaaactcttgtgacttgtggatacttctcatgctctatgatcaagatcatatacccacatttatgcacatgctaaactcctatactaggagctagcattataccattccattccatttccatactaccataaaaataaattctccatgctttcatgtgctttctttttctaaaaagaaaaaaattcttttggaaaaaaaaatagaaggagggaacggaatggatatgaaaaaataaataaagttatgctctcacaagcatgagcatgatgttgaaaaaaaagtgtagccatgccctctcctaatcaataaaagaaggatttttaggagaagaaagtaagcacaaaggagaagcattttctttattttccttcataaaccatttccaccttatatcacacaatttgcacgatcttgatcttgagtatgtttagttatctgctttagtctaagtttttgacttagtaataaatgtgaatgcaagtatgccatgtttgatccctaccgggctccacatatcaaaccttagagtaggaatcaaaaaggcaaaattggtgaggaattcatattgatacacttagagaaactgagtgaatcatttgaggaacttggctttctttgcaaattcatttgaaaacttccggaatgaaagttgaataaagattgggtaattggtgctctaattgctgttatgtttttcaaccgcccaaggcaaggagaagcagtgtctcatgggaatcaggggtaagggtaagccaccgtgccaaagattatttaatctgagagatagtacatataccttggacctgtacctttgagatatacagcatagtagcaactcctgatcaacaaccaagtttttatttccttttgtccttcactcgggacgagcaaaagttcaagcttggggggttttgttgacgatcgttatcgatcagtttcgaccgtcaatattaccaaaatagaggaaaactagtgatgcttgcaatgcatatacatgttagaataataatattccactagtattaggtttactaaccttttgcagagaataaccataaagtggaggagaatcgacatcaactcagatgataaatcaatcggacgatgtcgacgatcagacttatgtatgaatgggccaagaactcagaattgacactaattgggccgaaattcacaagtctacgaagtgaagcaatggaggaggccgccaaccaaaacttgagcttgttgggccggcccctggttcggccgaacgaggggattcggctgaacctcccgtggcgccgatgaatgcagggttttgatggacggctgggattgatccccaatgacggttggagggtattaccgaccattccaaccgtcacaaccgtcattacctgcctataaaagaagttaccattctcacttcacacacacacctcaagcaagagctctctcccattctctcaagttagtttagtgttattatgctaatggaataggaataaagtagaaatcgggagtccggaagcctttggaagagtggggattcggccgaacctcccgtggcgccgatggatgcagggctttgatggacggctgggattgatccccaatgacggttggagggtattaccgaccattccaactgtcacaaccgtcattacttgcctataaaaggagttgccattctcacttcacacacacacctcaagcaagagctctctcatattctctcaagcctttggaagagttcgggtatggctctagtagctttccttttctcttttgtaagctttgtactattattagaatactcttctttatacatttatggtattgaaatactgtccgagtatattaatgccaactttacattatgttcatgttatactgaatatgctgctagcttttctgggagatgctttggtgcgggtataatgtttgcttatgcaattactctatgtcataacgatgatattagagtactatctgatagtttagacgtggcatctagattacgggatatctcattatttggggttatatgctgcggatgagaggtgggccgctgatattgatagctcaataagggtattcctccacgcgtgtatatgatcctaagttaattctctagggagggtactcctccatatttagccccggttgtatggtcatgacgggctgtcgtaaggaactcggtagtcaggggtggcttcgcgaagtaccaggagggtatcggatagagggtattagctagtatatcagatcactagaatgtatgtatactatttatattagaagtataggaatagattatctttctcttttctttccacctagcttatataattttgtatgagaatgagtagcttaagtgcttgtgtgtcacactacccttggattatctcaacccctgcttaggatatgattatcacaagtaatatataaattattagtcaagttctctctacaagatcatcctatgggataaaataaatacgatacccttggaatactctcggtgaaatgctacaatggtatatccgtgcgcttgcggatgaactctgtaaccataatatactaggagtatttttgcgccattgctgggaattatatttctagtaatgtcgttaagaaacaccaacaccggccagatgcagccgtctcccacgccctcggctagccgtccgaggccgtcatgcttccggtgaccgcagtcacggtcaccaacaccgcagctgctgctgtcaaacgcccaccatcttgccgttgccatcctcacctcgcacccgactccttccccgccgccgacgtcgccaccgcctccacagtcacggctgccgtcgccgctgccaccgacgctagtcaccgcctccgcagacctcttctgtgccatcgccctctgccaccaagcagccagcaaacgccctgacgccgccgccatgttctccgtccgccgtggtcagccgacgccgccgctcaccgctgtcaactgttgagaccaccacctgccagcacccctgcaccggtatcgaggncaccacacctccgtgttcagcgcctncgcgccgtcgtgcccatcgccgacagattcggtcacctccgcaccagtcatcgtcgggctctacgaccgcgagttcgggccgtcgtggcatcggcgctgccagaaacctccccgccagatccgcgcaggatctggcgggctggtccactgccgccagtgcctgcaaacctctgccgccatccccccaaataacgccgcccgaacacactaccctgccgcggactaactccccgccagctccggccggacagcgcggatctgggcggtttccgcctcccgacatgagaagttcccctgcccttgtgcggaaagcggagcgaagccccaccgctgccatctatgccatcgcgcggctttgccgacgcccgctcgggtgtcggcgaggtgtagtaggagggatggaggacgggagacgacggcctgggcgcctcttgtgccccccgagaggaggtgacgtgagagtcgtgactacactcagtcacctgaattactgcatatgcatcgtcacaattggtgaaaatggtaatggtaattcacggccaaccggcattcgtttttgactttctcctggccgagccatatggtcgggccttcatttttgactttctactggccgagccatatggaaatggtaaacgactgaataaaatggaaatggtaaaaaatatggaaattgaaatagaaatggttttgccgttataccaatcgtttccgtatttaccttgttcttctgaaaatcaccgtttcttataatatggtaattaccgcatctctaaaaatgtcgatattcataagacatatttctacttgacccacagtttagagattgattgactcttcaatcaaatccctaacttgagtgcatggctaaaatggagttaatttgtaatttatatagtataagcttgaatttatttatacatataacatacttatgtaaagttaaatatatgttttacagtttaatatatgtttccgtatttgttaccggtttctgatatgtatcaatatgtttctgtccatattgttccgattcaggttttccgatattgtttttgttcctcacattaccattttttatttttgaaatggtttaggttgttttccgattgtttccgaccgctttcatccctactgcacacactgatcaagacactacagctccccagcaactcgtacccctcagtgcatctccctgcatacaaattgaattgattttccatgctaattgccagacaattaaaccggctattctacataatatggccagctcaaatgaaaccaaatattgaccaaattatggcacaaacaaagtaagatctagctagtccaatcagcggttccatgtgagaagcgtgtgcactagcttgaagatcacaccaaaaacaaaatgcccccgtttcccacttgtacctctccttgtgtgtcacatctacattttgtttgccttttttctttcaaatccatttgactattaagtagtaattgttgtttttttcatagtactcattattttttcaacttcctttgaatgtagttctttaaaaagtaaatgtgacaatctagtggattaaaagtatattaagtattcggatagttacataaacattttcttgaagtacgtgattacacattgtcaggttacggataagacatacctccaatcctacaatttactaaatataccggattggcaaacctcatatccaacgatatttttccgtatgcaataaggaaatatacaagatattatggaaaatatcctcacgggctgatgattatcaaagtcctactcggagaggatagggactattctatatcgtgcagggttcgttgtctccgagttctacttgaagactaaggcaattcatggtataaaaggcacaccgccagaggggctcaggatcatcgaatcatagcgccaacacacctaccatagtttacaaagccgaagaactcgagccgaagccgccgagagatcttgtcaatcaatctcgacaaggatctcgtcggtatcgtcggattcatctgttccctttttactctgtggttttctatatcaatctcatataaactggattagggctattacctcacgaggggcctgaaccagtataatccttgtctcttgtctactttgatatcgtatcgtatagatcctcgtaccaacgtacctcaatacacattttatccggtctacaggtatcccccatcgacagtggtgcgccaggtaggggactttggtgctcaaggttctgccgacatgacttcaagccgctccgacaacttcatctacatcggccccaatgcaggagatccaacctcaattccgatgatgtggactcaagtcggatccatcatctttccggtctactctgtgataccgatctcgtctggcccaatctctgttaggaacgagaacgtcgcagctacgactttacggaaaaggcaaatttatgtcatcagtgcctccctccgactgtacggaaaaggcaaatttatgtaattggctaggagacatcgtaaaattgcgtcgttgctgatggacaccacaaaattcgtgtaatttgctataggacacccgagacaatattttttatttccgagaaaaaagaggagagagaaattttaaaaaaggcaaagttgccctcagccctatctaacacccctaacccatcggcaaagcaggccaggtgccgacttcgacgactactggcgagccccggggtagcagcttcggcagtggctggcgagcttggcagtggcctcgatgatggtcggcaagcccggcagcagcggcttcgatggcagtggtggtggcggaggcaatggcttcgacggtggccgatggcggcagcggcgggttagacggcggttggtgagtggctctagaaagcacgcagcggaggcagctttgatgatggttcgcgagcccgacggcagtggcttcgaggcggaggtcaaggcgaaggccacagcgggtggtgacaaacggcttcgatgatggtcaacgaggccggcggctgcagttttgatggcagcggtgacggaggcagtggcgggcagcgctgggaagcaggcggggattagatagggccaagggcaattttgtctttttgaaatttctctctcccctttttgataagaaatgataaaaaattgtctcgggtgttctacaacaaattacataaattttatggcgtccatcagcagtgacgtgattttatagtgtcttctagccaattacataatttttgggtgtcctagggacaattttgcctacggaaaaacagacgtcgactacgacaacatctagggaacaacctcaagcggccaacctctggtgcaagaaccttgtgccttgaaggcgtgttccattggcactatgctgtagagacgtgggatgcatctctttttgggcaaatatgcaagtaccaactggaccggagcagcaaacagctagaaaagaagagggcatctcctctttcttgtgtgcgagtaggtgttgcggaagcaagaagctgtgcatagctaagagtggatgaaggctaaccaaggcggcacatgagctcaagagaggggctgggtgcagctaagcagcatgatcacaactggcgaggtgtatagccagaaaagactcgcacataatgcggtctttgatctagatgtagcccgtcagccctcttgctctcttcctcttctctcatctttttctgcttttcttccgtctctcttttcttctctttttttaagcaaggtgacaccaacttaaaaccttgatggaactcatcatgaaaatcttgtcgatcgccctcccccacacttggacttttatgtcatgagacgtcaaaaaccaagtgtctgagactgggatcttcataaagtatgttccaacatcaaggatctccaaaatgaatagttgatgtagctcccatgttcttaggcatcgtatgtccctcgttcttaatcttaacctgaaatggttactgaccaagaatacctgaagatgcatactattttagaactggttcttgcttttattggaaggaaaacgtaccaagataatccgggatatctcccgtagtgctttgtttatggtcacaagctcgaccatggagacatctagctgcaagattagtgccacaaaaaaaatacgagatttgcaatatttctgataaacaaaagcatccacaaccacacttctaatcatgttagaaatgaggaccataaggtggttgtggtcctcgtacaaagaagcggcactaatcggacaagactttggagattccttatgtgagtatcaatcctgaggaactttgaaagaaaaactttcatactcatttgtggagttctcatcctctagagttgatgtctcgaacttgtccttggcttgaaggttctccttgtcaaaagatgtgtcatgcaagatcagggttatttcttgaaaattgttgagaacaacatcttgagggctagagggacaagattttggcttgataggaggttgtgatggcggttctaggattggaagttcaaaagtttcaccggaatcaacttctttttcaatgaaatctgagacatcattttcaagaaatgattcgggggactcagatggcagaacagtcgtcacctcctttgcgtacttatctttaggcagaaagtcagtcaaggcaaatcttgactgcgagaatggcagtgagaattcattcccgcctaaagagaaattgaacctgcctactcgaggggtgttgatgagatgtttctcaatagggtgcccgattagaatattgaaatcctggacttcaaaaacatggaaatccaggataacctcgttgctatcatgaatgactggcatatcttggacaaccccaaatccttcaataatgctcccattgggatgcttgaagaatttgtcagttggtgtaattgtcttatcacttaggtatgcaaacgcaaaggattctgagacaatattgacaccgactattgggctgtagagaatcacaacattattcccctctaagtgacaaggaatgggccgaggagtggaatttatcggaattacttcagaagaaagctcaacctcctttagccattcgtcactcataatagaggtcaactctcgaactgtttccttaagaaactggaattctatcgagtcaggaggtagtgagggaacatatggttttctcttgctaaagtagttcaaggtgtttccgtaatcttcatcaagatcatccctcaacaagagagcacaacccggagtttgaatttcttcggtctcaatgggtcatggctcgggaagaggttctcgggtcgaatcaggagaagtagagacttcaactgatgcctcggggaggggctcattatattcgttcatgaaggaggtgttttttagaattcaatctagaattaccttcctttcaatcggagttttgtgcatgaatgatcctacagcagtgatgtctagatagattgcagactccttttctaaacccgaataaaaatgttgcagcagcacatgatcgggtatagatagggatggcattttcacccgtggggtcaggtccaggggacccgccctataggggtgggggtggggccatttttcaatccgcggggcttcatggccgggggagggcatccacccgtgggtgacccacggggccctggggtggtatgctacatcacaatacacagcccattctaggccgaataagtccgacttgctgaaatagtggcatataaaaggccaaaacctaaccctatcctcactttttcctttcccctcactccatcctcacagctagctgccactccaccatctaggcggcgtcgcaacgaggaccccgccgcaccgcgcactgcctccacacaccagcaggctcgacgcccgcgcatggccctccccatccggtctcatgtcgtcgtcgcatcagccacctgagcccggcgaccaggtaaaccgatgtggcgtgcgggtgggcgatggctagggttcacgcgtgcaagcgccaggcagcgagcagcgcaacgggctgctaggctgtcacaccctaaaaatcctaaatatataaattgttgtttaattggaattattagaatttattttaaaaacctaaaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaatcctcttttggctttgggccgaaagtcctctctctctctctccctcggcccagtcggcccagtccggcagcagccgcccgcgcgcgtgtccgcccgctgacaggtggggcccacctgtcaggcctgtcgtcttcctccggccgcccgccgcccgaaccctagcgccgcgccgccgtcgtctccttccaaattcggccacctctttccgtttccggtgaaatcaatagaggggaaatgatcttcgggatcccctctatcttttctcttttggaatcgtcggctaaaatcgtttggaaatccgtggattcgagttcgattcggatcgatctctctcctccgaaccctagactttccttcgccgtcgccggtcgccgtgggccttcgccgccgccttccaacccctatataaggacccccaagcccgccgctacccgtcgccacccttgctttcgcctctcgccgtcggtagcgccctagccctgtgagacctcgcgtcaccgtcgtcgccgccagccgtgcgccgccgtcgctccagtcgtcgccgtcgctcggggaggtcgccatcgtggtcgccgtcgcgtcgccgtcctcgtccgcccctccgccgtcgctgtcgatcgccggaacaccgccgtcgtcgtcaagccgaaggtcgccgccgcttcttcctcgacgccgtcgccgtccgttgatcttccgccgttgctttggtcaccggtgagttcgccgtgccgtccgctacccgtgggtgctctccgttcgcgccgccgcgccgtcgttcgccggcgagtattgtcacatcctgatttttgtttcaggatttataaatcatttaataaattattattagaatttatattaaatgatctttaacttacaagtgaagttaaatgtgggaaataaaatttcctaaatataaagcatggatggatttaatttttattaaattctccatgattaagtcaactctctgaaatattctcggatttttcagagctcaattcctaaatgatacaaagaacagttcagtaattatttgatcattaatgatctaattatattttttaagagcttttcttgtttaaaaatccttaaattacaaattgttgtttaaaaggaattattagaaatgatcttaaaagcctaaaagagaagatctaattttaatttgttaaatctcaatataaaattgggctagataaaatttttttaaatactttgcttaattctataattcctagatttttctgggattaatttgagctaaggaaataattttaataaatggaattgcatttcatgaataatttaaattgaaaaaggtttttaaaagtctcttttggctttgggccgaaagccggcccaaaacctctctctttctctctccctccccggcccagtcggcccaggccgccgccgctctcctctctctctcgctgtcgctgacaggtggggcccgcctgtcggacccgtcttcctccttcggccgccgccgcccgaaaccctagcgccgcgccgccgccgtctccttcccaaattcggccgcgtctttcccgatccggtgaaatcttttgaggggaaacaatcttcgggatctcctcttccttttctcttatagaaactccggtcaatttcctttggaaataggcggattcgagtttgattcggattcgtttttccccgacctttccttctcgtcgccggcagccgtgggccttcgccgctgcctccttgcccctatataaggatctccaagtccgccgctacccgccgccaccctcgccttcgtccctcgtcgtcggaagagccctagcaccgtgagacctcgcgccgccgtcgtcgccgtcgctccagccgtgcgccgccgtcgtttcggtcgtcgtcgttgctcggggaggccgccatcgtggtcgccaagtcgtcgccgtcctcgtccgccgcttcaccgccgccgaagaccgccggagcaccgtcgccgccgtcgacccgatctccgccgccgcttcttcctcgtcgccgacgccgtccgttgcttttccaccgttgttttggtcaccggtgagttcgccgcgtcgccctctacccgttggtgtcctccgtttgcgtcgccgcgccgtcgttcgccggcgagcatgcgttgccgagccgccgccggtgctgacgtcatcgctgacgtctgtcacatcctgattttttcgtttcaggatttataaataatttaataaattaataatagaatttatgttaaatgttctttaatttacaagtgaagtaaaatgtgggaaataaaatttcctaaatataaagcatggatggatttaattttttattaaattctccatggttaattatactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgattttaaaagcctagaagagaagatctaattttaatttgctaaatctcaatataaatttgggctagataaaatttcattaaatactttgcttaattctataattcctagatttttctgggatttatttgagctaaggaagtatttttaataaatggaattgcatttcatgaataatttaaattgaaaaaggttttaaaagtcttcttttggctttgggccgaaagccggcccaacacctctcttctctctctccccggcccaagttggcccagtccgccgagccgccgctctcctctctctctcagccgctgacaggtgggccccacttgtcggtttcgtcttcctcctccggccgccgccgcccgaaaccctagccgagcagctccgccgccgctttccaaaattcggtcgatcctttccttctccggccgaattgatagaggggaaataatctcctcgatctcctcttccttttctcttatagaaactccggtcaatttcctttggaaataggcggattcgagtttgattcggattcgtttttccccgaagtttccttctcgccgccggccgccgtgggccttcgccgccgcctccttgcacctataaaaggacccccgagctctcctctacccgccgcctccctcgccttcgtctctagtcgtctgtagcgccctagcgccgtgccgcctcgcgccgccgtcgtcgccgtcgctccagccgtgcgccgccgtcgctccagtcggtcgccgtcgccaccatcgggttcgcaaggtcgtcgccgtccccgtccaccgcttcgccgccgccgaagaccgccggagcgccatcaccatcgtcgacccgatctccgccgccgcttcttcctcgtcgccggcgtcgtccattgatcttccgccgctcctttggtcaccggtgagttcgccgtgccgtccgctacccgttggtgccctccgttcgtgccgaagtgccgccgttcgccggcgagcatgcgagcttgcgcctcccgagccgccgccggtggtgacgtcatcgctgacgtcatcgtcgccctctcccgtgagccggtcgtggaccgatcgatctcggccgttcgtcccgtgaaccgctgccgtgcacccggtccaccgcaaaccctagccgctgacacaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaaaaatgatctacatgtttgtttactttttatgtattgtttatttggtttttattagtctttttcctcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaaccgtgcatttattttcgaatgtcactgggtggtgtgaatctattcctttgttatggcctgtttgctttgattactttaatccttgataccttgggtgattataatttgactagttgagctttatatattggttcagctagatattagatgtgattgcttagccatgcttagaaacattagcacactattgggataacttatgattcattattatttaatgatggtttaatgatagttcacgatggttaatcgtgattgattaattaattacttgccaactaaaacttgataatggtgggttgtgagcacatggttttgagagtcctgctcatgacaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgtttataagggggtgattatgatccaggaatggtgcactttggtgagttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagattagatctgtacagccgggtatggttgcttcagaatggttgggcctgagcagcatgggtgtgctgttcagtgttgattaaaatttctgattaattactccactgttttacttctcttaaatgttttgctaaaagctgcttttgcaaatgagcctatattatgccaacctttggtatccttgtgcacttgcatatttgctgtgtggcttgctgagtatgtcatatgctcaccttgcaataatcaatcaacctcagttgaagaaaaaggattcagaagaagaagacgtttagcttataccccagttgagctgcctgtgggagtggagccggagcttcgctagattttattttccgctgtaattttcttcctggtgaggactaagtgcctcataagtaagtatttatcgttttagttaatttgataaatctgtatattaaattgtcagtttgtgtacctcggctgattcctggacgaggattttatgcacaaataagttcggaaattactagtgaatttccaagcgtgacaacgtcatcgttgccattccccgtgagccggtcgtggaccgattgatctcggccgtccgttttggataggatcgatctcggccgtccgttcccgtgaaccgttgccgtgcgcccggtccaccgcaaaccctagccgctgacgcaataatcctccttttccttttcaaaaataattcattattgcgtcataattcaattaaaatccacataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcccaaacacaatcctttgagcatgttgatcctatatttaaattctctatttatttcaactatgcatttattttcgaatgtcaccgggtggtgtgaacttattcctttgttatggccaatttgcattgattactttattccttgataccttgggttattataacttgactagttgagctttacatattggttcagctagatattagttatgattgcttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttaagagtcgtgctcatgacaattaaggaccggttcgcgagctactattgtgaaacattaatcgtgccaaccacaagccagcgtgggcaacggctttacctttcgtatagcatggttcattgcagagcaccagactgagaagtggcggagataagcccacgggggtcgctggggagtccatgccttgtttataagggggtgactatgatccgggaacggtgcgctgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggaaggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttactgagtatgtcatatgctcaccttgcaataatcaatcaacctcagttgaagaaaacggatccagaaggagaagacgtttggcttataccccagttgagctgcctgtgggagtggagccggagcttcgctagattttatttttcgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagtttggaaattacgagtgaatttccgggcgtgacaagtatgcacgcccgagccgccgccggtggtgacgtcaccgctgacgtcatcgtcgtcgttccccgtggcctggtcgtggaccgttggatcttggccgtccgttttggataggatcgatctcggccgttcgtttccgtgagccaccgccgtgcacccggtccaccgcaaaccctagccgctgacgcaataaacccctttttccttttcaaaaataattcattattgcgtcataattcaattaaaatccatataagtgttttaatccgatttaatctttaaaaattcataactaattcatcttagctcggatttagttggttcaagtctctaaatttttctcaaattgagatctacatgttaaaaatatccacatgtactgttcatgcttgtttatgtgctgttttggtattttgctcttttctgtttagattccgacgtttccggagagtccgttttcgcaggagaagaatttgaagagttccaaggccagtaaggcaagtcacccagatcctaaacacaatcctttgagcatgttgatcctatatttatattctctatttatttcaactgtgcatttatttttggatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactcttgggataacttatgactcactattatttaatgatggcttaatgatagttcacgatggtcaatcatgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctagggagtccatgccttatttataagggggtgattatgatccaggaaatgtgcgctgtggtggattgtgttgtgcaaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaaactgcctatggagtggagccgtctgcgtcgtttatcttattttttcgctgcttagatctttattgattgagaggaactatctacctctgtaatgacgttttattcgcttattaattagagtaataattgtactctattatcaatttgttattgtgtgcctcggctgattcctggacgagggttcacacacatgtaagcgtttggaattttggatagaaattccgggcgtgacataggcgagggcaagcaggcacataggcgagcagcaaagcaggtgacggccgacgggcaaacaaaaactcaggaggtgtcgatctaaatttctgtaatgtgttctttcattgtttggtaattatatatcccgatgacttagaacatgattctggtgctttctcagtttgatgatctttggtttgaacgcagaacaccatttctttggatagaatgtcaaagttataaattatttttgatgaaccactgattgttctgctatttttttttttgctaattgaatggtgcggacactcaatcggggccccggtcgggctagggctgcgggctgttttagccccgcaactaacctcgggggcggggggagaagttgggagtcgggggcgggggcgttccagcccaacccgccctcgacccgccctgttgccaatcctaggtatagataaggttgggccaaattgcactagattaggatgtgtttggatggagggattggctgggatagggtatggccacccaaattttggaggtgtttggatggtgggcggtactgggatatggccaccccctagggaatattccctccagatgccggctctgtgcatccggccaattcggccggacagggcggcccaggaccgcgcgcgactcatgcaagtgaagtggtcgcgtgccctcacctcctcccatccttttctctcttttttctcctctgttctcaccggttcacagtggcaaaccctagctctcctccctcattcagcggtgcaccaggcggggtggttcggcggagcgggtggccgcgccggggacgagcggtaggcggggcgggcggcaggtgtcggcggcaccaagtagtgatacgggttatcggaaaaaaggcaagacaaaatctgtctcgcagcttttccagtcaccattcacacatccaatggtagatgtgtatcaatggttcgctctctcgtgaagagagaacggaaacaatttcccctgaacagtattttgtctcatgccacgaatcttaaggcacgaacatagctgttcgaattcccgcaaataatggtaaggattttctcggtcaagaccagaaaaaggattttccttaatcatacgtattaattcagggcagatctcatagccagttgtataaataggctccgatgaaggaggtggctcgtaagattcgcctcgtggagcagatagctgaaaaattgatgatggctccttcggtcaagaaggttttactggaattcttctctagggtagcaggggtgatggtagaagatgaacaaggttcggagatagacagcaaccgttccccgacaacggcggcagaaatgcttgttggtatttattaacctcacagataaaatccgcaagcgcacagaaaataccgatgtagcacttcactgggagtattctcaggtatcgatttccatagggagcgtgtgtgtcaactccagatcaggttgatccaaggacacgaagctaatgataggcaaaggatagagaggaacagtgtctacggaaagcttaactttaatcctaacgcgatacttcgggcactggccagctcgctgctcctagatatcgctctactatgcacccgggcaaggaggacttcagtgatctcgagggttgtcaccacctctacacccacctcacacctactgtgggaagcggagcaaacaccggaaatcaactacctagacaccgcgtataagcagttaataacttactttaatgttagctataaactaaagcactcactatattttactggattatagtgaacgatgatcatgtccgctgattaggaactaaccaagacataattttcaccaagcaaaacaaaattactcaaaagatatttctattataatcagagtaattaacatggcaaaaaataagaagaggattaccgataactccagaactcctccgacttcttctactctactctccctaatcaagtataaaataaagttcaatagagcctcttataattcagcgcaagcttgcagtgtgtgtgtgtgaagtgagtgaggtgaggtccttaaatagggcaggtataacggttaggaaaacgtgacatgtcctttttgcccttcaaccgccattaggagctcatctggaccatacacgccaaaccctagcctgaacggctgagattgtggttcggccgaaccctggccaggcccaacaggcctgcactttggcctgttgcctctcctcctcctcttctatccatttttgtgtgtggaaggcccatttggtcgtattttaatgtagttcttggcccacttgtgatatggacaggaattctccttcacttaagtctatatttcatccaacttcgacggtttatcacctgcattcaaatgtacacaacacttgtggaatatgtcataattaaaccctatcactatgttggatgttttatttccttgatttatgcaggtattttgttaggagctaccataggcagcccccgattacgcaatgcgtatgtgtggacgacgggaggacgaggtcaatagcttcgcctccccggcgccgtgctgtgagatggaacagagagggagagattagagagaacagaggaaggagacagtagatgagattaaatttcttgcttggatttaaccataacaatccacggcttaagtagccttacatgctagcaaactttagctaacaaacttgctaattaaaagggataacagaaacaaattatcaagctgatcctaatccaccgaattcagtggcacgagatactattcctcgtccggcacggtgttcgtccgtccgcccgcaccgctgaaagggaattccccacataacatattggcggcataaaattggcatttagcaactgccaacagttaagttgagggacctccggtgaacttagtccttttaattattgggctgtgtcttctactttctacaaagcccacagatattttttcgggcagattggaaaaagttcactttgactccttcaaatagaggttcgttttgacccaataagtattgaaaccagtgcagaatgactccctcggtgattttgtgggtgattttcgctggcgtggctagttgatttggtctaacctgctgagtcatcatgtaaggcccacatgtcagtgtcacatatgtttccttctctcgttcctttttctctcctccctccactttctctctcaaccttttctctatgctccatgcatctccctcggtgatggcgagaactcttcctctctcgataatcatggaagctgcagccaagacggcgtccaagaaggaaggaagtgggcgacgagcagatccaagcagcgtggtggtccttccatactcccgcctcccgcgccacgccctcggtcgttgtgggcgtgctcccttgaggacgcgtcgccactgctgacgcaaccaacggagccgatgctggcgctgccgcctccgtctcaccttcttataagtcccaacgctaggactcgtgtttgtgctagatctgctggccgaagcaggcgagatagagaaactgctggggaaactgaagcctgctcgagtggatcctggtgacctccagaccttcctcggatcctctgcagcgacggaggagacaatggagttgcgcatgcgagcttcctcctctgccattggtgccagttcatcaaggacgcacgccgcaggcatgaagtagtgggtagcgtagatcgagtataggtacgtatccactggatgggtggtgatcagttcattcctatttcatagatcttgttggtaggctagtcagattttttttatctaaatctctctttttcgaactgcatgagtgcttaaagttttgaatttttcatggccaagttcatgtgtattgtgttgttttagttctaagtttcttgaaccatggttcttctctcctgtgttgtttttgtgtttttcagagccttgattacatcttttgatagcaaagttcaatgtagttgtgcagacattcgatagttgccgccaccgacagccgtatggtagacatcaacgagctcgacgagtgggcagctggcggcggctcaaccacttcggcacttgtgcccatcatccccaccgtgaagaggttgttctcgacggctcgctgaagagaaggtggggaagttcctgacaaactgggcccactctttttttttaattcatatgctgactgggctaacacgtatacaccacgtcaaccaaaaccgctatcaaaatagctgagagagtcgttttgcacggttttcatagttataggggtcgatatttttggttttacgtttaagggatacgaattagatctgacgtatatttgagggagtcaaattgaatttttttccaggtagattaggagcataggacttcattcaaatgtttcttgttttttttgggcttcactgctggagaaaccatttattctcccggttggtaacccctttagtcccggtttttcaaccgggactatgaatccgggactaaagatgcccatatttagtttcggttgaaataaccggggctaaagatccatttttgtcccggttggtaacaccaatcgggactaaatataccttatctttagtcccggttggggactaaagagagggtagcgacagttccatttggtctctttttttttcattgttttttagctggagtttaatccctgtattttctcccaaatcaagtgggatacatatcccaaatcaaacctcaaatcaaagtaacatcccaaaacattcccattacaaatcttaagttacttatacacacaaatcaaatatatcataaatcttaaaaaaattacacacaaaccaaatacatcacagattatacatctcaggtcatgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcccctttccctccctctccctcttgggccggctcggcccatctacctacccctccctctcctctccccgcggcccatccggccttcccccgcgcgcgcgccgctgacgggcgggcccgcccgccaccctcgctgacgggtggggcccacccgtcatccccttcctcccgccgctcccgccgcctcgcccgcgccctagcggcgccgccgccgcgaatcccgccgcctcctgcgtccccgcgtgcaatcagtagggggaattattccccgtgattccctctccctttccccccacttttccctctctctctcgcgttcaaacgggcgaatttgcccccgcaaatctcgccggcgccattgatggcggccggacctcccgcgcctattccttccccgccggccggcctctccccctttcaaccatatataaaccctccccgcgcctcctccgaccgtttccgcctttcgccgcccttcctcctcgacggaatcgagctcgcgccgtcgctctctctctccgccgtcgccgtcgagctccggtccgccgtcgtcgtcaccccggaccatctcccaccccggcgtcgcctccttcggcttcgccgcatcctcggcgaccttgtccacccctccgtttcgctcgccgaccgccggaacgcccccgtccccgtcgacctgagccgcgccgccgccttcgtccgctccggctgccattccgtcgtcgccgtcgacctagggtgagccgtgaaccgccgcttcttttcccccttcccttcccctctctcggccgccgctccgccgtgcctatggccgccgccggcgaccataggggcgcgggtgcgccgcctccccccggctgtgccggcgtggccgccttcgggcgcaccgtgcggctgccgcgtggggcccggccgtcagccgcccgcgccctcgggtgcggctgacgcgtgggacccacggcgccggccggtgtgagcccgggtgcgcccggtccatcgtggaccgtgaggctgccgcgtgggccccactcccgtggacccggtccgcgcgcccctcccctcggctgacgcaataaaccttttttttaattaaaatttaaatgaagaaattcgcaaatattcatttaaagagcatataaacttcaaatggccaactcggaattggaccgttcaagtctctaatttttccttaagaagtcaagaacccatttttgtgctttgtttcagcttgtatatggagtttattagagtaaaagccttttcttttccgttggtcgtgtagacgctgcagcttcagaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattatttccttgttcaccctagaataaacaaaaccccaactagtggacactctactcatggtaccactagtatgattttaggtagatgcttcgctggttaattaggcaacattatgtggttttacaactctagactttgggatattcatatcacctggacactatggaatggtttgattattgtggaattggattcacacctccccctctattcaaaaccctcaaaatggttttaggctgggctcggggtgcatggttttgatagtagcacctcggccatacaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctcggggctcagtcctgactacctgtcacatcctgatttttgtttcaggatttataaattatttaataaattattaatagaatttatgttaaatgatctttaattttcaagtgaagttaaatgtgggaaataaaatttcctaaatataaagcatggatggatttaattttttattaaattctccatgattaattatactctctgaaattttctcggaattttcggagctcaattcctaatgttaataatacaaagagcatttcagtaattacccacatattaaattaatcattaaatggtctgattataattttgttaagtactttgagtgttcaagtattttcaagatttttcttggaattatttgagcataggaagtatttttaacaattcaaagatcatttcagtgattaatttaattggaaaagtatttaaaatccccttctccttttcgggccgaaataggaaaagttcagcttcagtcctcggcccattctcccattttttcggctggccttatccctcctccaaagtctgctttgtgtccctctttcaatcgggccaagaagtagaagcccagccgaaagtctagttggcctccctgcgctactgttcatcttccagctctggacagagcccgagccagccgagcctgtgcacagtgccgccttcttccaccaaatccggcctcctcgttgctcctctttccaaattagttgcgggaatggaatcctctcaatctcctcttccttttccccaagaaatccccaaaattttatatggaaatcctttccaatttcgcggttcaacctttcctttttccggcgaaccctacctaatccgtcgccgattccatccgttcccgagtcgttctctccctcttctggctatataaaggaccccctagtcctcctctttcgtttgccccctctcccgtggtctcccgtgcctcgtagcgccgccaccacgtgctccaccccgccgtcgtcgccggcgccgctccagccgccgtgcgccgtcgccccggccgtcgccggtcagtgccgtcgcctccctcagcttcgcaagggtgagagctaccccggccacccgttcttttgcgccgaaccccgccggaagtcgccgtcaccgtgaaggccgaaccgttgccatgttttgatctccggcgaagctttgccgtcgactccgtggtcgccggacctcgccgtatccactgtcggcatcgcagcagtgaggagaagcccggcagccatctccccgaagccaaaatccaccggagctccatcgtcgccgtcaaccctgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggaatcaaaccagtcgggagagaaccggctttcagtcccgtttggattcccgaacgcggctgaaagctacttcaaaaccatctcaaccgagtcggcttcaaaccactcggccgagatcgcatcttctccaacgacaccagatcaagatgatggggcttacccaccagtcctgatgaagctccccgacgatttggtggccgtctccatcgcgacagcgtcttcttcccgtaggcctaggcggaagtcggcttcaacactgatttcgcctagcttcagggaagttggcgtcatcctccaaccactcggcacggtttcgacggatcagctagatggcgactacagctctcccaccgtcgactcgcgccccaccaacatcgtggagtacgacgagtttagctctcgctaccacgatccggatctcgacgacttcgacggaagcctagatgacaactacacccctctctactttggcgtcttcatggccaataacgagacggaggagcaacgccaagcccgggagaccgaagcgcgtcgcgagactgagcgccgccgactggaagaggagcatcaagcacaagaacaagaacgattacggcgtgagcagcaggagcgtgagcggaccgcgaaggaggctgaagatcgacggcagcgagctttggaagcagggcgccgggcgcgtgatctcatcggccagcaagatgttgaagggacgccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcagtcccagttaactccgaaagcgtccacacgccgactggtagccgagtccctcacttccgatctcatgactaccgtcatccaagcctcagcatcaccggcgcaggatctaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgatctgcgtcgagtggattggccagccggcttcaagccgactggaatagagaagtacgacggtaccactaatccagaatcgtagcttaccgtctacggtcttgcaatccgcgcagcaggaggagacaacaaggccatggcgaactatttaccagtggctttagcagattccgcccgatcttggctccatggattgccccgtggtacaattggatcttgggctgaattaagcgaccacttcatcgccaacttccaaggcaccttcgagcgtcccggcacacaatacgacctctacaacgtcattcagaagtccggagaatcccttcgagattacatccggcgattttctgaacaacgtaacaagatctccgacatcaccgatgacgtcatcatcgccgcattcaccaaagggattcgccacgaagaattggtcggcaagttcgggcgtaagccccccaggacagtcaagcttatgtttgaaaaagccaacgagtacgccaaagccgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaatttgcggatcaatacaccaagactgcacgaaagaactctgacgaagaacaaagcacgtcaaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgttggtcagagattgcaatcaagtttgaccgctcggatcatcctgaccgagtggtccacccggggcggtaccccctggtactagacccagtggtccgtaatgtcaagcttcgcagaaccctcattgacggtggcagtgcactcaatatcctcttcgccaagaccttggatgatatgcagattcctcgctccgagctaaaaccaagcaatgcgcctttccacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcacgagatggcgtctgcccgagaggttatccgactggctgcagccacggcgagcgaaggagaagtgcccgctaccaagatttcaaagaatggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaaacctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgcgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccttttggtgcatactgctacgtcaccatgccgtttggactaaaaaatgcaggagcaacttatcaacgtatgattcagagatgcttctcaacacaaattggccgcaacgttgaagcctatgtggatgatgtagtcgtcaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagccgactggatgcatggcggcgctcagccgatttgtttcaaggcttggcgagcgggggatgcctttctttaagctgctgaagaaaacagataacttccagtggggacccgaagcacagaaggccttcgaagatttcaagaaactcctcaccgagccaccagtcttagcctcaccacacccgcaagagccgttgttgctgtatgtatcagccacctcccaggttgtgagcacagtcttggtcgttgagcgcgaggaagaaggccatgtccaaaaagtccagcgaccaatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctatgtgctttggatacatttttcggcgtcccacaacgtcgccgagtatgaggccctccttcatggactacggattgcaatttccctagggataaagcgtctgattgttcgaggcgattcacagttggttgtcaaccaagttatgaaagagtggtcctgcattgacgacaatatgatggcatatcgacaagaggtgcgcaaattggaagacaagttcgagggactcgagctcagtcacgttcttcgacacaacaatgaagccgccgacagacttgccaattttggatccaagcgcgagacggcgccctcagatgttttcgtcgaacacctttatacaccgaccgtacctcatagagatactactcaagatgcggacactcatgacgtagctatggttgaagccgactggcgagagcccttcatacgatttttaacttctcaagagctcccttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgt

SEQ ID NO: 15378 - DNA, 17250 bp, Oryza sativa
agaaaaggaaaaaggattttccctggaattaacaattgcactttagtgatttttaattggttaaaaattatttctagagctctgaaaattccactaaaaatcctgttaatgaattttgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacaaacctaccccccttaaacggaatctcggccccgagattcggtggagctggtgaagaggtacggatgggcggctttcaactcatcttccctttcccaggtcgcttcctcttccgaatgatgactccactgaactcggcaaaaccgggtgaccttgtttctggttctcctttcgctagtgtcaagtatgtgaaccggcttctccacatatgttaggtcctcttggatatcaatgtgttccgaatcagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaagatacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcgctctgtctgaccatcagtttgcgggtgataggccgtgctgaaatttaaacgggtccccatctcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtaagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttccttgaggtcttgatacattttggtgctgcctgggtgaatggagtactgggtctgatgagcctcggtgagtatcagatccttcagttctttgtcgtcaggtacacacaatctttctcccatccagattgtgccatgctcatcttcatggaaatcccgagcctttccgactctcatgttctttttcagttctgctatttccggatcatttacttgagcggctctgacttgatccacgagcgtaggccgtgcctccaaagcggctacaaacccgtgttcaacaattcccatgttgagatgttcaaattcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcacaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataactagccagtcctagaaaactccgaatctgcgacacggtctttggtggggtccattttgtaactgactccacgttcgatggatcaactgccacaccctgggctgtaatgacatggcccagaaatttgacttccgtcaaccagaagtcacacttgctgaacttggcgtatagctggtgctccttcaacttctcgagtaccagacggagatgttgttcatgttcctcttcggactttgaatagataagaatgtcgtcgatgaacaccacaacaaacttgtccaaaaattctatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctctgctaattcgttggccgccatcctgtatggtctcttgtaaattggagcggttcccggtgccaagtcaatccggaattcaatctccctcttgggtggcatggtagtgaggtcttcggggaacacttccggatactcgcagactatgggtatatcttccaattttctcaagttcttccccacggtgtccactgggatttccgtttcaatttgattcaaggagactccttgctttggtgagtctggtgatttgtacactacggtttctcccttctcgttggtcaaggtgactgtgcgactcgcacaatcgatgacccccttaaacttggtcagccaatccatcccaagaatgacatctaggtctttggattcgagaagaatgaggttggctagaaatggtgatctttggatttctattagcactgaagggctaaaactgactgaggttgaactatttcccggggtacgaaccctcattggtgtgctaagctcgtctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctggtggaagttgctggagttgaacgggcggtgctggcggacgatcatggtggtaggtccaccctgctgtccgggagtgaagcgcggtcggtgctgactaccttggttggaccggaattgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcgtggaggtactctgtcacagtcatgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagggttggtggtgctggagaaggtgggtggcctgacacgtagaaactcaggcaacttggactgggggggagggggaccaaactgctggtgctgctgttcggcgtgctgcatcatcctctgatgcatctgctggtgctgctgctgcatctgctgcatcatggctgccatcatctgagtctgatgtgccataacttgggcaagcgtcggattctcgggaagtggtggtggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactaagctttattacaaaggaattaaaactgtaattgttctgatctgaattaaaaacacttaaaagggcaagcaaatatccttattaagacagccatatcataggcacatgatatcgaccgccgactgaccccaaacaagcaacctacacacacaaactaacaaacaaaaactagacagtcgatgaactagtggaaaaacgagcctaatgctcggaacggctcctgcggtcggtggagtcgaaggcgtcctcctgctcgtcacccggtccctctgagcgactcctggagcctgacggatcggtctcgccgctgccgctgggagtagcagacagccaacctccggtaccactggctgaacctctggcggctgatgctggagcgaaggagagagtgaacgcgggagttggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcgtgatctgctgtgcctcctgatgcctcgaccgccatgttagcgaggcaagtccccacgtagccatggacctccaagcggacacggtaaggaagctcgccactgagcggtgggatggtcgtgtattccggcgcgtcggggtagcccactaccagtgtcatgcgtgccaactctgccacgaaatcaatcatgccttctccgcggtggttgggtgggtgaccggccatctagagaagacaaagaagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttctccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcaggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaacgtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctggaggtacctcggcgactatttcgaagtacaccggagcgtcggagggatcggaatctagcgacatacaaagcaaacattgcaaacaggctataagactactgaaacagagaacaaaaccatttttaatggattctacacatttttcttgatttactgagatttgaatgggattaaacggagctcggatgaattagatatgaattttagaaaattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaagaatggggcggcggcgccacgtggcgaccggaccggcggccccgatctacccaagggtagatcggacggcggcgcgggacctctcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagatggaccatggcgatcgggatccatggccgaaggcggcggtagaggtggcgctcacccgtgcgcgtggagatgagggctccggcgacgaacctcgacggatgaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaaaaggggatgggggaaccggacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgggccggcccagtaagggaggggaaggaagggagaagtgggccgacggcccacttgacaaaaaggagggaaaagagaggaaaaaggaaaagaaaaggaaaaaggattttccctggaattaacaattgcactttagtgatttttaattggttaaaaattatttctagagctctgaaaattccactaaaaatcctgttaatgaatttcgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacatccctcatgataaagatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagttggcggttacacgcatctctttgtggccattgacaaattctccaagtggattgaagctaaaccggttgtcacaatcacagcagataatgctcgagacttcttcatcaacattgtgcatagatttggagtgcccaatcggatcattaccgataatggcacacaattcaccggtggagtttttaaagacttttgtgaagactttggaattaagatttgctatgcctcagtggcacaccccatgagcaatggacaggtggagcgagccaatggcatgatacttcaagggattaaagcgcgtgtttttgaccggctaagaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgagtggatgatttgcaccgattggaagaagcccgcgaagcagctttgattcggtcggctcgatatttacaaggattgcggcgctatcataatcgcaatgttcgatctcgtgcctttttagtcggtgacctggttttgcggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgaagttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccggtattgtacaaattgagcctccatttgttacattcatactcagtcagagtcagtcctttcatcatcagagttattattactcggctgaagatcgttgttgcggaattgctctacaacatcacttgcaatcttgtcagccgcactttgagcattactgataagatcaagagcagcttcttcacttgtcccgtctgcaaagccatcaatggtatcaatttcaatcctcgggtacaaggatttggtcatcgccaatgccatactagctcccatacttccagctttcttgatattcttgaagtatacatccggtgcaactctcagcttgtcaaagatttcggttgcgtcaagtgcactcggaccactgttattaaggaacatagcttggacaagtggtgtagcgacattggcgacttcgtctcttgctccttcaagtttcttgatcttaccaaccaggacgtcaaactgagcttgagatttgattttacggtctacaaaacacatttataataagaatttgctgcattaaaaagaggaaagttcagattgtcagctggcagtaccttcaacctccttcaaggctgagtccctttctgcagccagttctgctttgtcttttttcaaggcttctatttgcttctccatttgagccatcctggtggcttgcgctgtttgaaatccaaatgtttgaggatccagttatgacagcacaaatgggacagatctagagattaccttttgatgaaccactcagctcgaagttggagtcctgaagctgtgcaattcgatcccttaattccttctccgttttcttggcatgctccttggcctcgtgtagctgttccctaacggcttcaagagttcccaaatgtggaaccagcttttctaaggttgtggtcttggcctcattgcgaagatggatcctctgcacggtggttcatggattagttttgctaacgagacaataaagtcatcaaaggcagtcacctagaagacttacattcacaatgcgagtagcttctccaagtactttcttcagctggcacacttcctcatcttctttttggcgatttatgacaatgccagaaacttgagagttctcgtcccaccatttgagtaagataggaggacgagagtcatcagctgcctttatgcggagaatttcttcttcgtcgccgcctaatggacctgatgcattcccaagacattagacgaacaagctggagttattcagaacggcatcacttgagaatatgagttacctgaggatgtgcctagttgagcgtgaggtgatctttgctctttatccagagacccaatcaccgagtcattgccagcttttggtccttgggaagttgtcgcttgtgctccagcttcaggaatctcttgatttagacccacatccgactggtttccagtcaggggttcttgggttgttgcagtttcagttgcttccgactggtttccagtcggtggctggtcactcggatcggccttgtcatccgaagcatgggcgccagtcggctggtttttggcagtcggctggttttcggcagtcggctcagtgtctttggataaatttggctctgtcacagccggatcaggatcttttccagttggatcaatgtcggatggtttcctgcaaagtgtcctttcaacattcagcgtaatttctatgagagaagtatgtcaaagggaaatggtatcgagaggtttatacctggaagatgttctaatctttggcatttgacggccagccagttttttcctgggcatggtatgctttgggagtttgttgggcgttcccttgtccccagatttgttgctgtcatcgccctcgtcgtcattaagcaccagctttctcttgcgaggacctgtctgcccagccggtttggaggtttgaggttgtgggtctgacctgattgtcggccctccacttccctgaatggtgtgctggcgaggagatcggcgctgagcaattgggggatcagatttcatcaatacgtattcctgaatgagatgcttccacagttagctaactcaacatgaagatgaaattatgttttgaccttgggttgaagattttcagatacatacctgcggaggcggattgaatgcgttgtatggtacaactggcagttgatgtgagtagctgacgacaatagcgttcgagaatatcttgtacatcctctccttcatgatcttaaaatccagagaatctgggtcttcacggtttggatcgtgcttgccgtcaaattcaaatgctgtgcgggatctttctttgattggagctaatcggcacttaatgaaatgccgagtgatttgctctccctgtaagccttgctctttgagtttcagcatgcgttccatcagttctaaggcttgggcagcttcatctcccatgggaagagagttccatgtatcttggtatactgggggaagacaggagtactcaggaagagcgggctcgggattttgaatataaaaccagttggcgtgccatcctttgtttgaagtcttgaaaggcatggagaaatacttttggctcagagtgcctctcagttgaaatccagcccctccaactacgcatggtttgtttttgttcggttgaggcttaaggaaaaatattcggcggaacagagcaaaatgaggtctaatgcccaaaaaagcttcgcagacatggacgaaatttgcaatatggactatggagttcggattcaaatgatgtaagctgattccatagaaattcagtatcccacggaagaactttgaggttggaagagcaaatccgccataaaagaaatgagagaataccacgacctcgtgtgtatcgggggttggaaaggcttcaccgcacgctggccgccacccgatgatctccttgccagggagaacgccgtgcgccaccatctccttcaggttttcttccgtcacgtcggacggcgcccattggccttcaaagctttccttctcttccgccatcgatttttctcaaatgcgctgatttgattcgagggatggcttgggagaggtgaggaattgaggcggtggatcacgggaaggattttgatcacgttttgaaggtggatttgggtggattggtgaaccctagttcgccggcgcagctctttactgtagcgtggagtggggaaaatggcgagcgttccggcggggaagacgaagcatcgcttggatctcggatttcttgttaagggtatcggaagtgcaaatgggcctaggcctgaacagtacctcagcccaatacttttaacagcgtggcccattgtgttccttagggacttaggcattttttgctttggcaatttatgcgcacaatagtgttgcccaatgttgataaaatcctttttatgcggtcatataattctttagaattattgcaatgcagattaaaaggtgcctgacagaaaggtgttatactgctttttgttagctttattaggctacaaaagctgtcttggttaatttggaatgacttatttttatcatagtcacttccttggtatgttatatacctattttcattatggtaaatagtcatagcctaggctattagacttattcattaccataatttttataatacttggtgggtaatctttagaattttatattcggatgtctatcaagtgtgttcattcgtgaaccttttagagtgttaaccactcggatttcttttattatggctaaaaagcagtcggctagaatgcctctttaggcgccgcgtatgcttttgccatctgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttgacatgaaaagtttgaagcactcggactatttttgagatggctacgatggctgactgcaaaggtctcgggggctactgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagattcgacaaacccgaagttcgccgtcgcgttttgatctccggcgaagccctgctgctcctcccgtcatcgccctctgtcgccatcgactccattggattcgcagctgcgaagtgaagcccggccacccctccgttgtcgccgcacatcgccggaaagttgtcgccgccgtggacagtacctcgccgccctttgaagctcgtcgccggccatcttccgtcgctgtccgtcgtcgcgtaagtgttggtaagaatcgccgttgcctcctctttctcccggtgccctccgattgcattatttcgtcggcaatcgccgctcctttgtcgttcaccggtgtactttatccctagggtcttaattccatctaatctaatcttgtttggtcctagcgtcgagccggtcattgccgtgcaccgtacccgctgttgtccgctgctagccgccgcgtagccgttgccctagtgcacgttctgcagtcaccgcgccgctgtcgtgcatcgctatcggctgtgctgtcaccctaaccctagctttgtgtttccgctgagctgccgcctagccaagccaagtcgccctagtgccgccgtgtcgcagctgtgtgccgctttaacctagccgtcgctttagccgttgctcggtagtcaagttgtctagccgtaggtgcatccctaaattcctaccggtctatcgtttgtcgtaccggggcttttctgtgaatcgtttctagtccaccggattagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttaggtgatcccgtgtcacgtagaattgactcgttgagtcggtatctcgtgaggcccgcttgccagatcaatccaagccatccgatcttagtcgactcggtcaatataaatcctctcctcttttcagtggcatattatttctttttaatatatgtcatctaccaaatatgatccaatcttttccggaggttgctttaatcttctgtctcagctataaatcatttgtaaatgatttaattaatttggaatagtctccgtttaataggtttaattggaattaaatcttgtaaaattcataataaattcatatgaaatcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgtcgggagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttaatccttgataccttgggttattataatttgactagttgagctttatatattggttcagctagatattagatgtgattgcttagccatgcttagaaacattagcacactgttgggataacttatgattcattattatttaatgatggtttaatggtagctcacgatggtcaatcgtgattgg

SEQ ID NO: 15379 - DNA, 2480 bp, Oryza sativa
ctattcgaatagccgtgcccgcgggttatgggcgagttgagcaatgtttttcgtgattagtcccacacctctcacaataattatggatgttatacctgataataatttgcttagctcctggtttggagattagatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttatatcccagttgagctgcctgtgggagtggagccggagcttcgctagattttatttttccgctgcagttttcttcttgatgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggacaaattttccgaaaacatgatttgtgaaaattttcctttcttccttctctagaattctctataaatcattttatcatcctctcccctcctgctttcaacttgagtagttctaaaactagttgttgaaactagaagatgttaatgaggtctacttatggaggtcagtcaagtggatcgagaaagaaccgaagtgccaagtggtcaagatggaatgaagtttggatcctaccttagaacctatgccgccaaactatccttgaagaatagttagtagggtagaacgtttgttgcttgcttgtgtgtaggtatggttgcattcccgtcattggtgtggttcaatgatgagtgtgtaactatactaggttgcttgcttaatcaacttgaacaatataatggtctacacacaccagatcagtggtaacatggttaaggtcttaactttagcgtaacccctctccttctatcttctctaatctgcaacggatggtgaacactcgcgccaataaaagtggaaataataacaatgaagggaacccaactcttgctcaagttctggctcaacagactcagttaatgaacatgatgatacggatggagatggacgaagtcgggggtcgatggacatctctaggacaaatgaaggctacacgagctgcggcccggtagtcgagatgtcatggcacagggccggtgtcctgctgctcggggctcagtcctgcctacctgtcccgggggtcccggctgtaggtggggttgggtcggtactcttgtctatggctaggatgggttggaagctatgtcacgtcttccgtccatataccgtggtggtatgtggcacgtggttacacgtgaggaagaggtgtcttgtgggtaaagatgtacaccctctgatcagagtataatctattcgaatagccgcgccctcggttatgggcaagccgagcaatgtacccaagttagtgttttaattcttaaaacatgcttaacaactaaaatgtggaatggttggcctgggttagcttgggacgagctgggacccagggtcgggttgctagttcggtctgaatcatcgtaggccttgggttaaggcaggttcgtgtgggttcacggccttgattaataatattgtatagctctagaatcgtgtttacaaaatagctttgagcaattaagtgtcttttaatgctgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaagcgcctatggtcgtcgccctagtcttctgctgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaagaaacgcccgttgggttaattccggtcgtgacaggtcatgcaacaaatcataaaattatacatcttagtgaatcacaaattgaaaaaaaaaaaaagatgccggcagcggctgccgcctgccgccgctcgccactgggcccgtgcgcggcccagccggccgcctgctgcgtgggaagggaggagggggaggagagggcaggggatgggtggggaagggga

SEQ ID NO: 15380 - DNA, 1362 bp, Oryza sativa
cgcagacatggtggcgaggacgagcagtcgtgcgggaagcactccccaaaaacctgatcacccgcctacccggtgcagatctcaggcgaaggtgtgattccgaaggccctgctccttccgatctctcgtgcgtgcaagcgattagaagcgagaaagcgagagcagcacaggcacggaggaggaggaactaacacccgggaaagaagcaagcgaatcgttctgatcggactcgcggcctccttatctatcaggagagaggcagtcggcagtcgtgggaacgtgggatcgtgaacgtgccgttgcggaggcagttgtgggaacgtgggttcatggttgcaaaagtgtagcgccacgccacgcctagccctcggcctcggcccggcgcgcgcgcgcgtgtggctttccgacccccacctcaaccagtcaacagggggcctccaataactccctatttaggttaagatattcctcgcttaaatcctgaggtggtattattatccttaacacttattatgggcctttgagatttaataggataaattgggcctagcccaattattctaacaatccccaccaaatttcaaggctcataagaaatgttctcaaggttgtgcctatttgatataccagggttttggtggagactgttaagttgaacttccacctaggaaatgagctacatcagaccacaactgaacaatggactatgccttgaattgtcagttttgtgtgattaggtttcactcagacccttgactggtactggactgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaatatctctgcttggaaaagccactcggatcacattaaggcatgagtcatcctaccatgtaggaaagaaaagaagtacatcatgaaaataagcccttttcaagggtctcttctctcagtcacacaatagtttgttttgccatccaaattcatgggatctccgatcacaatggacaggtttccactattgtgcaaccttaggtgggtatcaagcccatttccctcgatgcactgtctatcacattacgtggtagccccttgataaactgatctgccagatttctagccgtttggacatagtccaatgctacactccggagtttttctgctttctgacagatttcagtcttctcttgatatgcctagatgacttatgttgtcctttgaactgttcactttaataatcactgtttgactatcacagttcattaggatagctggccctggttttt

SEQ ID NO: 15381 - DNA, 621 bp, Oryza sativa
tagtcccggttggtaacaccaaccgggagtaaagatcccgggggcctgacaaggtctgacaggtctagaactgggactaaagatcatctttagtcccggtttttagtggaatcgggactattgtggatttcggccgaccgaccaaagatggtttctccaccagtgctttattcaaattattgttcctggtgactaaggctatacacaacatggagacgtgcagagtgcccttgactctccatgttggtgatgatttcacgctatgtcggtcaagtgagtgccctagccaagatccaagtgccctacagagggcacaggtgtctcggcgggactgaggctactcatcgtcgaaggcatggtcgcgaccgtgttgtgggagaggccatgatcctcctccctttgcatgatttgttggtgacattctcttcgcacgatttgtaggtggtattcccctgaaacgatttattagttatatttccctcatgtgatttgtttggtgatttggtcaaagaggacagaggcggcaacagagtaggggtaggcgactgggaggggcataccatgaggcccttgtcacaacccaagatggaccggcaagctcctcttcacccgatctacact

SEQ ID NO: 15382 - DNA, 22857 bp, Oryza sativa
  unsure (1)..(22857): unsure at all n locations
atcataaggagtaggagttggcttgcagtcactatatccaaagcaactcaaaatcttgtccacatagtgggattgcacaagtgtaatcccactctcatctcctctttgtagtttgatgttaagaataacatcagcctctcccaaatccttcatttcaaaactcttggacagatagtccttgacctcctcaatcacattgaggctggtcccaaagatcaatatgccatcgacatataagcacaagatcactccttctcccccactatagcgatagtacacacatttgtcagcttcgttcacaacaaagcctgcagatgtaagcgtggtgtcaaacttctcatgccattgcttaggtgcttgcttgaggccatacaaggatttcaacagtttacacaccattccctcctaaccttctagtacatacctgtctggttgatccatatagatctcctcctccagctctccgtttaggaaagctgtcttaacgtccatctgatgaacgagaagaccataagaggctgccagaacaagtagttctcgaatcgtggtcaagcgagcaactggtgagtatgtgtcaaaaaagtcctcgccttccttttgggtataacccttggccacaagccttgtcttgtacttttcaattgtaccatcaggcctaagctttttcttgaaaacccatttgcatcctacgggcttgcacccatatggacgctcaacgacttcccaagtaccattagacatgatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttcttgactagaggtgctaggtgtatgtttcatgggaaattcattctcaaagaatgtagcatctctggactcaaaaattgtaccaatatgcatgtcgggtactccagagtttactattaagaatctataacctacactgtgaatagcataaccaaggaacacacaatcaacagtgtttggtccaagtttctgctttttggctataggtacatttaccttggccaaacagccccatgttcgcaggtatgagagatttaatttcttcctttcccattcctcgaatggtgttacttccttatgcttcattggaattttattcaggacatgacacacagtcaaaactgcctcaccccaccattccttggaaagccctacagtgtctaacatggcattcaccatctcagttagagtacggttctttctttcgaccaccccatttgattggggtgaatagggaggcgtcctctcatgaataattccaaacttttcgcaaaaggatgcaaactcattggaaaaatactccccacctctatcagacctcaaccgtttgattttcctttcaagttagttttctacctcagctttatagatcttaaagtaatgcaatgcttcatcctttgttttcaatagatacacataacaaaatgtagtgcaatcatctatcagtgtcatgaaatatttctttccccctttagtcaacacgccgttcatttcgcacaaatcagaatgaacaagttctagaggtgccaaattcctcgcctcagatgtcttgtgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatctttctcgctaatatggttcacaacattatgattattacacatgtcattcaaagaaaagcggaacaagcctccgctgtcataaccttttccaacaaaagtcccatatttagatacgacacatttattggactcaaacacaagtctaaaaccttctctacacaatagagagccactaacaagattcttctttattgaagggacatgctgcacgttcttcagctgcacggtctttcccgaagtaaacttcagatcgaccgtaccaacaccatgaacaaccgcaagcgaaccgtttcccattaacaaggaggaacctctcccgacctgataagaagaaaacagagaaatgtcagcacatacatgaatattagcaccagtatccacccaccaatcaggtgagtgaaaaatagagagaactgtaggtaatattttaccgtacaccgatgttcctccgccctcgctaatgaccatgttggcagacttcctgtctttgcgctcaggacagtccttggcccaatgcccatacttaccatacacaaagcagtctccctttgcctttcccttgcctttcttcttaaagttggttgcagccttgggtttgacatcagacttgactttcttgttgttgtgggatgcatgagggttcttcttctgtaccatattggcactagaacctccctcaacctttttgccccggacgtcctttgccctcgccttctcctcaacacccaaagagccaataagatcagaaacactgaactcttgtctcttgtgctttagagaagtggcaaagtccgaccaagaaggtggcagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggtgtcagaaactccgaacttggcctcaagtgcatcccacatgtccttcctagaaggcatgtgcatatacacgtccactatgttgtcagcgagtacactgatcaatgctccacagaacaggcaatccgaagcctcgaaattagcctcctcctcaggagaaagaggtggttcacttcgtttgccccgtgaaacatagaagcattgcatcgctgtcaaccacaatagtacacgtgctttccatctcttatagttagaaccatcaaaagcatgtggtttcagtgcagcagcaaagccaactaccgaaaataacctatcaggtttttggattgttagaaatatggtcataaatcggcatattttaatccaaaatgttaagacaataatcatggcataaacagtgtagggtgatctagtgacaacatgtaacataaccagtagcatactaatggcatcatgcgcattatgaatatcaggaacaagaacatagcagtaacgcagtagcatgctagagacatcatgaatatcaggaacaggaacatagcagtaaagcgctaacaacgggaacaggaacaggagaaggatataccccgagaatggccctccactggattgcgaggcagaattgactccgttggtgttgttgttcgcggcacaggctccagctcctggcgcaccacctccagctccagctcctggtggcgcaccacctccgccatctcctccagcagcagcagcggcgccggctccaggcgcagacatggtgggcgaggacgagcagtcgtgcgggaagcactccccaaaaacctgatcacccgcctacccggtgcagatctcaggcgaaggtgtggttccggaggccctgctccttccgatctctcgtgcgcgcaagcgatcagaagcgaggaggcgagagcagcacaggcgcggaggaggaggaactaacacccgggaaagaagcaagcgaacgggaaagaagcaagcgaatcgttctgatcagactcgcggcctccttatctatcaggagagaggcaatcggcattcgtgggaacgtgggatcgtggacgcgccgttgcggaggcagtcgtggtaacgtgggttcgtggttgcaaaagagtagcgacatgacgtgacgcacgcccgcccggcccggcccagcgcgcgcgcgtgtggctttccaacccccacctcaaccagtcaacagggggcctccaataactccctatttaggttgagatattcctcgcttaaatcctgaggtggtattattatccttaacacttattatgggtctttgagatttaataggataaattgggcctagcccaattattctaaaaatggctaaggatgcaagcgggacgggcaagcgggttttttacccgcttatctcacttttagtttatttttcttctaaaatttatactactatgtgggaaatgaactagctatcaagcgggttttttcgggtagcgggactattcacttgcatcctaacccatggctagatccagtgagcttgatggtgatggccatggcatggggagggacggtgggtgtagagattgaagggaaaggtgaccaactccactgaagcagctcgatgacggggagcttgtggtcaccgacagccgaagaggggtggagatggcgtcacgccctgtgggagcttgcagctggagaaggagaagaggcagtgacgatagtgtaaggagaggcataggcgtgaagaaaatgagggatttagggaatgagaagggaaggagagggagaaggagaggggaaggaggttaaaggtattttagttgatttgataataaaataatgctattatagggattgatattaaaaaattggctaaaaacgaaaatgtattaggacggagggtccattgatctttgatcatgcctaagaaggaattttttttttttgacttagagataagctcgtaaataatttgaatgcgcaacggatagtgcaacagatagctcctttatactaaaatataagcacttccaacacccatgtactagtattttattctattaatcacttttccgtactaatatctaatatcatttctcctcaatttttatctcttctaccacctccgtcctataatataaggatttttagaattagacgtgggtattaaaaaagtgggtagaattaaatgaaagaagattgtgtgttgtcgaatgacaattgcgtttgtcaagaaacttggttcactcttgattgaaaagtaaaacaatgtgtattgatattgcattttgttggtatgccacattatatatcccttggggtttatttatagtcttagtataaactcatgcactctaaggctaataaatacagagaaatttacatgtatactcttgtgatatagatatatataaaggtagttgtagataatttagccatggacttctcagtgggccataacatgggcctaatttgacgaatcagcccctacaggcatagagttctctacttctgatggcaaaggcgcttggctcagtggcgaatgcttccatcttcacccaatcggtatttcactctggtgctttgctttggacagtggcttgtttcggcagactcggttgaaggcccctgtaacatgctttcaacattgtaattggttgagaagtggaggtatgtgaaaagattgaatggcggagggctataattggttaggagtagaatgttggtcgagaaattgttatattttaggacaaaccttgagagttaaagttattatgtttttagacagagggagtaataattaatctataaatcattaatatattttaaaatagatggagtagtatgcatgcgacgttgggtcatcttttctatattcatccttgaatctaatgacaagtctgtgaacatactgaaacatatactcctgacatatatataccagtactacgaatctaaacaagtatgtctagattcgtagtattagaatatatcacatatatgtcacattcgatattaggggcctgcttatatcccctgccaaaattttacaccctgtcatatcgaatgtttggacatatgcatggagtaataaatataaacgaaaaaataactaattacacagattgcgtgtaaattgtgaaacaaatcttttaagtctaattgcaccatgatttagcaatatggtgctgcagtaaacatttgctaacgacgattaattaggcttaatatattcatctcgcgatttatagacggattttgtaatttatttttttattagactatatttaatactccaaatgtgtatccatatatccgatgtgacataccaaaatattacaccctgaatctaaacacagcctagcctaggttagttttctacataaggaaggtagtattctgttgagatgatagctatatattttaaatacgagggaataagaaaataaataaatagtaactgttaaatagtgttagaaaatgcagttaggagctactttatgacacggacagagacgcggcagggaccacgcctcactctcgcttgctgatgaagcgcttttaattccattaagacggacaacagaccatagtacggaataagagtccatatttattacactctccgtcacattattactatctacatcttaacatataagagattttaaatgaataacatatatttgagtactacaaattttgatttacctctgttcagatttaaactattaggatgtgtttcatccatccaaatcacatatattttataataaagggagtagtaagttcgaagtatatatatatgaactgctcgtaagtactattgtaggatattatctttgtaacttaatatagaatgggaacgcattctaatataataagtattacaaatctacaaccttcgtccagaagcgctgtaatactggacagatatttgtctagattcattttcaaaagttggcttattttggatggagggagtacatagggattgtgtagactcatgattagaatgtgtcttatctcgtactgaattgttatattttaatacggaagtcatatttaacatgttaggtaagctgattagatcacaataatattattggacatgactacacagcgaccggtctctgatttgcctaaagcagcgatcactccatcctagatttaaatctccttttagcttaaaaagtactatagtgcatgtttttttacctctttaatcacttgtatattttaaatcacatattatttttaagatctaatctatttgcatcattgtactctacttaaaatatgtgacaaaacgagatccatgttgaatatattaaaacattttattattttaaaagtaatttatttacattgtagaagtaacttagctatgtaatagaagtaactctatatagcattaaaagtaattacattatgagtgagttccaataagaaactacgtggagtaaattcaaaagtgtagagaagattttcatgtaaatacatttatgaaagtaaatttaataaagcctgaaagtaatttacataaatcataaaagtaacttagcataaaataaaagtaagttgttacgatattaaaagtaaatttgtcataggaataaaaaatataaatctatttagaaattaaatttaatcagcaaaaattatggaattgagtaaaaacaatcaactcaaagcattacgaaattatgagaagtaatttaatcaaatctaaaagtagtttttatataagataaaagtaacttacctatataataaaagtaatttacaatataaatgttttttcatcataatattatcatgtaagatcttgttataaagatttaattgcaacggacacaatggtgtaatcggattatatatcggataagtaatttaagagaaaattttataagaagaaaaaaaatatgcacaacctaatagcaaaaactacttgcatgcatgtctgtaacgctactagtacttctcacgtaattgtccgcgtcgctcgttaagtctaaatcgagatgcctctcgaaatagattttgcgtaaattattccctcctccgttctaaaatattttaatacagaagtagtatttagcgtgttaggtaagctgcttaaaaaaattatgtagttataatttattttggtatgagttgttttatcacttaaggtatttaaaatttttgaataagacgaatgatcaaacataaacatgtgttcaaaagtcaatggtgtcatcgattaaaaaccagagagagtagatttcaggacagagggagtattaaattagacacgtgtttgttatcattttttttgaaacagttgacggtaagatttctaccggatatattagaagaaaagagtttttacctaaagggggagagagttcacaaggcaacacctccaaggaggaaacagcacccgcatacatcgatgtcaccgatcctgtaagaccagacaaggatttcacccaagactgtcgccgatcctgtaagaccaggcaagaatttcacctaagactaccttaaaacgtgtagaaccttcaagaaacaagagcaaaagtgttgagtgttatcgttgcccaactcatcggctgacccgatgcagcagctccgactccgccttaacacgaaagctcaagcaccgtagagaaaagcacaccgctccaaactcggcactaagacagatccacacagtcacagggctcttatgcctcgccagtgctttgttatcattttgtaccatgtcttttgggcctacggtgtacattactacatgtggagcgattagcagcagccatttcgtagttagaatagaagaacacactcttgaggctatcagcaaccagctccactgctagctccaggccggtcatggcggcggctggtcacgatgtgcagctcccccacgtcgccatcttcccgttcatggccaggggccacaccgtcccgatgacccacctcgcctgccttctccgccgccgcggcctcgccaccgtcaccttcttcagcaccccgggcaacgcgccgttcgtccggggacagctcgacgacgacgtggccgtcgtggagcttcccttcccggaccatgtcgtcgcccgcggcgccgcggagtgcgtcgaggccctcgactccctgttcccccttccggcgttcgtcgaggcggtgtcggcgctccggccggggctggaggtgtcgctcgccgccgctcggccccgcgtcggcctcctcgtcgccgacgcgttcctgcactgggcgcacgcctccgccgccgcgctcggcgtcccgacggtggcgttcctcggcgggaacatgttcgcgacgatcatgcgcgacgtgatcctccgcgacaacccggccgccgcgctgctgtctggcggcggcggcgccgaggcggcgacgttcgccgtgccggagttcccgcacgtccacctcacgctcgccgacatcccggtccccttcaaccgcccgtccccggagggtccgatcatggagctgaacgccaagctatggaaggccatcgccggcagcaacggcctcatcgtcaacaccttcgacgccatggaaggccgctacgtcgagcactggaaccgtgaccaccgcgccggccccagggcgtggcccataggcccgctctgcctcgcccatggcggcaccggcaccggcaccggcgccgtcgagccctcatggatgaagtggctggacgagaaggcggccgccgggagagccgtgctgtacgtggcgctcggcaccgccatggccatcccggacgcgcagctcagggaggtcgccggcgggctggaagccgccgcggccgcgggcgtctacttcctgtgggccgtgcgccccagcgacgccgacctcggcgccggcttcgaggagcgcgtggaggggcgaggcatggtggtgcgggagtgggtggaccaatggcggatcctgcagcacggctgcgtgaggggcttcctcagccactgcgggtggaactcggcggtggagggcgtcgccgccggcgtgccgctggcggcgtggccgatgggcgccgagcagccgctcaacgcgatgctcgtcgtcgacgagctgcgcgtcggggtcagggtgccggtgccgacggcgatggcgacgggcgggcacggggtggtcgggagcgaggtgatcgcgcgcgtggcgagggagctgatgatgatggccggggaggggaagggcggcggcggcggcgaggaggcgaggaacgtcgccgcgctggcgtccaaggcgcgagaagcggtcgccgagggcgggtcgtcgtggaaggcgctggaggagatggttgccacgctctgccgccctgttgaaggagatacaccgaaacccacaaaataagtttatttgtttctacgtttgaccgtcatcttataatctatctatctatctatctatctatctatctatctatctatctattattattattattattattattattattattattattattattattatatactaaaagtccattaaactttctacaaacgctctcaagccaccacgtggcgctcctacaaacgctcctagatcggcaagtggcgctttaacatcctatcctattattatatactaaaagtccattaaacttcctataaacgctctcaagccaccacgtggcgctcctacaaacgctcctagatcggtacgtgggcgctttaacatcctatcctatcctatcctattatcctattattatatactaaaagtccattaaacttcctacaaacactctcaagccaccacgtggcgctcctacaaacgctcctagatcggcacgtggcgctttaacatccaaccatcggttttcatttaatctggtgaacccattatttttaaccattggatctttattttaagaaaaaacaaatcaatctatctaaaaaatcccacgttactcggccgtgtcccctgaacctgtacgtctgtacgtccgatgtacgtacatatcctctctatgtccttttctttttccttgttatatatttagattagatgaaaaactttagttcatgttaaccatatgttttaagttgtaaaaatatatgttattttaagttttattctaaatagtgcatctcatcgaaatatccataaaaaaatattaataattaacattatagactatatgattgtatatcacaattaaattggacttataattaaaaaaacaatttaaattttgagtagcattttaaaaatttactcactccctatcgtgtaatactgatatatccaaatgacattattaaatttatcaagaatgtatttttcatatattatatgttgctgtattcatatatttttttttggaaaattaacaaccatatatattttttacaccatgtggatgtccttttatctcttaggcttcattcggtctatctcattggatgaacttatctaggatacgcgaaacaaagcatgccatcagcgtaagattaattaagtatcaaatattacatatcacatgcttatctaagaaaatatatatagaaaaatgattctatacacccaggagtatgtactgtgtatatataagggtcatcctatatataaaaaaacaaatctagctacttatttaaacataacccgtggatatattattttcaaccattattttatatctattcgagtaatccttcattatgtacgtacgcaagagatgtcataaaggaaaaaaaagaatgtgtacaagatcagctccatcgagtagttttttttttctttctttgcggctctgagattttcctcaaattgtgcatatgagtagcgaccacccttggcaagtttgtcaaagaattcatgcggccgcaacaccgcttcacgccatctcgctaaattttttgaaattattttttactaatgatggataaggcaatcacgtttccttaaaaaaagcaatcacgagcgcatatataaacgtgtgctcacccatcatataaatacacatacacacacctaccctaagagaaaaaatatttgtctccaaaaaagaggaaaaagtatgtgcttagtatttgctagaaaaaacatatacacatgtcatcgaaaatgtcgcatagaaccacattatatctttttaattatgtcattctcatctatataatgttaataattaggacaaataattttgacaatatagattattcaatcgtatattacccatgaacatacataggtaaatcagatgtataataaaagaaaaaacaaaacaaaaaatatattagcttatatatttgtgaacgatggtgagagatcagattatatataaccgggacaattcgtaccgttcttattgtttaagggtgtaatcagacattttccttaaaagtcttccacataaggatttataataaaaaattaatcaacactaaacttcctacaaacactcctaagcctccacgtggcatcctataaatgctcctaagccgccacgtggcactctaataaattagagaaattcttaaaaggacacaacgtataatcattaatttttattaaattttgtagaccattatttgtaaccattagatttattagaaaaaacatatacgtacgtctgctcacccccccctccccccaaattctttcacccctttttttacctattttttatcctattttcatgcttttagaaaagcaaaaattgtatgccaaacaattaggaaatgcagcatctaaattataatgctaatatttgatctgcttatgtctttagatattttacattttaaaactcatgtcctcttttattcaactgtaaagagagaaatgtcacattaattggggatacattttctgacttttgcgtgtcatttaagcaattttaaaactataaaaattaatgatatatatttttgtcatcgtatataacttgataataattaaattagatctaataaaagtaaataaaagtaaaatgaacagatctatgagtaatattaaaaaaaataccccccccaaacattgtaacacagtaaaaaatacgcatcttataaatactcctaagatattatgacgttctcttaaatcggagataatacactcttaagatattacgtcgttctcttaaataagagaaaatcgtaaaaattctgacaagaaaacaaaacattcgaccatcagcttcgacttaaacatctgacataattttagtttgttagattaatcatttagaaaaagaacatccgaaatgtcccttcctccctgctcgcgtacagcatgcgccattcttttctctctattttttaaatctccttagcaactgaaattaaaattatctatatgtaaaaaagacacaaatggacctccatctattacttatatcctgtcaggtgtctaacgactttctactaacttaattaatttctcttaacatacctatgagggctatgtacctatataaattgaccttgatacttttaaaatgatctttttaggagataaataaatattcataagaaagatgatcatagcatcccaattacacatatgatctatgaagtcactaatcataataggtattcatctagcaatatagacaataggttaaaaataaatgtgtggccagttgaacatcataccgataaacatatgggttgcacctaggaatcttaacattgaaacaaccttgaggcctatacaattaatcaagtcaattccatataggaattaaaaaccatatcctttttttctaatttttggtaaaatttgctacaatatattgtaaagtcttgacgtagaacaatctagaaatgtgtatttgttataagacactccactttagtgatgatttgctaaacacactataaccattacttcaatatttcatgatagaaaaatttagaacgtatgcctttacaccatgccatgttatacgcacttatattttcgtcccaaaatgcaaagattgaatcatttcaaggatgactcgtagaatgaaaatctccaaaaagaaacaaaaaatggacatgaaataaattggaaattgagcaaatgttgctagatttaaaacccactgtaaatagaaaaattcaaacattttacgagttctgtttgaatgaaaaaatatataaaaattaaaatacaatcaatcaaaaaattgatattattggatatttttgggttgtaagatatcctactggggagttaaatatccttaattttctaataggaaccacctcctttgtttcgacacaatattttctcatcaattcgaaaccgcatgttctgaagtaattttattttagaacttaaatgttacaagggtaattataagaaaataatcagcgctcaaatcacacaaaatacatttcagtttataatataataaaaaatattttaataaacaacacccacacataaatattcataataaaatttcactcattatataagaaggtgcccgcgcatgtgcgcgggctatctttctagtttataaaaacaattaaaaataagtcacatataaagtattattcatgttatgtcgttcaataataataaaaatactaatcataaaaacatttaaataagacggatggttaaactttgaacataaaaacctagtaatgaattttttttttatgtttgctggttggaactcaatgtttcgtgcagtgattgttagtattgcagtcatttttttctggatgttgcatatttgtaaaacatttcataaaatggattgaaatattttgaccaagtgaggaaacaattttatataagtgatgaaacaacactcaatttttttagacatatattttgacatcaaaatataatcgtgtgagatcttgttatgaagatttaattgcaatgaatgcaaatgtgtgattggattctagattggataagtaattacaagaaaaaaaatcaatgtaagttattttaacatatttgtgttacaagtaaaagaagcaacctatgagttaagaatagataagaaaaaaaggccacgtggccactttggactggcaacttgtagcattatcgttatttattagtataaacacagaataatctgcaagcacataaatattattgtagctttcatccaagagtattatagtgtatcatatccacatggaacctagtcttctaactaggttgtccaaggacactagataaatggtaggtgagggtagagaggaattcttatgtgttacttatcttagtttaagttaagataaaactctatcaactagttcgggcaccggattacccttggtttgttaaggagactccggcctatagctctatgatatacccgaacgtgaaggattacgaaagacggacgggattgtcaccaccttccgcctacctctacaactcatggagcacacaacaaacaaagttaacttctaggctagacaccacgtctatgctatatattaccctaatctctgtaccacgcttaagattatggtactcaacctaagcagagcgatgaacccacaacgatgagaatatatcttacttaaatatgaaaagtaaatatcatcaagaaataacaaaacacttactcgtattaaggcaaacgtctgtagaggtacaagctaggataagagtgccaacagacccaacacttccccaggagaagagtgctgatagccctagcaattctctagacttcctctatctccctactctaggcactagctaagtagagcttcacttttagaatgaatcatatgatcttctatcttggtgtgtcttgagaatgagagtgtcaaagtgacttgagagagagtggagatgctaagagaatattctccctctatctcctctcaagcctccacctctcctcaaaccatcattcgatggtggtttcctgccttaagccttgcgccactgacttaaggattatgataaccgtcgccacgtgaagctgggcaagaggggagccaccccaggttcggcttgcgccgcctttcacctgggtcgctgcctagtgggcacccaagttggtttggggtgtatggatgaagttgaggcagttctcctcctggtgtggactatttgatccctgttctctcctctatttggttggagttgtgctttctcttaatttgcacaagtaatcacctgcatacaaatattcatcaacacttgtggaagtggttagtaataaaactgtaacatcctgaaaattcccaacaataaaaatcactaaaatttcgaactttttaaaactttttgcatcatgctggatgttatggttgcttttatttgccaagctataaattgtcacaatggaaaattaaactaaagttatacagctaagtaataatcataataataagatattattatgaaccctataaatatttacgcacgagaaaacaaagccagacaaagggaaggttaattaccaatttaatttatagatcaaatattaaatacttgaaccatgaaatataaacacttaggaaatgataatcattcaaataaatggaactctatctatagagtagttttactgggaaaaattaattagatattatataatttgaattgaatcacaaatgctaaattatagaaatccatgtggtggtaaaaccaatccaaaaagataaaccaatatatgtgaaaacatataaataccaaaatcccaaatatagggaattataaaaatctaggatatatattaaatattggacaatattaaattttgggaaaattcacatttgagcacttaatagggtcacccaaatgcttaggagtaaatacaaattaaaataaagattaggtggatagaaataaataaaatattatcgcgaccatatttggatcaattaaatttaagtacgatggaataagaattaatcctaattaaaactcaaataaattatataaaaataaaatatgagtaatattaatctagggtgaattcattagttgagataacacaaatattgagtaaacttcatttatgcaagatttagaaattatagaatcaaatttatatggaaaataaactgaaatcgggataaataggaaaatacactgttcattatggcgtaggtgttcgatgtggtccctagccttccccctcctctcccacctctgcccctagccgccccgagccgcgccatcgccgcctgccgcgcgcgcctcgcaccccgagccgtcgcgccgctgtcccgacggcccgcgcgcccacgcgccccgtcaccgcccatcccgtcaccgcgcgtcgccgcctcgcgccccgagccgccgtgcgccgtcgccatcgtcgcctgccgccgcgccaccgtcgccatcgccatctcattgccgcggccgcgccgtcgccgtcgcgtcccgccccgcgccgcgcgtgcatcccatcgccgcctcgcgccgtgcgacaccactgccgcgccgtcgccatcgaagtcccgtcgccgcgcgcgtnccatcccgctgccgcgccgcgcgccgtntcgtcgcctcgcgccgcgagcccgccgtctcgcgccccgtgccgcgctgatccctcgagccccgtgccgccgctgctaccgcgccgcgccgcccgttccatcgccctcgcgcagtcgccggtcggccgtcgcgtcggcggatcccgttcctcgcgcaccgcgccttgccgcgccgcgtggtggtcacatcgccgcgtcgagccccacncggcgccaccccaccnacnccatnagacccccgcccctcttccctcttccccattatctctttccccctcccttatataatccccccctaatnccactctttccttccatcctcacctcctctcctctacccactccaccacgccgccgagtcatcgcatagagccgccgcgccgccactttcggagccgccgcgccgtcgccccggagccgccgcgccgtgcgtcgccgccttgcgccgccgtcgccgtcgtcgccgccaccgccgccgccggtgagccgtctttccccctcccccccttcacctcgcgcccaccgccgtcgccgcccgcggaggcaaagaaccgagagagaaagagagaaaccgagggagggagaagccgaggaagagagaaaggagccgggagggagaaaagaaaaggaaaagagagaaaaagagaaaaagaaaagggaaaagagaaaagaaaagaaaaaggaaagggagaaaaaggaaaaggaaataaataggaaattagagggagtttgaggaagtttagaaaatttaaaataattagaatttaattatagattaattatagtcgtagaattgcaaaatttaatataaattatggattattcttggtaatttctataagaaatcaattcgcggtagtaaattagatgtaattaataactagacaaatagatgaattattatagattatttttgggtaatccctataagtaatcgattcacggtagaaattcggatttaattactagggattttagccgtgtattatatttaatcatttagtcataaactaaattaaatcgtataatatttctagaatttcgtccgatatttagctcatgatagaaatttctaacctattatatggatataatgctcgggaagattaaattaaaacttatgacaacgaaataattatacccgcaaaatagcttaaatcgaaattgggttgccgtagttcgcagatagtaaagttaataaaaaggaataaacccggggtcccacttgtcagttggtacaaggctgtggatatgtcttggattaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactatttaaaaaaatatatttataattataaattaattaataccaaatgattagataatagttaacctaaatagtgtgccaatgaataaaaatggatattgtacagtagcataattatctttaacatgtcttgtcactgtagcaactaaataaattagttataatcaatccttcaaattaatgggtgtataggaaaatattagtgccatttactagtctatgtccaaatataactaaatccatgacttataaattgtttacataaagtttagcctcatattttgtaactaaaatatcaacacacatagatgaatctttaacttgtttaggagagtaatcacaaagctagttgtatttggaccacttaaaaatttgtcgatacaatgtcatgtgaagtagaatatatgtatatagtgggtcgatatccattagttaaccaaacagagccatcttaaaatcaacatgtattgtatagcttacagtaaacagcaactactcaaatatatgatccaataataagatattgttgcttacacatatactatacatcccattatagtggtacggtatagtattaatttgcgtgttgcatatattaaattaggagggagtgtatgacaaacatgtatattagataaatactagttataaatcttgaccttatataattataattatagttcaactgtaaattaggattattcattgtaaaattatgtgatgggataatctgtagccataatatgattagcctaaacaactttaacatatagagcatggataattattaaccttttataatttattgtgacaagtaaaatatgttcataattaaagtaaagcttccatcaataaaataaataatacaaatgattcactgtaattatttgaatgatcctaaatccatctaacaacagaacctctagtatataaccgtcctatttagatagatgcatgcttagccataatccttccataagctatttgatagactaaaccaccgattagccaaatatatatgtatcccataaatgctatgttggttaactcctaaataggccacgttgacaatagaaagattaagaaaccttagcccctagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcctaattgcgagattgttttgtttacaaataaaatttcatgcaatgatgaacatcctacttgtgattatgccatgccttgattattgtttacccttaaaatccttgtaaccatgattacgtataagtccctagtcaattatgacaattgcttagaaatgtcattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacaatgggacagccgttgaggtagggccgagaggcgtgccctacatcggtgtcgccattggtaggactgccatgagtgtgtgagagagagaacttaacttgaactataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactacagtgtgagtaaaccaaatctattcgaatagccgtgctcgcggttaatgagcaccgggacatgtattacacttggctagactctaaattcttaacttgtgtgggatgggatattgcatggtgatttttatgctgatggagccacttcctgagaggaagggaaggtggacgtcctcagaaaaccatgacgactcaatggcgggaagctatccttgggatcacaatggatggtggacagaaccgttgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagaagcccttgtcggtacgcttgcgtatcccacgagatgatcagagtgcggtcttgttctaggtctcgttccccagtcgactgcctgtggcatgttaaccgggcccttatattattttgtcttccgctgttgttctctgatagttgttggcctaactggccctaatgtaagtgtttaactcttttagcctaaattcattcgtgatatgttgtgatccaactatgtatgtgtgtaccaactactgatccagggattggtacggataaacacagaagatttccgatttccaaaatcgggggtctacaaaaaccctatcgctagatttggtgatagacattagtaagttttatgttggaattgatggtcaaatttggtcgttaaggagcgtcaaaatgcatgcagagcaaacgagcaacttttggccgagaagttagcagtgagagcaaagctagcaaaggctaagagcgcaagcatctgattcttctctatttatcggagatccaatgcgtggcactctccaaaaagagtgccttattctttggtttgtgccaagtatttgctcgtggctttgttttttttagaccgactcagtgcagtttctaggtgacagggattgatgaatgatgtgagggatagttgttgcacaataacagaacaaattaaaggaataatttaggagaagattgaagcttagtcttctaacattcttttttattcaagctttctttcttgttatttcgttcttctgtttcaaggcttggagtctgttaactcctctatgtgtggatacagtggctggcataggcggatctataaggtggtccgagtggtcaaaaaagtgatgatcaaccctattatatatatcccgaaccaatccttagtggtatgatgcaatgttttacaacatactactaaaagagaaagagcatggtagttgtaggggatcttaccatgacaacacacacctccggggagcattcagaggtatctcgttgacggagggagttcacccagcactgataaggtcgccaaatgtgcaccgaaaattgctttcccctttcttttttgaagggaaaaagagttgtattgattaagtaacactatcgcaatcttgctgcaaaatctgttgatcacaaaacaatgcttgatcacgccaaaccgcttaatgagccatccgtttagcatattgagcaagttcaagcgtctcagatctaagagcacaaggcagtgtttggcatctacatctggttgcaatcatgtcgactttcgttaggcagaagcgttggccggtttgacgacataaccacgacgaggtggtataatgccgagagaagatcttcatgcacacaatctggatgaagggggggcagcgatgaataaggagcccattgaagattagtgtcgaaacatgaattcggcaataataaaaggggtagcgcacgagacctaaaagtggatgcatgcggagacaaaggatttaga

SEQ ID NO: 15383 - DNA, 6175 bp, Oryza sativa
  unsure (1)..(6175): unsure at all n locations
tttgtctcatgcccctaggccctgtaatccccaaacatgagtagggtattacctcttatcgaaagggcctgaacctgctaaatcctttgtctccgcatccatctacttttaggtctcgcgcgctaccccttttattattgccgaattcatgtttcgacattggcgtgccaggcaggggtacgccgagttatctatcaagaagtgcgatggaacttatctcaggaatcaccggcaccattgttgctccaagatccaatcctgacagggagattgatctcggcgaactcgatagatttaatcttcgatgtcgtcagcttttcctttccaatctgttatttattggattaattctaatcactgcttaatgctattcttctttttattctctattgcttgatgccggcgcaaagtgctcaattgggcatggtaagccgcagctacgcaaggcgaagccgtccactcgtagcgaatccaagtcgtgggcaggcaggacaagcacgaaagttcacgtgacgagatcgctggagatgtacaggacgtgtcaattcaatcgccatgcatggattaattaatccagccatacacgcattcaatattgctggatacgtacagggcaaattgatccatatatagtcattatctctctacttgctaataacaggctaacgatatactttgttgcttgttttgcatatattcgggagctgtacgtggttgtttgcaggacatcgatcaagatctaacagccatctgctgccgagaatacgggcaatatgtacatccataactctacacatgacgtatctcaaaaaaaaaaaaaactctacacatgacgagctatggatcgcttgatcagtcctagcaacacagtgcaacaccaatgactaattttctccgtctcggagtcagtccgatagaggagatcaatctcggcaagttcaacaattcaatctccgacttcgccgggttttttccctttcaacttattgttgtttattagattgatctttaaatttcagattaatctcttggtattttctgttgtttatatgtaatcccacggcgctactgttgccaactagtgtcctcgcctgcacggttggttggtcacaccaccgttgttaggcatccacgtcttcaccgccggcctgcctttgccacagccgattggtgtcttcgcctacatgattggttggttaattaaaccacagttgttgggcgtccacgttttcaccgccggcctgcctccaccgccgccgactagtgtttccacctgcacggctggcctattatgccaccgttgttaggtgtctacgtcctcaccgccggcctgcctccgtcgccgccgactggtgtcctcgcggcgtcaacgacttcaccgtcggcccgccttcgtcaccgccgactagtgtcctcgcctatacggttggttggtcacaccaccgttcatgggcgtccacgtcttcaccgaccggccttcctccatcgccgccgattggtgcccttgcctatacggttggctggtcacaccaccgtccatgggcgtccacgtcttcaccgaccggcttgccttcgccgccgccgactggtgtctctgcctacacggctggcctattatgccgccgttggtgggcatcttcgctttcaccatcgaccgcttcgtcaccgccgactggtgtcttcattgttattgatggacgactttgttcccacattggccacctctgccatcaccaaggggaatattacgaagctaagtcatcattgattttttttatatgatattttccttttcctctgcctccctacatcaactggttcgccgttgactagtgagtcgggggctacatatgttatatcatattttttaacaattttcataatatttatcttgattgcttgcgatataatctgagtacaaaagtgcctatcgagttatggagttctatcttcctatgctttccgtttggtttgtcgatggatggttgccttcgggccgattcctagcacccgggggctcgttggatggaccgagtaaaggtgctaagtattactcaaaaaaattcaaaagcatagagataagataatttattttctgctcttaacaattgcaaaagtacccgagtagtaaactctgatccgtgaaactttgttccattaatgacgaactcatgtcactcgtatgcatgcttgggaagtgcctagaccgactcccggtgcttggggactatgactagtcgggcagagtgtttaaacgtaaggagttatccgctcggggaaattaaaattgacaagaggagaaatatatatttataaatatttgaaaatacttgaatctttctcaagtactgtatttacatcagatactactcatcatatatgtttgttctgcaggatccagatccagatatgcatcaaagggattcatggctttaagcttatctcctatgttacagaaatggatcagttagaacatcaccaccggcttgccgttgtcgccgccgactggtgtcctcgcctatacggttgggtgatcacaccgccgttgttgggcgtcgttttcttcaccgaccggccacctcatccgccgtcgactggtgttttcgcctatacggttggttggtcacaccaccgttgttaggcgtctacgtcttcaccgactgagccttcgccgccgccgactggtgtctccgcctgcacggctggcctattatgccgccgtttgttgggcgtctacgtcttcaccgaccggcttgccttcgccgccgtcgatcggtgtctccgcctgcacggctggcctattatgccgccgttgttgagcgtctacgtcttcaccgaccggcttgccttcgccgccactgactggtgtctccgcctgcacggctggcctattatgccgccgttgttgggtgtctacgtcttcaccaaccgaccgcctcgtccgccgacgactggtgtttccgcctgcacggctggcctattatgccgccgttgctaggcgtctacgtcttcaccgaccggccgcctcgtcctccgctaactggtatttccgcctgcatggctagcctattatgccgccgttgttgggcgtctacctcttcaccgaccggtagcctcgtccgccgccgactagtatttccgcctacacggctggcctgttatgatgccaactgatgctatcttcttcacggctggctacgtcgcaatcactgctaataggtgtcatcatcttcaacgcaagctgtctacgtctgctgctgactagtttcttcacgtccaaggctgcatgattctgccagtgttgattggccttatcttcttcatcgccggtcgtctcgtctgctgctgactagtgcccttgcctctatagctggtttataccgctacaactattgatggacgccatcgtgttcattgttggccgccttatctgacgccgactggtttgtcgcctccacggctgcgcgtcttcgttactattgatgggcatcatcatcatcaccagcttgccttcgccgccgccgattggtgtctccgtcttgatggctggcctattatgctgtcgctgatggactcctttgttttcaccgtctggtttttgccatcgccgactggtgtttctatcttcacgactatgcgtcttcgccaccggtttgcttatgttgccttcgactcgtgttcacttcatcatgactatgcaactttgtcatcatggtggagcgacttcatttttattatcttcggcaccggcaaactctattgccgctacttcgcaagttttgctacttcaccaaccatgacgtctacaagagcttcaacatctcggcatgcgtcaccaaatatgacaccgtgttattttattacaacaagtggtgttccaatcttcaatatttctactcggacatcttcgacatgcatcttcactcaagcaatgactactcgacgacaagaagctacaattctcgactctatgttaagttgtttcccaactaaccaaagggtcgggggctacacaaatacaagactctcaaaattcgacaagttttttgtcaagatgcatcaatcaatcaatcaacaagtcaactctgggagttattatcttcgtctgcgcttcagagccggtcaagattaagtttacatgtctgggagtttggagtcatcaaccaatcaactcagatcagattcaatgagttgaacaacagcatatactttcctctaagtgaagcatctgcaacagatatagcaccaagttctactgccatcttcataaatcaagaggcgttgcatcaatcttcgtcacacaaatgccaacattaagaaaatacttgagcatggatttcttctcaacagtttgatggattgttgttactgacatcatcaccagcacatctacttcatcggccttgatgtctccgtcgttgctaaggggtgaccacgtcctcgccgtcggttgctttttgtcatcaccgactttcatcgccgacttgttatttcgttttcacggttggcctactacgcaactaccgatagaggatttcattgttatcatcggctgctacaccactattgactggatcactgacatcgtcatcttcatcaacatcctgtcaagcctcttcaacatagcccactctacttctattgatgggcaacttcgtcatcatatttgatcatctctattgctgccaatcgtcattaccatcggttgcatttgtcatcgtcgactatttcttgcattttcatgattggaggattttgccatcgtcgttgatgcgcttctacgtcgtcatcgttggcttgttttcatcgccaccgactgatattctcgccttcacggctggcttattatgtcgccgctaatgggcgttttcatcttcttcaccagctgtctcgtctgtctccgactgattattttgtcaccatggctacaaaactctgtcgctattgctgggtgccttcatctttactgctggttgatctaactgctgccaaccggtttcttcgcttccataccgattgcatcagctatcactgatggacaatttcaagtactccaaaaagataagctatatgctcaggggcttacgagctcaagcacaaggatcataccttcaagttggattttgttctagatacaggcaacatgcactcgtagtcctgagattattttctatgctcgaagactggaccaatcattatttcccgtaagggctatcaaacgaatacttgcgccagttgggattcaatttttatatctattttggagtatcccataagggataatcactcagatcagaagctattcatatgagctacacttggtctatatcacccggaagatttattactcgggagcatgctacatgcgtcatcctttaaagggtgtcgaaggcatattttttggcctaggccaaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatacatcttaaaaggtgtcaaacagtaaagctttatatagctaccccgttgacttttttttataagtcaaggtgctttttgggtttttaagcaattgattggatacaatatcattgcttttttgccacaaaagtgtgcatatttattgaccaatattttggattaggctgattatatatttggtcattttccaggcggttggtaaatcctttatgagtttatttactcggattttacaccacatatgccgtatatttccgggtgtggtgaaaccatgtgtcttttagggacttaagcacatatgttaaagcagtgtgcgcatggcgtatgcccaatactttggaaatttctttatttcaccgcatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15384 - DNA, 771 bp, Oryza sativa
  unsure (1)..(771): unsure at all n locations
nnnnnnnnnnnnnnnnnnnnnnnnnnnnnnnnnnnnnnnnnnnnnnnnnnnnnnnnnntttatcatctacaaaagaaaatgtgcatgtgactactgaagactatccgccaaagaatttaagaaaacaagtgtactgatctaaagtaacttgatataaattacaagatttgacagtgtaataaaaaaaacattttttcttttttgtcaaaaagcaggatatataaatgcctaaagacaataaggtgtatagagtctatagacaatgagacaaaaattatatttcctagataaggatgcttaccattgctattatttctgttaaatggtattctttatcaaaatccttcaaatgatcctctttggcactgttaagcagctcagaaatgcaaacatcctttgaaggatgttcatctttgcaaaaacctttcgcaagtgaagaatcttgtaattccttgcaaatttcctggagattatggaaaatgattaaacaaaatattatgtttaattcatgttttgcactgaacaataatatcaagtacttgagttgatcctagaaacaaactcaatgtctcacaacattaaataaatttgtcgggatcaaaagtgcattgcatgcacatcaatataacaatacacaagcaagttgtgaaaaagtcatgctttgataaacatacaagaataaaataatttatagcaaaacattaagcggagcacacctgaatctccctttcagtttctgtcatcacttcattcttttcatcagaaagcata

SEQ ID NO: 15385 - DNA, 661 bp, Oryza sativa
ccgccattctctgaaaagaaaagctccaaaacgtcagctaatttgcatacactatcaattgaacaatcaataatccaagtgctgtagctagctaccttggtgttcatcacgaggaacggcgcgagcagctgcggcgaagtggaaggagaagaagcagagggcgaagaggagaagcagcgcaagagcagcagcagcagaagaggaggagacgccgcgagtagtgctcatatctatcgtcttcttcttctagcttgggttaaactatggtgcgttgtcgaagggcgagaggaggatgatgatgaggaggaggaggaggaggagaagagattttgcttcttgcaattgctgctttgggtttgggtggcggcgagtagtagaagtagtggaggctatttataatcgggcgaagtggcttgctttcgttgcaacttgccgttgtttgatacacacagtgaactgaaaaacacatgttacatgtacagtacacaggaagtggccagacagggcaggattattgttaattttataaggatcggccgcatgcatacaaaacacgggtagatttaagattagttaatgtatatatatatatatatatatatatatatatatatatatatatggaaaaactatcaatcctttagggccccttttaatcgca

SEQ ID NO: 15386 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnnnnnatttgactttcagacaataaagacatacaacatgatattattatggtaactagacgcttggaccaaaaagtgaagaatatagtgcagttgcctatattttcctcaacttatttttgtaagacaaccctcactaatttcatgacgtaactgacctggcaattcatcaagtgaagaatttttccccctttttccgaaaccgaataattattgactggatgatgaactcataatcctattcttcaggtgttggcagaggatgaaaacaatgtgaaagcattgttcagacgaggaaaagcaagagctgaacttggtcagacagaatcagcgagggaggacttcctgaaagccaagaaacattccccagaagacaaggagatccagcgtgagcttcggtctctcgcggaacaggataaagctctgtaccaaaaacagaaggagctgtacaaaggcctctttggtccaaggcccgaacccaaaccgaaggcgtcaaattccatcggtcgcttctggcagtggctcgtgtccttgattggttatctcataaaactggtcaaacccaagaatgaatgaataggaacggatagtgcagaactgacgaattgacgaccaaaacatggactcattgtactgtaggctgggaattctactacaagttagttgggagtgttg

SEQ ID NO: 15387 - DNA, 754 bp, Oryza sativa
atgaaaaaagtacggccgcaagctctttatgggcggccaaaattgcaattagccccttgccgccctctgtacgggcggcaagggcctaatcgcaattttggccgacggcggcagacggcgcggtcgacccaccgtctgccacctcagcttgccgcccaccattagagcggcaggggctatttctgcaatttttttggtcgatagattatttctgtaaatattaaaaaaaatctaaaaacgaaaaccccgaaacagaatccttctacacatacgccgtatttggtagtggtacggttcatgagctgcacgtacggccgtacgccaattccggtacgcatccccctccgacacgaactctcgtagtcacgcacgtattcacgtcgtatatctctctataagtttaatcagcagtagcagattacacgcgatacgggagcaaatcaaatcaaaacaaacagatccatgatccagttgttagatataaataaatatatagtccaaaattaaactgatcggattttaaatttttgactatggacaacgacgacgacgtcgacggaacacgacgcaccgaaagcgattctgccggcaccgatcatgaaccatcatccatggcgaccgccaccgcgttcgacaacttagtgacgctactagaagcttaccaacgcctcggagacagcgacgacgacgacggggacggcggcattgatcgtcctgccgccgccgctaatggcgacggcggcgacggggaagg

SEQ ID NO: 15388 - DNA, 717 bp, Oryza sativa
gcgaattcgagctcggtacccagctcgcgcttggtgacgacgtggcccttgttgatgccgacgaagagccccgacttgggctgcggcggcgccatggcggatctcctcctcgctcctcggacctgcggcgaaggcgacggaacaaaccaaaatcgatcaacaaacagagaatcgaagcggagaggggcgcgagagatctcgagtaaggaagcgctcgtgtgtgtgagagagaggcggcgctcggaggctgcgtaccttggatcggcgacagctacaaaaccctaagccgccggctgcgtccgaggagaaaccctaagcgatggagaggatgttgttatatacacgtcgggtactagggtcacagcccagatcgattcgtaggaggaattaatgggccggcctagtttgccttcctgggcaatgactatgggcttgcttcacttatccatttcgctttttagctcgcgtttcgttgttatctcgagaggctgtaagccttgaaatgtaaaattcttgtacatgaaatctttcgtctgctcgcttttcacttaatgccatcatgtagcagcaaagaagattagtactccccttgttttttgtcgaaatattctttttcctataaccttcaccaatcgctataggcttttgtaccaaattttgatagcgttggtttagtttgatgtttttccaaaatttagtagcatttttatgagggaa

SEQ ID NO: 15389 - DNA, 1234 bp, Oryza sativa
ctatagggcgaattcgagctcggtacccaaataaaataatgcaggattggaacatcttcagatgtggagttttgtgcaagatattacaatcattgtgatgttgtcaaagtcgtccaaatacttgcctcttcagatgcatatacagatatatgtaggagaatgacagagtactggagtcatctacttgatatatttcagaatgagagatcaaaaataagtaaagaggttggtagaagccttatgtcacagtccaatattctatcgaccgctactccagtgaaagcaaataatggaagtgttcaggcaactttgaaagatggtcaggacagtaagatggcagtgctttcccagacaaatgcacatcaggttatggataatcaatttacgttgtgctcagctaacaataatgaagcttttaggcaaactccattagctaagacctatgtagataatgcatacagaaatggagcttttgggcccagtgggacatcctcaatttctcaccagagcatgtctatggtgacagttatgcctaacagaacacaagcacagccagcacatggattgattcgtccagacttgtcgtgtggttcagtaattggtaatggtatgtctagagaaaatatcaggagctctatttctgctagggcagacttgatcagcccaccttataaaagcaagccccctgttcagctaattactgaaaatatgagtggtggcaagccagctaaattctcatcttttagaccacaggcttacatgaatctatacaatcacgggaatgttgcagcatctgctgctgccaatctagctgttcttaaatctgatgaaggtaaggctccaacttcccatctgacaacaaaccaaaggaagaaactggctgctgactgtgctctacaagtgaaagcattttcctcagcagccttacaatttgtttggccaagtactgaaaagaaggttatggaagtcccaagagatagatgtggttggtgccttgcctgtcaaagttcagcaggtggaactaaaaaagcttgttttcttaacatggccactgcaaatgcttctaaaggatctgctcgaattcttagtggcatgcgtttaatcaagaattctgatagccatttccccagcattgttacttatttaagccacatggaggaaagtttgcgtggccttttagttggttcactacaagatgtgcagcggagacaacagtggtataatcaactaaaag

SEQ ID NO: 15390 - DNA, 2085 bp, Oryza sativa
  unsure (1)..(2085): unsure at all n locations
acatgccagtcaaatgtgttgtatcatgaattctttaaacttgaaacttgattgtatcccacagtagtagcagttaacatttataatcatacaactactgggatatgtatttccagtgttttattatgaattatttgaaccctaggtatgggctagtttcttgttaacttctttcaaacctgagcttatcttattttgcctggatgatgccatgactgatgggaaaataaaaggaaatattccctctgtcccaaattataagggattttgggtggatgggatatatactagtactatgaatctggtagcacatttttcagtcttgctatgcatcttgggctagatatatattttacatgtagggtttgccactcttcataagtgtaaagtgccatttgaggatcagccactctctttctcactgacatgaggcattcgagtgacaaattctcatccaccaatggtggagagtgacagaccccaaaatcaactcttggatgataaaatgaactcgatgctgaaattcttagtgggtagagcatggaattttgaaatacagtgtcatattttgcttaattatatcttgtgctaagtgcttctggagaatcaagttcgacatgcaataaataattgtaaaataaacttgaaatgttgtttcaacaagtgttggtgtaaaataaatacaaatgacaggttgagatcttattatctatttgttctttgcatcttttgtgcagttggaaagtaatattcgtggtgtagcattttctactagctggctgaagctaatagatgactggcctgtggaatctcctagtgcatctgctggtgcatcccgtcctgcagcataccaaaaacgtggaactggtggaaggcggggcagaaaacgttcaatggcatctgaatctgctcctgttactgatgatgacaacagctgaaagaagtgaattggtggagtggaggaaatgtttcaaagcgtatctgacagaggggggctctaccagttttgaccattataaaagctgctcgtcaaggtattgcacatgtctgtctgatatgataatccctttctctgtctcaaggtgagaacaagttaacatgatctgtcgctcactaggtggaaaaaaaaggatgttcagtgtgtcttatcatgaaggctccaattttccaaggcggactcggcaacttgcttgnagggcatgtgttggattaagccagagttcatctcaacttgctctccaggttagcaccttctatcatgatgttttgaagtatttagatcaagctatatgtattcctaatatacatatctatctcacaggttagatatcttgattcccacataagatggaaggagttcatccctccagatcaaattccttcagaagggaaaagtgtagattctgactattctgttctcagaaacgcagttgtttgtgataaaaaaatagttgacaataagataagatatgcacttaagtttcccaaccagaagcatcttcctgtccgtgtaacaaagaatattttggaagcagaagataatcaggatggggatgggaaattttggttttctgaaaaccatatcccactatacttgctacgagaatttgagcagaaagctggggttagctccttgcctactccaggaatgttagattctaactgttttgccaatttctaccaaaggcgagtaaaatcatcaattggagatgttttcttctatctgcttcacaagggtgatgtatatccttgcacctcatgcaagaaggatgtttccttcaggtttttgttctacaccttattgctttgttcattctgttattgttttctttataagatgctgctttatctttatttctcatatatctttgttgttaatcttatgtagggatatcataaaatgcagctcttgtcaaggtacgggtttctagcataccccctttttttttgctatttccttaaagtagagaataactgataaattactgacgtttttccaatatgaactcacaatagtaactaaaacaatgtttcaggtaattgtcataaagagtgcacattaaggtctgttggtagcaaaggggg

SEQ ID NO: 15391 - DNA, 1887 bp, Oryza sativa
gtcataaagagtgcacattaaggtctgttggtacaaagaaggcaatgctgcttccagtttaacatgcaagttgtgcctcaagaagcgtagtcttatgcttacaaattacaatacaaacgcaagtttcatcctacctcaacagaagagtaatgtccatcacgcagtggcagctcccaaaataatctttaaggttggttcttcccattccgctgaaccagccacaaaggttgaagctccgccaatcgtgaaggtagaagcccagccagtggtcaagaaggaaacctgccagttgtgaagatggaaacccagccaactgcaaatgtagaagcacagccaactgcaaaagtggaagcctttccaatttcgaatttggcaactcagaataatgcaggggcgcaagtccagcctaagacaaaatctaaaaaacccaagccagaaaaaccgagaaaatccaagaagactgaagagatcaaatactttggtctcgtgtggaagaaaagcactaatgacaaaaataataatgaaaattctggagaagtgttcagggcgaatgatgttatcctaaaaggcaaggatggtgtaggttcatcaataaaacctacttgctgtctttgtaataagccttattgcccagatttcctgtatgtccgctgcgagaggtgcaaaagtaagcccgtctatcattattgtaggcttgtagcttcaagttatgtatatatatatatgtgtgtgttatctatcagattttaacttcttgatattcttctttgttcagagtggtttcatggcgatgccttgcaacttgaggaagaaaagatatttgaattggtttcataccgatgttgcagatgccgaaggcgagccataccaaaatgtcctcattcagatgattataagaagcctgaaccagaatacagtgagcaaacagtcgctacgtcatcacagtcaactatgctttctagtgaggagaattttgctgtagcagatcaagatccactgcttgcttcatatggcagagttgaaccgtttggagcacaaacaatggatgctgatttatcgatgaacatgatgagctttaacccaggaaatcagaaactatcagtaagaaggggacaaaacaaaaattgtgaatatgttgaccaatccagtatacatgtggatgactattatatccagaatcaacctcaagggaatgcaaacatcaatttcagtcactcgaatgaattctctttgtcagaggctgatggtgtggatgcttcagagctgttgggatgggatttttctcaaggaaataccagtgctgccccttctgatttcgcagctaattgcccgtggaatgacatcagctgtggcagcgttgctggtgatgaatatgaaccacagacttatttctcattcaccgaactacttgaagctgatgatacacagttcgataatacatttgggatgtctaatagtgtgcaagatgatggtgaccaacaaggaattggttttgatgaaatggctttcatgatggaagatggggcctcaaacatgcctttcccaactattgactccgcctctgacgaggtagcatgtgacaggtgcaagaatcctcagccgccacctgatctcaaatgcgcagtatgtggactgcagatgcaccgtcattgctcgccttgggaggatggtgaacagccatcagatagtgcctattggagttgtggtgcctgccttgagtggcgatgatgagcttcaaactttcattgcacttgttacctgagagctgcatacagcagctgtctaattacagtcgaaggtaagcacagcattttatctttgaatactacctgaatttttcagtttaacaagaatttggtttatggttctgagcataatctgtgttta

SEQ ID NO: 15392 - DNA, 1092 bp, Oryza sativa
ccatcagatagtgccgattggagttgtggtgcctgccgggagtgccgatgatgagcttcaaactttcattgcacttgttacctgagagctgcatagagcagctgtctaattacagtcgaaggtaagcacagcattttatctttgaatactacctgaatttttcagtttaacaagaatttggtttatggttctgagcataatttgtgtttaggtggatctgtagaagaaatctcatgaagcacaccaaggaggagcgagggaaaatttcccttctagctatttggcattgtcagtgccactgaccgtttgggagttgtggcgttgattactggacacaccttagcaatatggtttgacaaccaaggttttcggcgaactgtacatatattaatgaatggttgatcgaaaaagccgttttccattcatctaggcggttttctttttaaggggaggattataggattagattgctcttagttacgtgttatataggagctctggactttggaagccatgttcctgacaatgtgttgtcttggattcttttgcccctttttttccctcagaaaaagaatagaagtgcctctttctccgagtggatgcgatatccttgatatatatagcctcggctttttcctctgattaaagatgcttgttgctctgcctttttctggtgtggacgtgcggtggctgtacgagtacgactataggaaagatcatttttcacgtctttactctttacccttatatttttcataatgtcatggcttttatgtttctttctgcttttacttttgaatcgtacagtcaaaatgcttcaccgagccacacgagccacttcaatgcacaagaagattgtgatgccccattatattgtataagcaggaaactttgcatggattttgtgaaagaggcaagttcaattcctgctgctctttggtctctcatcactcaaaacatcatataggcctccagcgtagttgcatttctacatgggccgagcaggacgtcacatcatacaggcccagattgtagaaatgggcctagcaggacgacacacatgcagccccatatgcataaatgggccgagaa

SEQ ID NO: 15393 - DNA, 720 bp, Oryza sativa
  unsure (1)..(720): unsure at all n locations
tcgccatcaagtccaccaagaagctctgtgctgtgagttctcctgacaattcattcatgatctactagttagtcttgctgtctactaacatttgggagtcctctcgttgttgcgcaggtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggtataccttcagtagttcagtgttatttatatgaaatattatgattgtttttacttttgttgcaatcagatcggtccttgactgtttcctagagaaattttgtatgttaccattacgtcaccgcaatttgtagcatctgctatgtgaaaaaaattgactctttttgtcctttgcaggctctgaaaccaggtgctacaatttttgtggggcaatacttgttcactggcagtgagactacttcagtttggttagaggtaaaaatcttcagcatgctaaaactggtgttctgtgtttgtgatgtgtaatgtgttacgtccttgttagtaggatgtgcttgctgtctacattttctgatacctaatctccattctgcttgatataggtttctgaagttaaaggnnnnnnnnnnnnnnnnnnnnnnnnnnnnnnnnnnnnnnnnnnnnnnnn

SEQ ID NO: 15394 - DNA, 653 bp, Oryza sativa
  unsure (1)..(653): unsure at all n locations
nnnnnnnnnnnnnnnnnnnnnnnnnnnnnnnnnnnnnnnnnnnnnnnnnnnnnnnnntggctggccaatacggattggcagattattgcagatcagagagatgggtgggtgtgtagacttggcggcttccttccttccatcaaacgtgctgctgctagcttgggcgtgggtcccacttcgccagctgttactgtgtgggccccgttcctgccctagctctgcaagctcaagctgccgagctggctgccacgtccactccacagatgcagatgcagcagctctgatgatctcatgaatctgctacctgctgctcatcatcagttctgtgcaactgtgttgaaaaacgaaacacaaacagtttttgggacaaggaaatgttggaagttgcgtcgggggagggtctgatgatcaattcaatctctcctccgccgaagaacaaaacaaacaaatccaatattagatgcaaggagaacgacctgcgagttcacttaaaggctaaatagatgataacccatgaattttcgcgtcgtggcctaacttatcagatctagatatacaaatgggtcaatttataaacttatttatagatcaaattaataggtaacctgccagtcaaaaccggtgattcgcggataagcccgctcgccccccta

SEQ ID NO: 15395 - DNA, 595 bp, Oryza sativa
aattcgagctcggtacccatcaaaattttgaaaatttcggtaatttctggcaaaaattatttgaaattttgattgattttgaataaaatttgatcaaattaaaaaaaccaaaaaaaatggacgagatttgagcataccggtaggggccaaatttcggaaatttcgaaccacgggcacacaggcacatgcacgtgacgtgacgtggcgggctctatcctggcttcatctagaatgtcgccttccacctcctgccaccttcttcccctttccagactcctttccactcctcctgcaccgaccccgccggctatatacacacccgctcgccgccgccttatcaccaagaacgagaaccacatcgagcgagcgatccgtcgcgcaccagcttaatctaccaaccagttcgccggagaattcaagtgaggatatatggcgtacatgcgggtgactcaccgggacgaggaggggaagaaggtgacggagaaggtgccgatcccggagacgcggcgtcccgacaccgcgaggcacttctagcggaagctggaggagcaagggttccaccgcctggagcgccacccggcgaacgggcccgcgc

SEQ ID NO: 15396 - DNA, 2524 bp, Oryza sativa
  unsure (1)..(2524): unsure at all n locations
nnnnnnnnnnnnnnnnnnnnnnnnnnnnnnnnnnnnnnnnnnnnnnnnnnnnnnnnnnacgagatttgagcataccggtaggggccaaatttcggaaatttcgaaccacgggcacacaggcacatgggcgtgacgtgacgtggcgggctctatcctggcttcatctagaatgtcgccttccacctcctgccaccttctccccctttccagactccttccactcctcctgcaccgcccccgccgcctatatacacacccgctcgccgccgcctcatcaccaagaacgagaaccacatcgagcgagcgatccgtcgcgcaccagcttaatctaccaaccagttcgccggagaattcaggtgaggatatatggcgtacatgcgggtgactcaccgggacgaggaggggaagaaggtgacggagaaggtgccgatcccggagacgcggcgtcccgacaccgcgaggcacttcgagcggaagctggaggagcaagggttccaccgcctggagcgccacccggcgaacgggcccgcgcgggccggcatcggcgcgccgccgcccaagtccggccgcggcggcaagttcacctgggaggggcccgacggccccgtcgacgcccaactccagcccgccccgcccgccgtcgatcccaacgaccccaactacgacgagggcgacggcgccggagtcgacgaggaggttgccaaggaggtcgtcatcggcgaggtggaggtcgccaaggtcgccgaggccagggacggcgtcgacgtcgtcgcgccggcgccgctgctccagcaagagcagcagtagtcgagtctcgcgccgcgccgcgcccgccattagccatttcggagctgatgtctaatggtcgttgtgcgttgtgtgtgactgcgtgtgttttgggttctaaactgctataattactagtctcctcagtcctcagtggtttgcatgcatgtaaaaaatcgtgtctcgtttaatcaataacggtaaacatggattaactgtggattagttttcaactccgtcacctgacggcggcgccggccgccggagcagattcgcgttcggccggcagccgggcacgggcccaacgaataagcagatgggccgtgtacaatattcggcacgcgagtaattgggcctttgagaaagtatgatattgcgggctcaattttataacggacgagtccagagacgtctctttatcttatcctaaactacaatagcagaaattttcatcaacttccaaaatcaaatcgggttaaattagatctcatagcatcgagtttaaattgtatcataaactgcaataccataaatcttcgtcatcttctaaaaccgggttaagaagaatagttaagaagaagacgtagtggcgttctagttaagaagaatagttaagaagaagacgtagtggcgttctagttctagttaagaagaagaaaataaagaaaaatgagacccacatgtaagttatcacctcactctacttccctcctcctctcctctctttcactttgtctcaacggcaaacactgggggtgagcttcgatcttagcctcatcggcgagctgggtaagcaggagcaccacgaccaggcaccggaggtcatgcgcaagtccgtcgtcctcaagaacagcttggcgacatgccgctatccaaagaagtctcactccatcctcattgccagcggcgccgacgacatcggtagccagtacggcggctagctagaccatcacctggcaagtggcaaggcctcgctaggaataacctcaccgccgacaccacaatcgagggtggtgatgcccgcggtgaggttgttccccgtgaggccctgtcaggtgatggtccagtcgccgcactggctgcagagcagctgccgaggtcgtcagcgtggtaggtagcgatgaggatggagcgagtctttttgggcaacggcagcagcgccacgtcgtcgggtttgccgttcttgaggaagatgagggacttgcgcacagcctcctgcgttgggtcacgatagtctttcttgcccagctctccaacgaggttgaggttggagcttaccaccggtgctcgacggcatggaggagatgagaggaagagaagagaggagagggtaacttggaagtattggttgaagtgaggtggccacttacaagtgggccccatgtatatttttaaaattttcttcattctgactaggatgccatgtcaataaagtcatctattcataatttcatattgctatgaggtctaatttaagccagttttgtaagttgaggggcgatttaagaatacggtttaaactccgatagaaagatgaggaatgtcaggtggacttattccatttacaacggaagtattcgtgtcagttgggcccactcaatacgggcacacattttgctaagctcgacgtagtttttgggccttcatgctaagtgggccttgacattagtaatggaggnnnnnnnnnnnnnnnnnnnnnnnnnnnnnnnnnnnnnnnnnnnnnnnnnnnnnnnnnnnn

SEQ ID NO: 15397 - DNA, 9830 bp, Oryza sativa
  unsure (1)..(9830): unsure at all n locations
ccggggaggtagtgcgccacccgggagcagacagcttggaaatggatcgtctccaccgccggcgacatcgtcggctgaaaggagaagctcgaggtgaggtggtcgtctcgcccatttctacatgtaccttgtcccctcccaggaaaaggccgtgcaagttaatgccgtcatttctctctttcggttgcttaattcgtgtaggatccgttcctggtacttggaggattgaacagagtaatttagtgatcaatttgtgatgatgatcgtgcaggtgcgttcagtttggaaacctctctgaagatccatgccatcagtttgcatcctggtgcttccattgaacaccaacttagttatgttttcgccaattgtggatgtaattccattttcaatgtcagtgagttagctatatgcttgatagggtaggtatgtcaaatttatagtttaagtaattcattttctattgattgctctttcacagtaaagagttgcgagccagagtttctgatatcttcttgaacttgtctttaaaagctatcgacatatcgggcgtttcgatggtggtgagtaaatttgatcattggactctttggtactgaggcagctgattgtatcacttacatttaatatctgagaatggattttaacgaccaatatatatagttttcacttctcagtttgcaagatattaactctgctgtggttaatctctgggagaatatcttggttgtagttttgaaaaattaaatcgttggtatcctatccatctagagtggagggtaatgtaaagatggcaacctcatttggcaggtcattgatggactgaaatgtttcatggaccttaatcttccattacagacgacattcttagcggaagttcctcttgccaaatccttgactggggttctcaaaatctgtggtcaggtgctgcctgaatttctttaaaatttacaatcctcgtagcaggattggcttttacttgttaactgtcatattataacatcactcatgctcttcttgtcaccaagcagatttgtcactgctgtaagttttgactgttttgtgttccttttcatctaattctcatgtgtcttcattaatgatacacttttcgttggagtagttcttaacttcttgttttgaaaatgcagttaagtactttgcctgtaagaagttatactcaatgcatccaatgttgtcagacgaagaagttacagtaacaaggtgcagactgctaaagtcaccgacttctatgattgtgatccagcaaatcctggacagccctttgcaccattcctctttttcaagcgaagcaaaaaaaggtacacaacacacagtgaatcagtgacagatctctgtatctttaaagtgcatgaacatgtctaaggagtaacttctttttatgcactcctttttggtacgatcctcttcatcttgctctcttctcccattccgtgcatttcaaacacatcaatagattcttgtgctgctgagctgatggcaataagaaagaaaagcttctctgcttcagcatctttcttcatcaagtgttcgtcctaggctcctagtaatcactgtaaagagccttttggactggagctagatggctagatgctgaacaatcaatcacaaaatggaaggtcatggtgtgttgggaccatgatcagcaaatggcatgttgatacatcacgaaagctaagttttgcatgtacagcttggtgtgtcatatcaatctatgatcacctctgcttgctgctttaagcctctcttcttttgtaataggcaacctgtgattttgttctctcctatgattcctctgaagttaagtctcagtggcaagcaattccagcattttgcagacaatgatccaaacaaaaaattaaaattcctacttatcttcatgaagcttccatgcacaagcttgttgtgtattactatcacctctgattgctgctttaagtctcttcttttgcaggcaacctgtgatttcgttcaatcctacgattcctctgatgttaaatctcagtggcatgaaattcgattgcgttttgcagacaatgatccaagcaaagatattccttctcatctccatcttcggagacgaataaacatggacacttgatgcagaagcctgtcttggagaaacatctctgatggatggacgaggcaattcagcagagcccttctttgtcatgactaccatatctgtctctctgcacaactcagatcttctccacaggtaactaaaatagttaagagcacatgattaagcatgcattaaactagtcaagtaccctccttttggcagcaagctcgatcgagcttatcgtaatccctgtgcaaaggtagttcaggccaaaaacagatacattgattaattgggttagcacaagtattaaatttgcaagttgacacttaaagaggggcgatgatgcatcgcatctcttgcaagcttgcctccatggccatccaagcctgtcagcgtcactgattatactaattaagcatgcagtgtaatcatgctttcatgctccatttgttttgttgtttgtgttgattgattggtgtgcgagagtcctattttttcatgaaaaactttgtgcccgctccttttccttcgatttggagatcggccaagttcgcctttttattatgaggcgtggagaatgtcgtgttaaaaaatactgtatgcaaggacatagggcagaggaatacctgcttataaaatacggcttatgaaaagagtagcctatcagtttgtcagattaattatggaattgtgcctgtggttacgtcgaatgccaggtaaatgaacttaatagtctaatcttaagttgaaattgtaaaactataatataatcaatcctaaaaattgtgtacacgactacatgagaatatgatatcaatcaataacctatgtacacaaataatgtatacatttattacaaaataattaacagaggcctatatatatttacaaataaatgatactccattcgttccaagctaaccaactaagatggagggagagtgtatgatcacccgcaagtccggccttatcaaatggtaattttatcatcttaagaaattattaggacgtatcatattttgtagaagaaattttatggtccttgaaaaaatacctcgaggtatctaaattttacactaaatttattggtaccttgaggtacttaagtaatagtgtaaaatttggtacctccagatactaagtacctcgagatatcaaaaattttagtgaaaaaatttagatacctcaacgtaatttctcaattaccgtaaaatttctttatcaaagagtacagatttctgatacatttgcgtattaattaagcattctgctagctagctagctatagtgtgctatggtttcaacacaagatctatgaaagctctgatatcctcaaagaaagggagaagctaataattaactagctaaatcttttatctcatccaattgcagtatggtttatgggcgtacatatggccatgcacgaggataaacgttaacgtccctctctcggcatgctaaatttagcttttgcccataaccttttatatacatgtatatactccctccgtactaataaaagaagtcgtttaggacagcgactcagtctccaaaacacaactttaacttcttatttctatatttattaaaaagtgatatatgtatatttttatgaaaatattttttaagacaaatctattcatataatttttacattttcaaactcaacaacttaagagttattcatgatttatatttctaaagtttgacttaaacattgtcctaaacgacttcttttacgagtacggagggagtactatatactacatatatgtggttaataatatctgcagttttattgtcactaactcgatcgatcaccatcagcttgatcaccatatatgattgttctacagaaaaggtgatcagcttggtcaccataattgtactagaaaattagattggaggggtcccaggcaatgcacgcacgcacgagttcttgctacttttagtttgtgaacgcatcaaactcaccccgttgattagcggtagctagattgcaatgtgatactgtgattaatctgtccttaatttgcaaatactgttggcatgcactagctaattaagctgtcagcaatatatagcatctgtaaagagaagatgcatgcacatggtaattaagttgcatcacagtactagttttcatggcttagtaataattagcacttgctgtgtacatccactttgaatgtaggggttggtttaatataaaccattacctaaaaaaataaagtaattaacacgtggaatgcgtgtggatgccgatcgactcatcgatcaatattgttcttgagcagattaagccaaatcaaatacgtatataggagtatgaagataggatagtatgtgtacgctgtacctaggagacttctaattaaaggaagaatctagactctgaaagtattggtctgacaaatacagcattacttggtgaccaaagctaatgtaatttaaaaacaaatcggtcgagtgatctatgcatgcatcaacaattccaccaacctgcaaaatggaattaaactgaactctcttcgtcacaaaataaaccaacttttaggatttaaaatttattccaaaataaattaacttctaccttgttacctaccatcattccgtaaatcaacaagttttatctcttcaatactccacacctacccactcattaattaggggcattttggtcatttgctatttccttgtatctatcttaggaagctaaggttggacatagaatgggacagagggagtaactctgtaaggatggtttattaagtggtgatgtgtgtactgctctgctactgcatatgtcaaaaaggttgcgcgtgatcgtgtgaggtaggtctaaaaaaaatatcataaacccttttagatctcattcgtacgtcatgctcaccgagatcgtaaccaaccatatgatcgattgatatttacttttcggactatatatataacatcatatttgtattaataaatacaactaatgttttgcagtactaattataaatcttatactgtaaatttgaaaagttaatactccctccgtcctaaaatataagcatttttagtgtgtgtctgattcatagttaaaagtggctatattttgggacgaaggtagtaggtgtagtttttttataatacatactacataagagaattatgataaaaaaaaaatttattacctacttaaaaaataagggagaggtagcagtgtcataggagtattagtgacaaaaatcaagaaaacaaaatatgacaccgtatctttgaagttgaactgtgaactttctggtcgatcgaagttgtgcgtaattggaatgtgatgagaaatatatatacatagtgcattccagactagccagctgaaaatgatagggcaagctcagcacttacaatgagcacaagatggtatgtatacattacatcctcatccattaactaagggtgtgtttgaggagtaggagattagagtgattgggaagatagctcatgattaattgagtattaactattttaaatttcaaaaatggattaatatgattttttaaagcaactttcctatagaatttttttgcaaaaaatacatcgtttagtagtttgaaaaacgtgcgcgcgaaaaacgagactcaatctcccctatctcgccagaacgaacatagcctaaatattcctcgcaggccggtttacattcaagtgacatctcacgatccatatactccgtactcgtaaaggaagtcatttaggacagcgacacggtatccaaaacataatttgacttcttttttctataaaaatatttattaaaaagtgatatatgtatacttttatgaagtatttttcaagacaaatctattcatataatttttatattttcaaactcaataacttaagagttattcatgatttatattctcaaagtttgacttaaacattgtcctaaactacttttttttatgagtatggagggagtatattataaatcagtacgtagttaagtttgttgattaatttcacctatataaatttcatggatcgagctggggtgcatgacgtaagcgtgaatgacaccaagtgatgcaaatttctgttgttaattcaaggtgtgtgtttagttcctgaaaaaagttggaagtttgggaaaagttgaaagtttggaaaaaaagttaaaagtttatgtgtgtagaaaagttttagatgtgatatgatgtgatggaaagttgaaagtttggggtagttgggggtgaattaaacacggcctcagtcgatcaagctggtcacggcactatgcttgcggaagaggattctctaacttacttccctctgactttaagtcactgatatgtactccctccgtcctacaatataagggattttaagtttttgcttgcaacgtttgaccactcatcttatttaaattttttttgcgaatataaaaaatgaaaagttgtgcttaaagtactgtagataataaagtaagtcacaagtaaaataattaataatttcaaaaacttttgaataagacgagtggtcaaacgttccaagcaaaaactcaaaatcccttatattatgggacggagggagtatggttcactggatagagggtccacacgttagtgacacaagtttctcttatattataggacggagggagtagagttcgctggatagagggtctacatgtcagtgacacaagttagaggaaggtaagttagaggatcttagtcccatgcttgcatgtacgtactcaattcaactccatccatttcatttcaattaattacatcagcatttcaattactcctaaccagcatgcatgcatgcgcgccctgttggatacggaaaaacggcgtgggtatccatgcttgactgccgcgtaagcacagatgcatgcatgccaacgtacgtgacgtcgctaacgtgtgcccaattaatcccagagatcgctatacacacacgcgcgcgtataatatccaactgcatgcacacttgcagaattttcgtcgagatatgatatatatacgccatccatgacgtactgaggcccgttcgaatccagttataaaatgagaaaaaagaataattggcacacagggtaccgagattttccctgcaaaaataattttcaattatttaaaagttgaaaacttgatttgtctaatactagcaactttaatatatataaataattttttttgcaggaaatacacctaatagcagtttaaaaaacatgcaaacaaaaagcgagataaaattttttctccctccatcccattttaagtgtaaccatgatttttcgtgtccaaatttgatgtcttatctaaaagattttttaaaaaaatttaaaaacataagtcatgcataaattactattcatgttttattatctaatagcaataaaaatactaattataaaaaaatttcaaataagacgaacgattaaagttaggcacagaaacttacggttgtacttaaaatattttaagactgtccccaagagaagcaacctaggaggggaacaatgaatctgtaccaagagttgtctagatttattggggttgtctttttttatttttacagacataggattgtctagattcattggggttgtctttttttttttaaaggcagaggaagtatatctaatcagacctaacttaatccattgatgatacgcgcacctctcatctctcgatcggcgcctgtgcccctacgtctctgtcaccgcacgaacgaacgatcatcgactagactgatgcaaacccatgcatgcgcggatgcgccgccgtcgtcgtcgtcagtgtgctgtgctcctactacactgtagatggaagaacagtgtagtaggaaccatgcccatgcatgcagtgatatgatgcaggccatgagctattgagctactactagctagctatgtgatgggaacagtcgctagcaaggctactacattcgacagtgcaggggcagcatgcaacagctacagcagccgccgttgactcgtattcgtgctccctccgttactaaatatttgacaccgttgactttttaaacacatatttaaccgttcgtcttattcaaaacgtttaagtaattattaattctttttctattatttaatttattgttaaatatacttatatgtatacaaataattttacatattttataaaatcttttgaataagacgaacggtcaaatatgtgctaaaaagtcaacgatgtcaaatatttagaaacggagggagtatatatgaacaggacaagttcatatatatggaactgtgagaaggaagaagaggaaagggtggcgccatgatggatcaggatcgacttcacgagcccacgctgccgatggatgagatgattgctcaaatggttataaaaaagttaaaaataattgagaaaatgtattaacattagatatatcattttcacaaacatgcaaagttaaatttcacttttacgtgttatataaaagataaatttaactataaatatacgttaactagctatagtttcatttgttttatttttacaacttgtaaaagttgaacgaaaggagcaggtttacattatcggttgaccactaaattttgagcctcatcagtatcacggttttcaataaatttcaactgaatatactgtttaaccttcgaaatctcaatcgaaacttaattcggtacccatgtcgaaacatcgaaattttacggaattcgaccggttttcgtcggaattgtgaacagggagtatcttactcacatgctccggtttgattttcctcgtggatttatcctcttctcccgtcgccatctccctcgtcacggcgcgcgtgccggccggatgaagggttggtttggtttgtggcctaaatagaccttaccaaattttgtcaatgcccaaattttgataagttttggcatgactaattttggtatggcaaagttgtgtttggattgaagccaaaacagcctaagttcactattaaaatggcctattttcttagacatactaaaatttggcttcaaaccaaatagacactaaacactattgaaattgtcaaatattggtaagcctaatttaagcctcaaaccaaaccagcccgaagtcttcagtcttcacgcacgctgcacacatgccactacctccaccactccactgtagatagtggccatggcgccaatgatgcagccaagcagagctctgaatgcgtatgcatgcagaagcagcagctgcaaatgaacagagcatgcgtagccgctgctactgtctgtgtgtgtctactattccctcagttataaaacaaatactactccctcccttatagtatgaaggattttaaatagatgagacaatttctgtacaaattcattgtacttatagtaattaagtgtcatatccattgaaaatcttttataatttgagatggagcgagtacttgacatttggcaatggccattggctggccaatacggattggcagattattgcagatcagagagatgggtgggtgtgtagacttggcggcttccttccttccatcaaacgtgctgctgctagcttgggcgtgggtcccacttcgccagctgttactgtgtgggccccgttcctgccctagctctgcaagctcaagctgccgagctggctgccacgtccactccacagatgcagatgcagcagctctgatgatctcatgaatctgctacctgctgctnnnnnnnnnnnnnnnnnnnnnnnnnnnnnnnnnnnnnnnn

SEQ ID NO: 15398 - DNA, 7705 bp, Oryza sativa
tactatagggcgaattcgagctcggtaccctctgaatgcgtatgcatgcagaagcagcagctgcaaatgaacagagcatgcgtagccgctgctactgtctgtgtgtgtctactattccctcagttataaaacaaatactactccctcccttatagtatgaaggattttaaatagatgagacaatttctgtacaaattcattgtacttatagtaattaagtgtcatatccattgaaaatcttttataatttgagatggagcgagtacttgacatttggcaatggccattggctggccaatacggattggcagattattgcagatcagagagatgggtgggtgtgtagacttggcggcttccttccttccatcaaacgtgctgctgctagcttgggcgtgggtcccacttcgccagctgttactgtgtgggccccgttcctgccctagctctgcaagctcaagctgccgagctggctgccacgtccactccacagatgcagatgcagcagctctgatgatctcatgaatctgctacctgctgctcatcatcagttctgtgcaactgtgttgaaaaacgaaacacaaacagtttttgggacaaggaaatgttggaagttgcgtcgggggagggtctgatgatcaattcaatctctcctccgccgaagaacaaaacaaacaaatccaatattagatgcaaggagaacgacctgcgagttcacttaaaggttaaatagatgataacccatgaattttcgcgtcgtggcctaacttatcagatctagatatacaaatgggtcaatttataaacttatttatagatcaaattaataggtaacctgcaagtcaaatccgttgattcgcggataagcccgctcgcacccctaggaggagggtctaatgatcaatccaatctccgctgaagaacaaaacaaacaagttatagtattctctgctctcgtctctgaattccaccaacttcatttgctcaaatccaaagcgtcaacatatacaagcacattaagggcccctttgaatcggatgattgctataggatttttgaagcattcagtttcctaaggaattttttctatggaactctttaatttataagaaagaataggattgtatttctattgcgcaatttcatagaaaaataaacaagaggtctaacatcttagaaattttcttttgattcattgtttcctatggtgatattaaagggatcctcttcatatttactcggttttctattcctgtaggattatggaaatatgtcacttcaattcttatgtttttcctattgttgtgtactattcttcatttcaaaggggccctaaaataaaagtaaaattgatactacaatttacatggattggctgggttcatattgccagcagattttccagtgtgcaatgagcagccagaaaatgattaataacgtaagcaattaagggcttaattactttattgtaagaaaaacattaccaatatttggtaataccaaaatttggcattaccgaattttgataaagtaaggtaaattttagttgaaattttgtgagtggaaagttccggaattaccaaaatttgaaaggattgtgttggtaatggtatgtttaatttgctaccttacaaaatattgataataccaaaatttaaaaatgttgacaaagtgaataagctctaagttcggttaataggctgacaaaggatccatttttttctatttcctcatgctatttcttgttgcaaaataccaatcaatatattcagctcgttgtgttggcgacttggcgcaaatgttgtacccgtgaaaatggggctagtgtcagcgcattatctctcacaagagttctatttttctggattagacgaaaacacaagtagtaatattatgcaacaatcaactattgcgttccctttgccttgtctccgacatatatatccatttcatacagcatccctttatcaccaatgtccaatatgcttttcttttcacacacacagtagttcagatgacccacaaaccaaatttacgattgtttcaagagttgaaattctgctagtagaaaattatcactaattaaatagccatgtttagttggtttttagactagacctaactcaggccaaccgcaaaactttgcgttttgaccaacacggtagtggcagttaccgtagcatgaactaggtgtagtttgtttggcacctttgagcctctgtttgttttggaaaaaaaagttttattagcagcttaaaaataatttataggtaaaacttttcttttttttgaggattaaaaaaaagaagaaaagttaatattctaatcgatttaaaagttaatatatattggaaaatagagtatgattaaataccctcaaaatcaactctaaaaataagtttcaaaatttaaattttgaccgcatgcagctgataagccaaaaggcaaacgacagcgttgtttgttgccgcgagaaaggactggaattctaatggaatttctagcttgtgaatttcttatccctaggtttctttgcccccatattttggtgattggagaaattaagggcccctttgatttggaggaaaaacataggaattttagagaattttaatcctatagaaaaatttcctatgaagccatttgaaataaaggattgaatcatattcaatcctttgaaattcctatggaatggacaatcctataaaaattttggaggaaatttagcaagagcttcaacctcttgctaactttcctttgagtctatctctctcatccaagtcctgtgtttttcatgtggttcaatcaaacggtcattcctgtgttttgcaatccgctgttttacacttacattcctatcaaaatcctacgtttttcctatttctacgttttctcaattctgcgattaaaaggggccctaaaggattgataatttttacatatatatatatatatatatatatatatatatatatatatatacattaactaatcttaaatctacccgtgttttgtatgcatgcggccgatccttataaaattaacaataatcctgccctgtctggccacttcctgtgtactgtacatgtaacatgtgtttttcagttcactgtgtgtatcaaacaacggcaagttgcaacgaaagcaagccacttcgcccgattataaatagcctccactacttctactactcgccgccacccaaacccaaagcagcaattgcaagaagcaaaatctcttctcctcctcctcctcctcctcatcatcatcctcctctcgcccttcgacaacgcaccatagtttaacccaagctagaagaagaagacgatagatatgagcactactcgcggcgtctcctcctcttctgctgctgctgctcttgcgctgcttctcctcttcgccctctgcttcttctccttccacttcgccgcagctgctcgcgccgttcctcgtgatgaacaccaaggtagctagctacagcacttggattattgattgttcaattgatagtgtatgcaaattagctgacgttttggagcttttcttttcagagaatggcggtgtcaaggcagtagcagcagttgcagctgatcagcttgtgctccagctggaaggtgacaccggcaatggcgacgaggtctccgaggtgagaatcgatggaaatatacagagctataaatcttcgagtacctagctgattagacaagaattgatgaagaagcaattagtggtaactaatcttgattgttaatttatttctatcttgttcttggtcagttgatgggagcagctgaggaggaagcagcagcatgcgaggaggggaagaacaacgacgagtgcgtgcagaggaggctgctcagcgacgcccacctcgactacatctacacgcagcacaagaacaagccttgatcgatcgatccatccatccaactacacgctgaaatccaaagctaatacaaggaagatcgagatcgagataaattaaccaactctatatgcatatctatctatccatctacctctgcatgctgttttcactgcatcgatcgctactgttctgcagtgccaatcactgtccgtttctgtacaatctgtgatactactagctagtagcagtacatggcatcgttttccttcaagtgttcgttggcttttacttagtccggtgagtgcttgtgggttatttctgacgagggagtgtgatcagtacgcgtactaatggtattttggtttgtcatggcatgatgaaattaagctgtggtagcaatataatgcatatatatattacctttgtctcatgtccttagtatgtagtagtggtaaatagtacatagcatgaataatatacttatcaaggaacacttgtgttttgtttaatggcgcatgtctgtcttcctgtctgtaaaaaagtgtagtacttaatttcttcgttttttaatgaccgaccaacgttaagccgagctatacaaacttggacagttcttctttcaacaatgtttttacaaatggctggaactttaccggagcaaaaaaattctgacaaataaattaacatcaatttcaacgtacaatataaagcaaacaaaagatgttatcaatcagggtttatctctaccaccttaaaagcggattcatcgtcctcctcaacatcgtaatcccgcacgtaaaaaaaacagtttcccaaaaaaacaccccacccaaagatcaatattttcacacaaaaatttaaaaggaatggatagaaaaagaacaaaaccctataattccagtgccattgcaacgtacgggcatgacacttgtaaatactaaaatgcgaataaaatataacgaaacctcaacattttctcgacactaatagttctcccaagagaaacttaatcctttttttttttaaaaaaaactaccagtccaggatcctactaagatcgattgatcagtcactctctgtcagtctgtctacagtgcccaagtcatgggcaattttgtatcaagtctttgttccagattccacatcatggtcatcagaagtcaacaccgtggatgcagctagctgctatacagaggctttgataaatctcatctgaccagcaaaaggggaacacacgaagattctccccacatgcgttggcatgcaatgattcagtcacactgctaacatagctacctatctctatctatctatccccatgacattgcaaattattgtactatgtatcgatcgagcaatttgtggttagctttttcacaaagatgctgtggtagatgcgaaagatgtcgtcgagttggagcctcgaaccagcagtcaaaaattcagaccgaggtgatcacaaagctcattagtatctgagtatctaggtatgtgtgagctaaggtcgtaggttacacatacacacgtactgtctgatcataatctgatctaatcgtcgaaatataaaattgactatcttttcttatcactttaagtttttgttgaactaattgttgcatacaactcaatactgaactttgattgctgaccatgcacgatgtcttgtttggaaaaacatcggaacttcttttagtatcatatagctctagaatctagaaaataaactaaaagttagatgctacaaaacacagttcttcttggttctcaccggtgggctactcaccatctattttttaggatctttagctcgctaaacagggactgagcttaatttgatatagtagaaagtgaactgcacgcccgtgcactagtgtatgtttgggttaagctgagtggccaatagtgatcagctccattatatatatctgaatctgatgactagtgaactagtgataaatcactagtgtgagtagtcagtgacgacatacatatgatagaatcttagttgggcatgcatatgttgctgctgttgtgctgttgtctgaagatatgagtatatatagtagccgtagtgtggtgtagtgcgcgcgagtggggttttaattggttaaaagcatgttggttgctggtagctaggtgtcaggttccctcactagttgattacatgattcatggctttttcgaaatgcatgatttttaaaacacatgaacaaaaggaaatacatatataactaaaatactataacatctcaaattttatggattgaaaaaaatgaataacaataatatgaatgaccatttaaatagggcataggaaaaaaatcgatggaatcagaagttggagaaagattttcccaaatcttaataaaccccggctggcttccgccaaccggcgaaaacagaagttggaggaagatacaaagaatttatttccaataggttaaagcacatgtcagaattcctctaaaatatctatattttgggatataattcaaaggaatctcatagtactctaactaaaaaaagacaaactctaactacgaatatagacacacacgtgtccaagtttatagtaagaattgaacttttttttttgtcggaaggggtagattggacatgtagttaggattggattttttttcggagggagtaggatttttggatagttatttctttgatccaagtgatcatcacataggaaaatcctccaagaatcatttgttcgaagtagccttcatcatcgaagaggaggctagtagtagcagtgtagcacgcacgcatgtaggcgatgtacgctttagttgcttcttttccggcagatgggtgtgtgtgggcgtgcaacagcaagtcagcaacagagggaggtcggccacttcgcaattggagtgaggggccgcacacttttcgcctgcacttgctaagctagtagctgcatgcaaacataatctgtctatcaattcatcagagattcagaatatgtattaagttaaagctattctgttacaggtcgaaaccaataattatttatgaatggagggactaatgtgtgttaattggtgcgatccaagctggtcgatggcttctgcacattttggctggtatgcttgtcttcactctgctggccggtccactgtcagttcagataatgcagggtgttacgctagctaggtcgatttcagttcagataatgcaggcctacctcctcctctttgatttcattgacttcgacgacgaccatacgaattaaaccgtgttaatcacagtggtaaatacttcacctgaaacaatcaaatccatcaagtggcaggttagtactatgcgtttcagacaagagaggcaacagttatactccctgagtgcacaaatatatttgtccataaatataaatataagatgttattttatttgttcataactgtaaaggatttgaaatgttacttatcccatcaatcatattccttttaattttctttgcatcttaccctcaaccattaccattacttatttaatgaggatactgaagtattttctcctcaactttaatatctgctaaacggcctagtggtggagagccagcagcgccatcgagcttggcccaataatagcgtttttcaatagccaactatattttccagacatcgatagcacaatccatagtggagacgcatgtaactgaagagagttatattaatatactccctccgtcccataatataagggattttagagggattcatcatactagaatatgtcacatccctccaaaatcccttatactccctccattccaaaatatttgacaccattgactttttatcacatgtttgaccgttcgtc

SEQ ID NO: 15399 - DNA, 1310 bp, Oryza sativa
gactccacgctttcttcagtctcagggttctggagtccatccactcggaggatcatctgtggtctttagctggcattgtcgcttttagagacttgttgggagtgtagcgtggctcgggcccttcctgctgcttggagtttgtgttttagccgtcgtagtttgtttcctaagcttcaagtttttatttttgcttcggtctggttgattgcgttgtgtaactataactattttcttctaatatattcacgtgcaatcattttgcgcatttgagaaaaaaaaacacttcacatgttccaaaatataatcattaatgaaagttttaaaagaaaccaagtttatggtgaaaaataattgtaattggttgaggtaaagagttaaatagagaaattggttgaaatgagatactgtatgaaaaagtgcttatattgtggtataaattttgaatccttaaaatcttatattttgaaatgggtggagtattagtactctaaaaacagaatgcctactccttatgtccaaaaataagttttactcttttatttactctcggttcacaattaaatttataaggtttatctctttagtaacccctacatgtgcacgtgatactattctctccaactcctaaagttgaggagaaaaggggggtttagtgtacctgatttactttaacgatggatggtcaggggacatcaccgagcatgcgtgtatgtgtatggcctattatgtgagggttgattttaaactctacaaaggatgtcccctagttatttgcatgtcacttaaataattatggaaaaaattaagaagatatattaacatgtaatatatcacttcacaaatatacaagttaaaattcaacttttacaagacatgacgcaacatatagaagttaattttatcttccatgtttatggagtgatctagcacatattaaactatcttgttgatttttttaaatgtttttccagtgacgcaaacaacaaagtgactttctctcgagagtttataatgggtgtgtttagttcacgtcaaaattgaaagtttggttgaaattggaacgatgtgacggaaaagttggaagtttatgtgcgtagaaaagttttgatgtgatgaaaaaaattgaaagttcgaaggaaaagtttggaactaaacaaggccaatagtttctcctattctatctgggttatatattatatgggccaaaacaactgcggtactaattgggccttaaattattcgtcatggcaagcccaacacagggtccagcgacggatcgcatcgcgttgcgggatcagagagaagtgcga

SEQ ID NO: 15400 - DNA, 2459 bp, Oryza sativa
  unsure (1)..(2459): unsure at all n locations
tataggccaattcgagctcggtaccccatcaccgagcatgcgtgtatgtgtatggcctattatgtgagggttgatgataagctctacaaaggatgtcccctagttatttgcatgtcacttaaataattatggaaaaaattaagaacatatattaacatgtaatatatcacttcacaaatatacaagtaaaattcaacttttacaagacatgacgcaacatataaaagttaattttatcttccatgtttatggagcgtctaccacatattaaactatcttgttgatttttttaaatgtttttccagtgacgcaaacaacaaagtgactttctctcgagagtttataatgggtgtgtttagttcacgtcaaaattgaaagtttggttgaaattggaacgatgtgacggaaaagttggaagtttatgtgcgtagaaaagttttgatgtgatgaaaaaaattgaaagttcgaaggaaaagtttggaactaaacaaggccaatagtttctcctattctatctgggttatatattatatgggccaaaacaactgcggtactaattgggccttaaattattcgtcatggcaagcccaacacagggtccagcgacggatcgcatcgcgttgcgggatcagagagaagtgcgatgactgtaaaccatcggactcctccgagcggctagtcgatcgtccccgcgcgttttcctgtccgtttccgtgtcggaatttcagagttgagtccgagtccgatacggagtaaaactacttgatcgcctcgatatattgaaacaccaaacccacgcaacgaactcgatcatctgaagtttccttcaattccccgtcgccgctgatctcacgatatgatgatggccgcggcggaggagcagctcgccacgacgccggagatggagatggagatggagtatatcccactcgatggttacaacagccactacgtgcgcgacgacgatccttaccggcgttaccgcgagctccggatgctcgcgccgccggcgaacgagatctccggccgcctcctcgaggcggcggacgaggacgccgccatgtcgtcgtcgctctgggacgatgagttcgagctcaccggcggcgccgacgccgaccgcttcaccccgcccggcccgcgcctcccgcgcccgcccacccaccacctcaacatcttctcttcccggctgcagcgcctcgcgtccacccgcgcgccgccgccgatgccgccgccgatcgacgatggcgacttcggcgtcgtcttcttgacaggcggcgcccggcgccatgtcgccgtggccgccgccagggtggcgccggcggataccagctgcctcgggaagagcaagtacgaggaaccgctcggcggcggctagacggcgatgggcggcgcggattcgacggggtgcgtgatctgcatcgcggagttcgaggtgggcgacgagctgagcacgatcccgtgcgcgcacaggcatcggttccacgacaagtgcctcgccgagtggttgaagcgaagccgctcctgcccgctttgccgccatctccttcccgccgtcgttcccgccaatacccgccccaacatccattttctttaaataaattttgtgggctttttgtttcgcgtgtgcatgcctgcatgcatgctgatgtatagttgagatttccattcttctgtaaagagcattgagctaagcaaaggcagtgtaatacttcctccgtctcaaaataagtatagttttacactgtttatgtgtcacgtttaaccgttcatcttatttgtaatttttttatgattaatatttttattgttattagatgataaaacttgaatagtactttatatgtgactaatttattttaattttctcataaatttttcaaataagacggacggtcaaacgttggacacggattctcatggctgcatttatttttggacggaggtagtatgtgttttagcaattgatggaccatttttcttttaatctagagtagctgtaatgataagattctcttattcaaacaagtggcataacaatgttttcagaccctatttagatgggactaaaacttaaacgtagactaattataaaatatcacatcggatgtttggacactaattataaatattaaacgtagactattaataaaaccatccataatcttggactaattcgtgagacgaatctattgagcctaattaattcatgattagcctatatgatgttagagtaaatattctctaattatgaattaattaggcttaaaaaatttgtctcgcaaattagctttcatttatataatttgttttgtaagtagtctatatttaatactctaaattagtgtctaaatatagagactaaaattaagtccatgtattcaaacaccacctcagccttgattnnnnnnnnnnnnnnnnnnnnnnnnnnnnnnnnnnnnnnnnnnnnnnnnnnnnnnnnn

SEQ ID NO: 15401 - DNA, 3260 bp, Oryza sativa
gttttcagaccctatttagatgggactaaagcttaaacgtagactaattataaaatatcacatcggatgtttggcccactaattataaatattaaacgtagactattaataaaaccatccataatcttggactaattcgtgagacgaatctattgagcctaattaattcatgattagcctatatgatgttagagtaaatattctctaattatgaattaattaggcttaaaaaatttgtctcgcaaattagctttcatttatataatttgttttgtaagtagtctatatttaatactctaaattagtgtctaaatatagagactaaaattaagtccatgtattcaaacaccacctcagccttgattttacggcagaattcgagttatgcccgtcttaattccaattaaccgcttatccagtgatagaccacatgtttacagatattaggatgaacatcaaattcccccttataattctttttttttcgcgagaaccctttataattcaaattaatgatgtgactatatataatctattcatcgtataactatctgagaccgccaaatcacttgcgaggtcggtggcaagcatgatgagctttttatgccttccttgacgttgttgcgttgcaccaccatcgcttcccatcaaaagaagtgatcatctatggtcaattttttttagataatgaaagttttatttagactcagataattatatcaagatgatacaatcaaactgagtcacccccggcctctgcataaaatgcacacagccaaaaaagaagataaaaataactagaacatctcccaagcataaaagtttaacagaaacatatatcttagtggctatcaatccttaggctagaccgccacccatgctcctgggtaaaaaactcctgtgccacctggtccaactgtcgagataccaccgtatatcttagtggctatcaatccgtagactagatcgccacccatgctcctgggtaaaaaactcctgtgccacctggtccaaacgtcgagataccaccataatagtatcccgcaatcccggttggtggaggatagcccaggtacgtagccaccgggtaactaaggtgataacctgcaaaaaggagaagacaccatcttcttatcaaaaattactccattcctgcttagccaaatggaccaacacagagctgttgcacccatcaaaagcagattcctcatttctttggggacacatgatagccaactcccaaacatatgaccaacattgtgaggaggttttagattagaagccaaatgaattacagaccacaccaagcgagataagcggcactgaaagaataaatgttggatagtttcatccttgtgacagaaacaacatgtattgctgcctttccaatttctcttagcaaggttgtccttggtgagaattacgccccgacgtaaataccaaagaaagattttaactttttaggggtactttcaccttccaaatctgtctattgatattcggaaccccggtatgtgttagagctagataatgagatttgaccgagaagaccccattcggggtgaggttccagtgaaactcatcttgctcctgtactagaaccaaatcagctatgcgaggcaataggttatgccaagcagctagttttgcaccaattaaatccgtcgccatgaaaagcacggaggattggtttggaaaatctgtacgatagtcgactgtttatgcctaactatgttatagagacaaggatactgttctcttaacgaggcattccccaaccatttgtcttccaagaacctaacttgggagccgtccctaattttgaaggatccaaaacggaaaaaatcatgtttgaccttcataagactagcccaaaaatgtgaatcccccgctttccaataggcttgagataaaggttgtgatcccaaatatttattgcgtagcagttgttgccatattccatcggtggtaagtagtttgtataaccacttactaatcaacactttattctttatctcgaggtcatgaattcctagccccccattgttctttgggacgacaaataatgtcccacttagcaagccggtatttcttcttatgtccatccccttgccaataaaacctagatcgaaggtaatcaagttttttaagtaccccactaggaattgcaaaggaatgacatcatatacattgggagactactaagtaccgagttaatcaaagtaagtcgtcctcccaacgaaagaagttttcctttccagctactcaatttcttctcaaatctctcgaccacttctttccattccgcatttctcaacttcctataatggatcagaatgcccagataacggaatgggaagttgccgacctggcagccaaagagctggttgtattgatcactataatcaagtgcttcaccaaaacaatacagttcacttttatgaaaattgatcttaagacccgacaactgctcgaaagctagaagcactgacttcatgttctgagctttttcaaggtcatgattcacaaacagcactgtgtcatcagcatattgtagaatggagagtcccccatcaatcaaatgtggtatgactccatcaatttgcccttgtgttttggctctgtttatcaatgtggctagcatatcagcgataaagttgaataggattggggagagagggtctccttgccgaaggccctttttatctgaaaaaaaggcccgacgtcatcattgactttgattgccacgcttcccccggaaatgaaagactcaatccagatatccacttgggcgaaaaacctttcatacgcagagtttgtagcagaaaaggccatttaaccttgtcatacgtcttttcgaagtcaattttgaatatcaccccactcaacttcttcctatgtagttcatgaactgtttcatgtatgatgacaactccatctaaaatgtttcgtccacgcatgaaaactgtttgggtcgggttcactaaatggttagcaaccgagctaattcggtttgtagccaccttagtgaatattttatagctgacatttaacaagcatatgggtctgtattgttggatttgatttgcttctttaacttttggaactagagtaagtaccccaaaatttagtccgaaaattgggaggctaccagtatggaattcattaaaaaggttcatcaggtcatgcttaataacatcccaaaatttttggtaaaattcagctgggaaaccatctagtccaggagctttattatgctc

SEQ ID NO: 15402 - DNA, 2727 bp, Oryza sativa
  unsure (1)..(2727): unsure at all n locations
nnnnnnnnnnnnnnnnnnnnnnnnnnnnnnnnnnnnnnnnnnnnnnnnnnnnnnnnnnnnnnnnnnatccacttgggcgaaaaacctttcatacgcagagtttgtagcagaaaaggccatttaaccttgtcatacgtcttttcgaagtcaattttgaatatcaccccactcaacttcttcctatgtagttcatgaactgtttcatgtatgatgacaactccatctaaaatgtttcgtccacgcatgaaaactgtttgggtcgggttcactaaatggttagcaaccgagctaattcggtttgtagccaccttagtgaatattttatagctgacatttaacaagcatatgggtctgtattgttggatttgatttgcttctttaacttttggaactagagtaagtaccccaaaatttagtccgaaaattgggaggctaccagtatggaattcattaaaaaggttcatcaggtcatgcttaataacatcccaaaatttttggtaaaattcagctgggaaaccatctagtccaggagctttattatgctccatcgcaaagatggcttctttcacttcttcttccgaaaaaggagcagtaagaaaatcattttcagcttgtgaaacttgagccatatcaccaattatggactcatcaagcgaaaacgagttctcctctggtggtccaaaaagtttcctataaaaactcgtaatataagttttcaaggcctcaaccccctcaattttcccttcatcctggtctaggaaaaagatcctcttcttcctatgtttaccgttggctatcaagttaaactattttgtgttgttatctcctaagagtacgtccgagactttcgagcgttggtaccatttaatctcctcctcacggagtagacttgccaaagaatccctcgattgatcaagaagaattctttcttgatccgaaaggagtcgtacttatcgatgttagagatcaattgtgttttgcaaatttgcctttttctgcttaaagacgccactggtatgagcagcccaacctctaagatggcgaagtaaagcgctcatcttgttattccatctttggaccgcattacgacccttgactagtttgttccatatctcgagaacacgatcatagaagtcatcacgtagaaaccaacccagttccaatttaaactgtttaatgtttcccgtgaaggccgcttcccctgtgtcaaggagcaaaggcgtgtggtctgatacccctctgtcaagagcatgaaccgaaaccaggggtacttggattcccattcaattgatgtgaggaccctgtctagtttctcataagtaggaatgggaagcgaatttgcccatgtaaattgcctacccgaaagagcgatttctcgtaagtcaaagctatcgatcacaacattgaagagaaaaggccaacgagagttgtaacgggcattgtttttttccacactacttctcaggatgttgaagtccccccctgtaagagtaggtagatgattttgttggcatgtacgaacgaactccgccaagaaactagatttaaaatcatcttgggccggaccatacacagccatcaagatccatttaaaattatcctccctattgttgagatgaaatttaacgaaaaattccccttcaacaattaaagatatatccaaaacagctgcattaattccgagaagtataccccctgatcttcctttaggtgggagacaatgccacatgaaatcagcacccccagagaggcgatctaaattcatctttgacatttcaccctttcttgtctccattaacgcaacatagtctagtatttttctctctaactgtttctgcaacataacggtatttagccaagtctgcaagacctctgctattccaaaaaatacctttcatgaggaaacagatttagaggcttttggattttgggaacgagcctttcgctcttttctttttgaagaagatttggatttttctagtggataccaacaagtcacaaattttgtcactttggtccacatcgtccatatcaatctccgtgagatcctttactaagtgagcgagtagggcaacatcatcgtcgccctcgtcatcactagttgtaaaatgatccacttctgaaaaaacgtgcttagaatggttacattcactagtcttgtttgttgctttagttctatcaacctcaatatgtttcaaagcgttaagcgagaaagaaatttcatcatgagagttacccaaagaaacacctaaagaactaagattggaagcaacaaaatcataatgtaaagaaggtaaagaaggggatgaatttataacagtatcttcactagaggatgttttatgagaggccgagtgctgctaagaattcgttgccgaaacctcccgtccaacaaagctgtcatccaaattgcgcaatgctttcctcttcattgccttgagcagtgagtcatcatcccccgcagcgatgccatccatgttctcaacattggatctcacactacgacaacgaggtgtagaagatgtcttgctcagttggtccttgctgcgattgacatcggttgaagtaggtgtagccatctgaggtacagctagggagagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15403 - DNA, 1463 bp, Oryza sativa
cataatgtaaagaaggtaaagaaggggatgaatttataacagtatcttcactagaggatgttttatgagaggccgagtgctgctaagaattcgttgccgaaacctcccgtccaacaaagctgtcatccaaattgcgcaatgctttcctcttcattgccttgagcagtgagtcatcatcccccgcagcgatgccatccatgttctcaacattggatctcacactacgacaacgaggtgtagaagatgtcttgctcagttggtccttgctgcgattgacatcggttgaggtaggtgtagccatctgaggtacagctagggagagtgcagcagtggtagctgccaaagaggcctcgccggtgatcttggcagctgcagccggctgagaggacagcaaggaccaacgttccaactccggtggcagcaaacaaggttgatcgggtgtaggactgtccactggttgagacaaataaatttcatccaccttttctgctgctgttattacctcacccaccactgttgcacctgatttggtgtgaacaatggtgtaagctatcccatttgcgatcaccagacgaggtggtggtggaggccgacaatttccaaacggtgttagaactagttgcatggctgtaacatctgatttttgttcctttgatattgttggagaagctgaattcttagccctcttgtgtgcctgatcatgagagccatcctttgacgagttttcatgatcctcctgtgcatccccgtcatggtccataaagtccacctccgaaatctgtgccggctaacaaccttcctcttccaaagcaaaagtgattgggtagcccaatttcccaaaaaccacatctgtagtgacagggagttgtatgctacaatgcatacaaaccttcacacgaatcactcccgtccgcctgtaggtgagcatatctacttcctgagtagctccaataacacaaccaagtgcccaaaaagccaagtaatgatgccatgggctaggcacacccgacacatgcacccacacttcatccaactcatatgccggaatcagctcatcagtcgttttccactcgattattgtcattgacacaccatgattttttagacggaattccacatcatccatcctcttcaattcctcaatggaaggaaaagcgacaaggaaggaattctcagcatgaaggactgcctcccacttccaatccggtctgattcgatgagctaactcagtctgaactatttcaggcgtcaaggagccgccacgaatagagaccaaagctgttggaaccaatgaagcctcctgtacattcatcccaaaatcactgatttggataaaaccgaactcggttttcccaaatccaaaaagagagcatgtaggtttcggcaatttgagcagcgggcacttgacagctagatgtgactctttcttgttacatacatagcaatcgatgtccgctttacat

SEQ ID NO: 15404 - DNA, 3586 bp, Oryza sativa
  unsure (1)..(3586): unsure at all n locations
nnnnnnnnnnnnnnnnnnnnnnnnnnnnnnnnnnnnnnnnnnnnnttttttacacggaattggacatcatccatcctcttcaattcctcaatggaaggaaaagcgacaaggaaggaattctcagcatgaaggactgcctcccacttccaatccggtctgattcgatgagctaactcagtctgaactatttcaggcgtcaaggagccgccacgaatagagaccaaagctgttggaaccaatgaagcctcctgtacattcatcccaaaatcactgatttggataaaaccgaactcggttttcccaaatccaaaaagagagcatgtaggtttcggcaatttgagcagcgggcacttgacagctagatgtgactctttcttgttacatacatagcaatcgatgtccgctttacatacctgcgctatgtgaccactcgttttgcactggtgacagtgaggtggcctcggcttcttggccttagttgcttgtacagtaggatgtggctgcccaccatctgttgtttggtccagtttctccgtttgctggccttgcgccgccatccccttcccccgaggtttgggcttctgatcttgctggtccggacacgggagatcatcatggtctcgcctgtgatgacccccagcattgtttccctgaggaaaccatctgttgctattgcattgagactgcccggcgccttccatgccaacgccctcccgatcccccagtcccagacccaccggcatggttgcccccgaacctcgggaaaaccggtggccgctaaaactggcgcggaggatagtggtttggcccgtgctgatttcttgcattgaaaggtggattccctgtggctccatcatcccgtcgctgctcggccgtcgctgcatcatcacgagggcgcgccgccatcgctgcctaggagggtttcttcggagaactctcgctagatggcgtgcatctgtttaggcgaaagtgggctagggactttccacgaaattggtttccaatcggtctgtgtgggaaggaaggaataccgacactcataactgaattctggggaagggaattagccaaaaatcgtcctcccgcactttgatcgactcggtttgatgcggacaccatcgattgccgatcttgggtaggtgttgattttgaatttggtgaagttttggcccgcggcaagaaatctgccagcaaaactgtttgcactggccgtggacgaggtaatggtaccttccatggacgcattacccatccacggcgatggcactcagtggattttgtcttctgttttgatgagactctggtccactgatcgtcctcggtgataggtggggcagtcggagtcacccctgacactatcgggcttttttgttcccaccaacgagaagcaggagtgggaaaaccaatctcgtcccagaacccttggattagggagagatcggactctcctgattgagagtcatgcgttttcagtcctataacctccatgccggcgagagccgttgagccgttgtgatgaacttgagcgggagaatcaggagcagaagttgtggcagccatggttgcaatcagattctgtccacaaacgtggtcttgattgcagccggctgaattaacgatctctccttcctaaatgacgtcagttaggctggagaagcgagatccacttaccggcgaaggaattggtgctagggttagccgacgtcggtgggagtcatggcgccgtccatagaccttcagacttcctgcacagagatcagcacctgcatcctaggtaggaaaattaccttgctcttgtcctgaggaagaagaagccgccaccgaaggagatgcactcatcgccggcagtgaggaagaacctcaggggagcctccaatggaccattgatccgtttttggagcaaggacacagcgccggcgagggaaggatacagctccactcccggccgtcggcctgaagaacgctgtttactagactgaagaatgtcggacttgaaacattggcccgattcctggttccggaggtgttgacagaaaacacgaggcctgggagatctgcttaactctagtgcaggtccaaaactcgccttcggatgtatgagcgtgccagttgatttgatcctgcaatcaacaagaaacaaagacaaagaaaccgtggttaaatccacaaatgatagccaatcggctagatgccgatgacatatcatttgtctttgagccgatgtcatatgtagatcgatcggcaaccatgaataagtaaagaagaactagatctactcgatcggctgtagacattaacaatatataatctttatgtcgatatattcttaaatcaggtgattgggatagatcggtcaccatgccgagacagtataaatcatttagatcgaaagatatattaacaacaagattatatatgttcatagcatagccgatcagataaatttagcgtgtattggctaatactccgatacgactttatattaagatgctagggcaagtaaaatatactagacagaagcctaatatacttaaatgtaacaagatcttaacctaaaggacggatttaacatatcaattaagcatataagataaaagtaattaaatcagataagatcggctgaaactccgatactactctaatcggcaaccagtaggcaggctagagattgaaattctaaacacgacttaatagatcaaactcaactgatgtagcattaagtatgaaaagaagaacaatatctagacaatcaagccgctggatgtttcataaagtggtggatatcttatataatctaagccaacgtcgttatttaacctaatcggctgccttctggtaacagatattagccgattgcaggttagatgacgatactgtcaaagattatgtaagatatatgataactcgacgaattacataaacaagactagagtatcataaagatggaagcactaatcttgagaacgcaagccgccataacaagttttacctcttgttgaagatcgaaaccgatgcagctcaacccgaaagcaagaactcgtcgaaataaaactaaaggaaaaagggtggcgatgcgccgaaattgtattgaacgtgtgtgttaatcattacatagagctcggggcctatttatacccgagaattacaagatatgcccataccggacacgactgttatctctaacaaactctaagatatcacaagtctttacggcagacttttgcccacacttatctataaggaatttacataaaatatcctaattaatagatacaattgccttcccaggactctatccgtgcgtggcaatcatcttgacgcacatcaactcgaacccgatgtcgtacacagatcgtattgtcggaatcagctgtatcacctaacccggtctaactcggacttagccaatcccaatcgtagccgatcctgactccagccgatccttactctgtttccataacaatcctcatcttcgattctgcctcgaccccatcttcatctccgatgctgatattaccaaatttggtcgttaacaagaggaggactccagtggctggtaccgagaaaaattcgccctatagtagtc

SEQ ID NO: 15405 - DNA, 3725 bp, Oryza sativa
  unsure (1)..(3725): unsure at all n locations
nnnnnnnnnnnnnnnnnnnnnnnnnnnnnnnnnnnnnnnnnnnnnnnnnnnnnnnnctcggggcctatttatacccgagaattacaagatatgcccataccggacacgactgttatctctaacaaactctaagatatcacaagtctttacggcagacttttgcccacacttatctataaggaatttacataaaatatcctaattaatagatacaattgccttcccaggactctatccgtgcgtggcaatcatcttgacgcacatcaactcgaacccgatgtcgtacacagatcgtattgtcggaatcagctgtatcacctaacccggtctaactcggacttagccaatcccaatcgtagccgatcctgactccagccgatccttactctgtttccataacaatcctcatcttcgattctgcctcgaccccatcttcatctccgatgctgatattaccaaatttggtcgttaacaagaggaggactccagtggctggatggccagcgccagaaacagggccgccacaggcaagccaaggaggccggcgtcaccgccggcgaagccccgacagccgccccccatgagatcgcccagaaatcgcccctgcacaaaacccggaattcaaaatgtgaatccaattccgcgcgcgctgcgactacgccacgctatccttatttagatcgaaaattgagcattgcaacttgttaggttatctaagatcaccgacttatagattcgacatgaaaatcctcaattaccatcctactgacataaaagtcaccaacccaatcatatctaccccctccgtctcaaaataaattaacttttgaaattcaaactttgtcccaaaacaaatcaacttctaccttctcatccaccctcggttcgcaaaatcgaaaaattttattccttcaataccccttacctacctattcaccaatactaatttgctatttataatggatattttgggcctttattctcttatttaattttgcattgagaaactcggagttgcctctttatgagacggagggagtatttggtaaaatttggcccctccaactttgaatatcctctaaatgcaacagccctactctcccatagtcccataccgcaaaaagagagaagtctaaataaacgtccaaaaacacggaatttttttattaaaatatttaaaaatatattttttctttcgaaaattaacaaatctaatcgcctaccgccctttgggagggcgatttttaaaaacctaaatgcaaaatttttatttgtgtttaaaccctttccaccggttttaattgcttaaaaactaataatgcttattcgatactccaaatgattttaaatggaaaagtgataaactacaaagttatagatctcatcaagatctacaacttttatataaagtttatctccattcaatgtcgtttgaaatgtagatctgagattttttaaaatgtgttttatattttgtaatgaatatttggatatctaaaacatcttaaataaaaaagttgttaactacaaagttgtagatctccttgagatctacaattttgatataaagttttatttcatctgactttatataatataattttaaattataaaattatagagctaacaagttgtgctgaaaaatttgcatttaggtgccttgccgccctctggaagggcaaagggcggcaggcgattagatttgtaaattttcgaatcaaaaaattatttttgtaaatattttaataaaaatgtataaataaaaaaattccaaaaacacgttggattagattcgggccaacccaccttgaacataccaaaccacatagggccagcccaccttgaacataccaaaccacatatttcggcttgggcccagtttccatagaatttttttcggttttagatttttttaatatttacagaaataatctatcgaccaaaaaaattgcagaaatagcccctgccgcccacctctggggcagcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaagaagagaggggaggagaagagaagaaggggcaaagccctaccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaattaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatctaggtgtgcagacgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcagtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatataaaggaggcggtaaaacattttgcagtgtcacttcataaagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgtcaatttgnnnnnnnnnnnnnnnnnnnnnnnnnnnnnnnnnnnnnnnnnnnnnnnnnnnnnnnnnn

SEQ ID NO: 15406 - DNA, 1078 bp, Oryza sativa
ctactatagggcgaattcttttctcggtacccgatccccccccccccaacacgggaaccgtccgatcgagaacgtgcggttgaacaatcaagcggacagaggcgagcacagtatatggtgcaagctgcggatgccagcgacgaatatatgaagcagaaattttgatttttgagaaagagcaggtggtctatcgatcgatcacatccaaggcaatttcttcatacggatatcatgtcccaagacgtgcatccagctccagcttgctagctcccgattccagtcatccagtgtctcaaactgaatcagaccttgtttaccgatttactgaaccaaatataagcagaaggaaagaacaggtggttcagattccacaatcagaataactctctctgaacattgcttgtttctgcacttttgttcttgctactagctgagcaaagttgatgaaatgcggtgatctacaacatcaagacatcaaacacacaatcaaagtaacaactgataaggagaggttatatacaaaaggaagcaaatagaggagcaaggaaggaacagaaggttcagacttcacaatcagaatttagaactctactctgaactataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccggcagctgagctgcactggccgccaggccgccaggccgccagccgccaggccgccagtgcacagtgtttttttttaaaaaaaaagcaaaggaaatgtataaggaaaaaaaattaaaaatggaaataaaatgtttaaaaaaaagtaatgatttactaatgttaaaaaatggtatttaaaaaatggaaataaaagttttttaaaaaagtaatgatttgctaatgttaaaaaaaagagaaaatggtat

SEQ ID NO: 15407 - DNA, 4653 bp, Oryza sativa
  unsure (1)..(4653): unsure at all n locations
nnnnnnnnnnnnnnnnnnnnnnnnnnnnnnnnnnnnnnnnnnnnnnnnnnnnnnnnnnnnagtaatgatttactaatgttaaaaaatggtatttaaaaaatggaaataaaagttttttaaaaaagtaatgatttgctaatgttaaaaaaaagaaaaaatggtatttttttgttgtgttgaaaaatttaaaaatatagattgtgatttattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagataatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttcttctatatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttattggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgtctgaaccggtaccttctctacgacaggcgtatgaaccggtacctcctacacagatgggggagttggagccgatccggaggtatcgtcaaacctcgacatgtagttggggtcgaaatcacccaaggtgaacgacggcgactggtatggaaagttcggatccattatgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagatttttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgcgccgctggcccgctttcggcctgacgggccgccggcgaaacgggccgtgccgtgccgcgggccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctactctgaacattgcttatttctgcactctgttcttgctactagttgaccaaagttcatgaaatgcagtgatctacaacatcactacatcaaacagacatccatagtaacaactgacaaggacaggttatttgcaacagaactacattcaactgatcacagccggcctggagttcattcctgcttgaacaacaaaggtacagagatcatactacacacccagaacactgaagcacttgccatgcaggcagtacttctcttttatgaaaagatgatacagatcagttgcaactatgttacaccaccaccatgtacaacgaccggacaccgaaacatcatcctagtgcagagctgtgaggattgcagtggcgctctcaacctagcaatgcatccagaaaggtcgaatgagttcagatcaaatgcaaatgatgaaaaaaggagttctgttttattgagtcaagttaattaggatcccctcgagggatcaaaatagtttccctcaacattatattcttggcaagaaatcaatttcctttttaccttgaaggttgcaccacagatctcttcttcatttgcaggaacagcagtcaccttgttctttgggttctcatagcacttcaagcctccaagagcattggaatagaagcaacctgcagtcagaatgcatgtaattagtgagcataaccaaaaatggctctttgcacatatttgagcagtgaagattcaactgacccacaattttatactaaatgccccattttaaatgtcatttgcaatgattggcaacataaaaggactatgattcaaacattaccttgtgggaaaggtgcaagtgacttgccacatgatcctttaagcaggtcaatgtcgttagagaaggcaacagatccatcagcagttatcccccagaacagaggcaccttgccctctggatcctgagacaacaattgccagcacaagatcacgtcataatcagtaagctaaaccaaccaaatcaccaagcactgtcaatgcaagtgtttgagcaacagcatgtaactgtcggttgcctcgagatgaagaactcacagaggccacaaggagagaagaggtggacttgtcgaagagcacaaaggcgtagctgccggtgagctgcgagagcatgaagctagcagggtaaggtgctctgtctctcagcgtcttgtacgcctcgataaccaggagcacctcattggcgcccttggacaggccatactgctggctcagcctgcccagattgtccagnnnnnnnnnnnnnnnnnnnnnnnnnnnnnnnnnnnnnnnnnnnnnnnnnnnnnnnnnnnnnn

SEQ ID NO: 15408 - DNA, 1904 bp, Oryza sativa
  unsure (1)..(1904): unsure at all n locations
tcaccggtaccctaactgaagaacaaattcagagtaaatgactctgtctcagcctctcaggatgaacagttaactgatctagccacagagagcaatcaattcttggctctgttcttagctagatctcgtgaaatccaggacttggggagttcagggtaaagaaaacggcagatgttttttcagcaatttcagctgaagcagagtagaagcagcagctagtataccttgggcggaggagggattggttggcgtgggagtaggcgaggtggccaaggtcgccgagctgcagggacacggccggctcggcggcggcgaggaagcggccgaccagctccgacgcccgcgtcttgggcgacggcgtccggctgccggcggccaccagctccgccggcacctccaccaccgcgccgctgaacacagccaacatcctctactctactgtactgtctgtctaatcaaagctaattaagatcactacacacaaactatgaaactactccaatttaatccaatcctactgctaaaactctcctctgctaatgatcagattagcatagataaaaaaaaaatacgtgtggcgttccacactccttggatggatagatggatggagcaagaaacggagctcacactggatggatggagaaatggaggaggagaagctgctttatatagccacaaacccaagcaatggagctctgtttacgtgggggccgcactgacgttttcttgtgtgttaacctccgattaatcttctttaattgtttttctcctgactaaaacaaaacgtctcgtgcacatgggcgtgtcaaaaacaccagcttatgtctgtacttttaatggagtgtaagttttaattagtcaattatatcaaaatcgtagaactacgctgagaacactttggacgtctccatagttagatgcataacgtcaaaacatacggcatacttacaaataaattttataatcaaagaaggtacaaagaatgttaacaatagactatatgttgtgtttaagatgagaggagaagatcgagaagaatacgcaaaacaatgtaaatattactacatgattattgagtattaactattttaaatttaaaaaaaataaattaatatgattatttaaaataacttttctatataaatattttatgaaaaacgtaccatttaactgcttgggaagcatgcacgcacacaacgaaagagtttttcttctaatccacagctgccgaacccagactaaatcatcaacgtttctgggtaaaatactccctaaccctctgctccaaaggttaacacagccataaagagtccatgaagagtcattgagtgcaaatgttggacacgagatgttacaactttgataccttttcttcctagcaagaaaaatatataaatgatttttttttctgaaacaaagttttaaactctgttactaatctggacaatcaacaattgggccgtcaggaaaaaatggatgcgagaatggaagaaacggaaccgagatatttctagagaatcatatcacattgactaattcgttcaaagaaaaaaagaactctgaagccagtagctgctaatttgattaggtgaagcatggtgaagaagttgataggtgaagcgagggaagcaaacaaggacgaaggagatgaggtgaggatggtgatggaatatattggatgcatcttgcacgatttcttgtgagtgacacttgttgtgatgtgtgctttgtttccatgtgggaatctaatgcggccacagaaacggccaccggcattttggcctaccggagcagatattgcgtggcacgcttgatgatgcagtacttatttcaagaccaggaaannnnnnnnnnnnnnnnnnnnnnnnnnnnnnnnnnnnnnnnnnnnnnnnnnnnnnnnn

SEQ ID NO: 15409 - DNA, 1026 bp, Oryza sativa
  unsure (1)..(1026): unsure at all n locations
nnnnnnnnnnnnnnnnnnnnnnnnnnnnnnnnnnnnnnnnttcaacaagtacaatgaaaattcacttcttgtttttctgtctatatcagtctgttagtaacatgatttagtcatatttgtttgtccattgtttcacaggcagagaaggtattcaaccaagatttatacttcaagcggactgtgaaatatgttggggagcccatgacccacttggagtctatcgcttcttctgcggtgtgtttcttctcttgttcccaaaatttcttaacgtttattgtgcacatataaaatatttttgactattccattgttttttgcttcacaaagtctttatatgaaacaagggtttcttagtctgaaattgtttcttgcctattttgcaggtgcgagctgctatcaaagtgaaggcttctgtcattatttgcttcacatcatctggacgcgctgcaaggtagaaagatgtgaatataaacaggataatggtgtagtttaatcaaaactaatttcatatttcatctggtatctgtaatgtctgcagactaattgccaagtacaggcccaccatgcctgttctatctgttgtcattcctcgtctgaaaacaaaccaactgaggtggagtttcactggcgcatttgaagtatgtaatcagtccttcccttctatgtttatgatcttttttctgatttttttcatgtaacatgctttctgttatctggtttatgcctgactattgtatctcatatttctcgatgcttttctttcaggcaagacaatcactcatagttagaggtctctttccgatgcttgctgatcctcgccatccagtaagtactattgcaaaatatttgtgcaaaacacacttgggggattctttttcaattaaacaacacacggccttttatcatgggggaggaatgaactcttgcagatttctaatacatatcaatgcctattagatatatagcattaaacataacatgctagtcttattgcttgcatcatgtcccactgttattgaaatgtta

SEQ ID NO: 15410 - DNA, 434 bp, Oryza sativa
  unsure (1)..(434): unsure at all n locations
nnnnnnnnnnnnnnnnnnnnnnnnnnnnnnnnnnnnnnnntctgttaatgcaatatcagtcatcaaatatgtgtcactacataatatttatataggtatatcttttagttcaaagagtataattcctcctgttaaggggaatttaactatttgccacttttaggtttgccacttatctaaatgctcctcttaggcttgcgcttaataatttaccactgaagagatgatttcttaactatttgccactgttgcctacgtggcgtgcccgcgtggaaagtatcgtggaccccactcgtcagccctcccctatccttcttctccaccgtcgctcgccgctcgtggccgccactgccgctcgccctccacccgccgcatccgatccccatccccgcaatggggggagcgggacgagccgttgtcgccgccgccgctcg

SEQ ID NO: 15411 - DNA, 814 bp, Oryza sativa
  unsure (1)..(814): unsure at all n locations
nnnnnnnnnnnnnnnnnnnnnnnnnnnnnnnnnnnnnnnnnnnnnnnnnnnnnnnnnnnnnnncctgtataaaaatccttatccccatctcttttacctcagtctcgcgtataccctagtaccaacgatccccatactgtccaaataccgtagtcacgacatcaaacgtcgacaatattgattctagggttgaccttggatccctatatgcattcctattggacttcgacacgatacaagccccaacgggtccaaagactatgacgcgtcactatgatagattctggacgtcgttttgttttgatgattaccgttgacttggaaggaatttttatgtgagaccatattcattggaaagatgatctcattagctttccatacatatgtaaaacgtcaagagcagagtccgaatgaaatccgggcgatgattctaatgcagattgttcctgtagtccgaggtggacttgaacttgatataagttcagcctccatcttaaattgaatgcttatgacagccttgtccatctcctagcctctgtttaagtgctatctggtcatcggcatagtttcaaaatcacattaagaagtacttagtaatgaggttacctgtaaatttaattgtcggatgtgagctattataccttgcatagcaacttgaggttgagtgtatccgaaagaatgatgtccttatgagtgatataggtataccaagtagtttttattgtttttaatgaagctgtaaatttttcgcagttattcatagcacaacctttataataattggttgggtaccgagctcgaattcgccctatag

SEQ ID NO: 15412 - DNA, 10859 bp, Oryza sativa
  unsure (1)..(10859): unsure at all n locations
nnnnnnnnnnnnnnnnnnnnnnnnnnnnnnnnnnnnnnnnnnnnnnnnnnnnnnnnctattttcttctgtataaatcgtgcttgtttacggtttacataatacctaatatttacatctgctctttatatcctgataatgctagcagagaatactcgatattatctgctatatatcttgtcttctagaaaatatttttcaggaacaattgagcactcgagtaggttgtggtcaagtacaccgcattatcgagaacgatctcgacgaatgcagagtcgtcgcgcccaacctgccaacgaagaccgacgacctatctcatagcaccggccatggctggactactcgagaaaaggttgttaacggacaattcctcgcgaacgcggtcagcttgatcacccgacatgattgcgaacggacatccggatatgctacaagttgggtgtgtgagtcatgctggccacatgagacgcacatgtaataaaccaactctagcacttccattggtgttcgagagatgattctactcgctcgctggttctcgaaccagtacgtagcaatctctcgcaccgcaacttccattggtgttcgagagatgattctactcgctcgctgttctcgaaccagtacgtagcaatctcccgcaccgcaaacttctattggtgttcgagacgcaaacttctattggtgttcgagagatgattctactcgctcgctggttctcaaaccagtacgtagcaatctctcgcaccgcaaacttccattggtgttcgagagatgattctactcgctcgctggttctcgaaccagtacgtagcaatctctcgcaccgcaaacttccattggtgttcgagagatgattctactcgctcgctggttctcgaaccagtacgtagcaatctctcgcaccgcaacctccattggtgttcgagagatgattctacacgttcgctggtcctcgaaccagtacgtagcaatctctcgcaccgcaacctcagatggtcgaggtacgactacagcaataacgcagcggtcctcgtaccacaacttcaaatgatcgagagacacctactcattggttctcaactagtcaatcgtagcgatctctcgtacatttacttctaatggttgagttacgactattacctggttcttgaccagaggtgtagcgattctcccattacctctacttcaacaaagttgatatcaggtacacaatatcgccaagtgttttacccagagatcccttaccacaaagacacctagcgttgaaacctatcctaatgtccctttacgccgtcttgacaaggcctccgaggaacctaagggaacttcggctggggacgcccagagcagataaggccttgtcggatccttcaaagatgaaagaccatgtaagatctggtcgtgtaagagttctcgccgtgcgtattaaccaagccatgtaatcggaaatggattttccaacttcacgggtgggggctaagatcagtgcttgttcaaccgatgcaagtcaaaggtccaagagccttatcctccgagaacgattctccgacgacaaggctgggggctagggagagtgtataactcaacaaactgactgatcgaagtcggtaaaagagtagacgctcatacacaaaacattggtctgtaagtttaattcattttcggttttccatacatattataacatgtcatcctttgagcattcgctggggggctatttctatctaatattctttcctgagtattgatttcaggaaaattctattcgacattatcgaagactccatgtctctatgattctacatcaagatcgactaaggcgagtacgacaaatgttgacaaggccccgttacagactctacgcctactcgattactcgagaacggttggtggatctcgacaaggaatacggaatgaaaagatggtgaacctgccgagataaaatttcttaaattcaatccaaattctcgattacagcaagacaagagacttagtcgcatgctctgtactttcttggttgacgtcagagattgactcagacaaaccctttaggtgcccgcacgaggctgataaaggaagtctaacgttatctctggactcatcgagaacggtcatgtgagctcgataacagttcctccaaggtctgcggttgagaatatgaactcgctcatttgcattgaagtcgggggctactgtcagggttatggataccacatacataatagtagttgactaaatctcggcagaacccaccacatactatgtactatacggaaacaacctgcggatatatgaagagttccggataagggaagacaaccagagttctacatggaaacgacaaggactactcggattgtatccatattggttccctagttctacttggacaaggggacacctatgggtataaatacaaggccccctaggaggagaagagacaatccacatacccaccatagaagagacaatcaacacacccaccatagaagacacgggcaacatagacaccacaaagccaatacaagccaacatacaccaagacaagacgccggatatcgatttcagggataagcacggctagtcccctacggtgtctccggatactgtcaggagagacgaaagcgctatctctgatctcgccggacacagattcgaggaggaagactaccctgttgtcgactacgagtcagaccttcagatcgccatgtcgacaacagttagatagactaccccaaatattatactggtgtgattatggtgaataagagcaataccggcttcggccaacaggatgtagggttattacctgacaattcaggggcccgaacctgtataaaaatccttatccccatctcttttacctcagtctcgcgtataccctagtaccaacgatccccatactgtccaaataccgtagtcacgacatcaaacgtcgacaatattgattctagggttgaccttggatccctatatgcattcctattggacttcgacacgatacaagccccaacgggtccaaagactatgacgcgtcactatgatagattctggacgtcgttttgttttgatgattaccgttgacttggaaggaatttttatgtgagaccatattcattggaaagatgatctcattagctttccatacatatgtaaaacgtcaagagcagagtccgaatgaaatccgggcgatgattctaatgcagattgttcctgtagtccgaggtggacttgaacttgatataagttcagcctccatcttaaattgaatgcttatgacagccttgtccatctcctagcctctgtttaagtgctatctggtcatcggcatagtttcaaaatcacattaagaagtacttagtaatgaggttacctgtaaatttaattgtcggatgtgagctattataccttgcatagcaacttgaggttgagtgtatccgaaagaatgatgtccttatgagtgatataggtataccaagtagtttttattgtttttaatgaagctgtaaatttttcgcagttattcatagcacaacctttataataattggttgtaaagccagaacgaaaaacaatatttttttaaaaaaaacaatgagcatgagcatgtaggtcattggaattgaatgagtactctgaatcagggtttcccaaaccgccggggccggggttatcgcgccccagcggtaagcaaggttaccgcgcggtaaccgtgaaaaaccgtatgaaaccgcgcaaaatttatcaaaaattcaaattattttttaaatttatttgaatttgaggaggttaccgcggtattttatattaccgtacccccgcagtaagcccagtaaccgcggtaaccgcgcggttaccggcggtaagtcgaaccctgctctgaatctcttatccttcagaaatgcagagtttgtagtgcagaagacatcaattgaggctgtgtttagttcccttcaaacatccaaaaattccgtcacatcaaatgtttggatatatgcatggagcattaaatgtggacgaaaaaaaattgcacaatttgcatgtaaattgcgagacgaatcttttaagcctaattacgccataatttgataatatggtgctacagtaaacatttgctatgacggattaattaggtttaatagattcgtctcgcagtttacagacgaaatctataatctgttttattatttgtctacatttaatatttcaaatgtatgtccgtatcgataaaaaaaatttgggcatgaaactaaacatggcctgaatttgttaccactgtacgcctaatgagtccaaacgcgtaatttggttagtacgcttccacctcttcctatggcaaaatgccaaaaatcttcgcgggaaacccaacccaaaccacacaacccttttccgagtctaacaacaaaaaaaatcccatctcgcttcacccatgctcctcctcgctccctcaccagcggcggcggcggccgccgctcgccggaggaaggtcggtggatcagccctccgcgtccgctgctcgagcgtgcgggaactggagagatccccgaaccctcgtccgggggagcggctgccgccgctgcgggaggcgaagcgggtggtgctggtgcggcacgggcagagcacctggaacgcggaggggcggatccaggggagctccgacatctccgtgctaacgcccaagggcgagtcgcaggcggagacctcccgcctcatgctcctctccgactccttcgacgcctgcttcaccagcccgctcgcccgctcccgccgcaccgccgagatcatctgggccgaccgcgacgacgacctcatcccggactctgacctccgcgagatcgatctctactccttccaggttgggatacttctcgggtattaggttgctcacaggatgttcgtgcaaatgcctgaacggatgtatgcttggttggtatcactgtctgaatatttgcagggattgttgaagaatgaagggaaggagaggtatggagttatctaccggcagtggcagaagaacgcggccaacttcagcattgatgggcactacccagtgcgggagctctgggaccgcgcacagaactgctgggagaggatcctggcacatgagggcaagtcggtgcttgttgttgcacataatgcagtgaaccaggctcttgttgcctcttcgttgggttggtgccactaggctttgctgttgattctatagttccaaggttgtgcccaattgatctctggtttactggttttcgcatttaggacttggcacagagtactttcggattctacttcagagcaattgtggtgctagtgtgctggatttcacccctcaggctggtggagggcctccagctgtatgccttaaccgcttaaatcaggtgtgtgtgtgcatgtgtgtaactttcagttggatggatgttttttttttccttttagtagtatgccttgcctaatgcaagtttcgtaccatcttctggataagtaaaataaaataattttgtgtcaaaacagaactacaggtggaaaaccagtaaatataggatttaattgtgtttccatgtttgcagacgccaaattctcctgttgcctcaggaagttctgcagggagaaagacaagcaagaggattatcctagcatgtcaaggagctacacagaacagtgcagaggtatatattctcatttgtgcatccatgcttgcatgaaaaaaaaagcgctttttctatggatcaaaatgtgaaagcaaagataattcactggagaaactgtgtacattgatttcaagtatagaagggataccttaagaaatccttaaaacggtaatgaagggatttgaacccatgaccttaactatcttaacctgtgctctaaaactggctaaatttatgcaccttttatggatcaatacgagccacctactattttcctggaggtctgctttgtagttctttaaatttaatttgggaaattaagtgaatcaatctcatttgttcaagtattgtactaaaaaactaaattaaaaattcgagtataagttgtataaggaaaggtttttattatatttctgtaaagagtacccccaggtagacaatatttacctgttgagctttgctgcttatgtatgtaattacactgtttctattacagattggtgtcagtggaatggggtatgcaccgcttaacatgcttgggattatacaggtaattttcttctttgtattgcaaactgtatatttcattattctaactaaaacctaagctcattactggccaaatgttttcagtctcagaagactgcagaactacttttagatcaaaaggtaaatggtattctctgtagcccacaagttgcagcatttgatactgctactactatatgcgaggtaactacattctgaagtctgaacaatttgcaaagtttagtccaatgcattatcgttttattgttattacctgcttgatctaaccatagtagagtgaattgtaggttcaagaggctgcagattgcttaggtgctgactgtgtgcctcgttatgtggaaatgaagaaactgctagaactagaaattgatgatgccttccaaacaaagcaaaaggttagaccatttccacgttccatggcttctgtcacagtagctttactagtgcatagaatatttgaagatcctgtacatgccttgaaaatccacacttgcaatagatggcagggctatctgcctattcattaaagagagtagtgttttacactatactaatagcgcctctaccaggcagacacaccaagttgacacccacaaaggaacccaaaacacaccatcacccccacgcaaggcaccctagcctgggaaagattgaaaacactttttggagatcaatatttgcaaagataatgcaaagcacaacatttagtgatcagatctataatgagtgcttgccagccaccatattcttcttgctaaagctatcccatcttatgtacatactggctggttgcttggttacctggaaattttaatagctccctgcatttcgtggggtgttcaaataacacttggttttcttctgtagagctttggagaaatagctcagtctgggtggctgggcagcatggaatacaaaactctggaggggctatggaaccagtcgaaagctgcatggcaagccttgctaaatgagttgcaagatgatacttcagaaagaattctggtggtcgtaggacatccgggtataaatctagcattgatttgcaggtgtctggatttaacgatggactacatgtcatcttttcatctagacgatggcagcatcagtgtgatcgatttcccagatggaccaaaaggaagaggtgttgtcagatgcacaaattacacagcccatctaggaagatggtcaatacctattaccaggaccatggaaactgatgaagagttctaacttcctgcaaggtaatgttctggtgtaacatccttcaggaaagctaagtatgtcaatatcttatactgatgtacatactggcatcttgattaatatctgtagatctgatatgtaaatagcatccttctttcaaacaaaaggaatatgtaaataacctttttttctgaagctaaacagtaaaagtatcatactgtttatatgtaaacatcatttcatatccaccaccattgtgttaccgctgtttgagtatcttcctcgccggcccagccggctggctgccttccacgggagcatgttgccttcgcctcgtccatcctgtcaccacgctcattggcgtcctctatgctgatccctgcggctgccgtttccctcatccagtgtgccacctttggactactcgctgcagcgggcatgattgcagttctctctgctgctcgcgtcaggcattgggtgattgagtccatggtgaatggtgttgctgctgcctaatttctgtcacaaccacgaggttggcgtgttccaggtatgtgggcgtgttcactacttcattcctgatacacaattttgttaacataaacagtaattcatattttcttacaaactgaatcgtaagttttaatttttaaatttacatttcttagattagagcagaagcggtctctgttaatgaaatcaccattgcatcaactgcacagacctatatgattaaggtacaaaagttttccggttcagtcagtagactcagtactgtaaaccgcaatgatgtgtgtgtcaccctcaccatgggcaagccatactgtaaccataaatctgttgtactacagggaaggccatggctgtcattgtgtcataagaaaacagggctcattagactgcttctgcagtcaagagctgcgtcggtgcagacaatcttccatggacaaagggcctggtacgcagcatgaaatggacactatcactatgtttgtaggtgtcttcctctatctacattgtctgccttgttctttctgtaagttgggttcggcccttggtgttatctgcgcctgcaaggggcaggagattatatgactatcatatgcgaagatatttctcatttggatagaagagatttaggtgagagctcaaacaaggaattatcttgaggtgttatggtgaagcatatggagaggataagaaagaggtgggcacaactttgaacgtaaaaagatgcatgctggagctcagattcacatcgggttcgaacttgaagtgtgagcaatggtggcgactggcgaggtgattgacgatcctgaagagtcggtttgtgatctactatgaagtttgtattgactattaatcacagtaaggttgcatacgagtcccaacgggcttctgtacatctgcaacctgtgagtacaatacaagtgatgcaaacaactgcagagacaatgcttaatttgcaacctaggtattgtgagctgtccgggccgctgggacttctctgctatcttttcctgtgtctacattttatgcaggaacttttgcatagttggtagatgtttatatcaagcagagaagaaccatattcccatcattaatagttctggaccatccaatatatactgtctcagaactcataaacatgtacctactgtgtccttttcgttggcaaccatggtttcatttttatagctaactgtactgtagttaccaaactcatcatttttgtgccaacaacacttcagttcatcagagtcaagctcaaatagggagtgtttatctgcacatgcagtactcaatttcatggtagttatatatttatttctgcagcataatggcttaccgatgcatggctaggttccaaaatcacttgattttcttgatttacgagatggagttttgcctgttctgtggaatgaaccatattaaagcggtccaaaaaataggcatcagtttagtctcatatttaacttaaggtttagcatgtaagctagatgtctctttttgtttgactttgcctctcttgatgagtgtaccatcatattttcctactgatcttggataactgactcatgaagggaaatgtaccctattcaatgcacataaggatacctatttcttgttgccagaaaggtcctaatcctactgcaggtactgtaaactgttcaagatggggttatctcatgctttaggctactaatatgaagccatatacatcaatggcttccccaaaagggtataatgatgagcactaacaatttacctatccgtatgggcagtacaacttatctgtagagttccaagacaatgccagtttatgttactcccctactcggtaattgtgggtgcgtcaacttgatttcagttttggcaaggtagtatagaatggaatcatattactgttgaaggattctttaatgtcaagctaaacaatgggcccatcatggaatggaaacttctcacactgatctgatcagcagattattattttgagcaatttcaacttgcagctagcatggggatgttccaacttcaactgcacagaagaagacaagtttgttttcaactggtatgcctttatttggaaatctgaatttttatccaatatttctctcttatttttagtaggtatgatcagagaaggctttgtactctctcgtcaactgccttgttgcagtcagttagagttatatatattcactcgaactgcataatattatctagcagcttgttcagtagattagaaacataaatgcctcctacgtcaacttgtgcttgctgtatctttaaaaactgcagcgttatcttttcctagtttaacaaaaagacaaaagaaactgtccccgctacacacggtttgatggttatgctgctaaaaatatcatgcagcatgatatattactgtttgcctcttcgttttgttggcagttggcaatgcagtcgtttatgctcttgccaactggactaaatccactggagctgtagatcattccgtgtgaagacccacattatcggagtatcacaaaatagacattataaacttaagtatattattttgtttttgctggttgaaaactaacaaattgcggtcgatgattttcagggttccttgttcccttgctgtcagctgaatgtctcatttcagctttaccacgtatgcctcttttgtgttttctgtacttataatatttgcattgtcaagttgtcctagtttagtcaaaaagagaaaaaaaaaagaaagtaagaaaagaaaccgtgttcagtgtacattggtcatcttcagttattaaaacatacaagtagactatttgcctcttccactttctggcaatacatttatcttcttgccagctggattgaatcatgtagatcgttgtgtgaagagccaccctatctgatgtatcagatgaaaaaacctattaacttgctgtgttaacatttggggtaccgag

SEQ ID NO: 15413 - DNA, 1109 bp, Oryza sativa
  unsure (1)..(1109): unsure at all n locations
cagccatgtcaggatcagtgccggtattctgtctgtacccagatgacctgactccagtgactcgtgaaggtgaagagaagccgcacaagcaggtgatgatcttttcttttttttaattaggaacttaaaaagtctactccctccgtcaaaaaaaaaaagacaaaccctggtttctgtgttcaacgtttgactgttcgtcttatttgaaaagttatgaaaaaaattaaaaaaaataagtcacgcataaagtattaatcatgttttatcatctaacaccaacaatgaaaatactaattataaaaaaatttcatataagacagacagtcaaacgttggcacgggaacccacggtttgcctttttttttggacgtagggagtacgtattttccggttggatgtagcctttttaaattactccatccgtcctattttaagtggaaccatgagtttccgtatccaacttttatcgtttgttttatttgaaatttttttataattagtatttttattgttatgagatgttaaaatatgaatagtattttatgcacgacttatgtttctaaattttattaaaatttttttaaataaaacagacgatcaaagttgggcacgtaaaatcatgtttgcacttaaagtgggacggagagagtaggaacttagcctaactactagtccgtccccaaaaaaaaaggtaaaccctaactacgaatctggacacacatgacatgctgcatgtgtctagatttatagtcagtattgacatgctactcagttcattgcaaccaatttttgccctctcactccgactcgtccaacactctgtccgagagcgtcccattctcctccgtggttgcatggaggacatgcatttagcctcgacagttgttctcccatgttatacagatcatcgtatcatagcatccacgtcctcgtcacccctccgccccatcctcccaaccactcgagaaagcagctggaaggcgacgctgtctaacccatctatgttcgtgcgccaaatgcatcatggcaccatcatcatagtctggaccgtcgtccgctnnnnnnnnnnnnnnnnnnnnnnnnnnnnnnnnnnnnnnnnnnnnnnnnnn

SEQ ID NO: 15414 - DNA, 675 bp, Oryza sativa
  unsure (1)..(675): unsure at all n locations
nnnnnnnnnnnnnnnnnnnnnnnnnnnnnnnnnnnnnnnntctactaacatttgggagtcctctcgttgttgcgcaggtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggtataccttcagtagttcagtgttatttatatgaaatattatgattgtttttacttttgttgcaatcagatcggtccttgactgtttcctagagaaattttgtatgttaccattacgtcaccgcaatttgtagcatctgctatgtgaaaaaaattgactctttttgtcctttgcaggctctgaaaccaggtgctacaatttttgtggggcaatacttgttcactggcagtgagactacttcagtttggttagaggtaaaaatcttcagcatgctaaaactggtgttctgtgtttgtgatgtgtaatgtgttacgtccttgttagtaggatgtgcttgctgtctacattttctgatacctaatctccattctgcttgatataggtttctgaagttaaaggagatgatgtggtttgtgtgataaaaaattccgctactctggct

SEQ ID NO: 15415 - DNA, 932 bp, Oryza sativa
  unsure (1)..(932): unsure at all n locations
nnnnnnnnnnnnnnnnnnnnnnnnnnnnnnnnnnnnnnnnncagaccgaagcaaaaataaaaccttgaagcttaggaaacaaactacgacggctaaaacacaaactccaagcagcaggaagggcccgagccacgctacactcccaacaagtctctaaaagcgacaatgccagctaaagaccacagatgatcctccgagtggatggactccagaaccctgagactgaagaaagcgtggagtcgaaaaccctagagtttcatttcttccacaactgccaaaagatcaggagcaccagggagtcgaaactggcgcggagatgctcaggtaatatcaggccctggaggacggccaccagagattgtgttactctagaccttctactccctccatcccataatactcccttcgtttcaaaatgttatgacaccgttgactttttagtatgtgtttgaccattcgtcttattcaaaaaatttaagtaattatttattcttttcatatcatttgatttattgttaaatatactttcatatacacatatagttttatatatttcataattttttttaataagacgaacggtcaaacatgtgataaaaagtcaatggtgtcaaatattttgaaatggagggagtataagggattttggagggatgtgacatattctagtatgatgaatccctctaaaatcccttatattatgggacggagggagtatattaatataactctcttcagttacatgcgtctccactatggattgtgctatcgatgtctggaaaatatagttggctattgaaaaacgctattattgggccaagctcgatggcgctgctggctctccaccaataggccggttagcagatattaaagttgaggagaannnnnnnnnnnnnnnnnnnnnnnnnnnnnnnnnnnnnnnnnnnnnnnnn

SEQ ID NO: 15416 - DNA, 1323 bp, Oryza sativa
agcacaagatcacgtcataatcagtaagctaaaccaaccaaatcaccaagcactgtcaatgcaagtgtttgagcaacagcatgtaactgtcggttgcctcgagatgaagaactcacagaggccacaaggagagaagaggtggacttgtcgaagagcacaaaggcgtagctgccggtgagctgcgagagcatgaagctagcagggtaaggtgctctgtctctcagcgtcttgtacgcctcgataaccaggagcacctcattggcgcccttggacaggccatactgctggctcagcctgcccagattgtccaggactccctcaaacaggcagaaaatgtcatcttttgatgcaaaggatctgcacaaatgcagttgtatgttctcagtgagcagctgtaaaattatagatgctttccaaccctatgataaaaaaaaactggcatccacaacaaaatttaagaaaattagtatgtttggtgttatcagttcagccattcttgaatgcctgaaggacatggtacttcagtgcagaatgcaaaattaggtggaacatctatgacttaatgcaagatgcacctaacatcaagaattagatacctaaacttgctgaaaaggaagcatatattttgtactggtataatgaatggagtaaaggagtggaattccttggatgatacttcttcagtgaatctgcctagtagtactagataagatatgaaaaaagggtaatcaggccccacaaatcatagtgctgaattgacagcatggcccccttgttcagctttcctttctttcagatctgtgggtatcaaaaccggatagagtcttctggtaagcagtagccaccaagtgctaagtgtcctacactcctactatgaactaagccatgtgaatggcacaacaactaaaggaaaggcataaacaaagaggtttttaaaagcaacctagtagcttgccaaatactgtcatgtttatcctttttaagtttttataattaagaaataggcttgacaaaacaggtttgtccattttcttaaaactataattagtccaatcattagccgcctgatgaagaatatgaggcccgtttgttgtgaagtcaattgaaacctttgtatctgtggaaggtggcttgatgtggtaccatgcaaaataacaaaaggtgatgcggtggccttctttcatcgaaatatatgtggcaatgttcatgtaaacattgatttaactttctttcctgtcatgttctcctcttgtttttcctatggaagcaccaatcatttgaccgtaaagagatctaggggtaccgagctcgaattcgccctat

SEQ ID NO: 15417 - DNA, 631 bp, Oryza sativa
  unsure (1)..(631): unsure at all n locations
nnnnnnnnnnnnnnnnnnnnnnnnnnnnnnnnnnnnnnnnagtatttatatgctcaaaagataagtgaattccattaaatcaaatatagcataggataatcaatcttaactctatagcattttctgttgctaacaccatattaagagatatagcataagaaatgtctttggtctcaaattttataatgaatttaaaaaagctaacggagcagcaaaaactcaataaacctcagagagctgtggtatttttgatagcgtcaagaattgttgtttccagtttatcctcagcaacccacatagagcttttcttgcgcaagagctccctgtgatccgccttcttctgtactttaagcttctccttctccctccagctctccagcttctcagctctttctttcatctgtacatgatctcatctcagttatacacatatatacttcgctgggtctttttattttacacaagataattgaaacaaattaaatttgcagaaaatttctaaaaacatgtagtatactacttaatcctctaataagagactcgttcagcaaactaggcaattcaacaaacaagtcgtgtgcaagggtggagaatgcgaaataggggggaagagagggagaggggaggatac

SEQ ID NO: 15418 - DNA, 724 bp, Oryza sativa
actatagggcgaatttttcttcggtacccttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataact

SEQ ID NO: 15419 - DNA, 665 bp, Oryza sativa
  unsure (1)..(665): unsure at all n locations
agtatttcttccaaacattcagtacttgtcactaagttctggttctggataatctatcatgcacgtgcattctctattcgtacttgttgaattgttcgacctgtttgttgaattggctggcatctgttctgttacattacatctggggttgggaaaggcaagtatgccaccatggcaacttgatactgcattagcgccgtgtcgcatataggcaatgtgtttatccatagaaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagannnnnnnnnnnnnnnnnnnnnnnnnnnnnnnnnnnnnnnnnnnnnnnnnnnnnnnnn

SEQ ID NO: 15420 - DNA, 809 bp, Oryza sativa
tcggtaccctggttagttgtccttcttcaactgttgtgagatgattctctaatcgtaatcctctagctcctcctctttacaggcgattgcatacatgggagatgacttcatgtttcaattgttcgggaaatacagagatatggccttggctgtgaaaaatccatgtcatctcaacatggccgcatgcctaatcaaactgaagagattcgatgaagctatcgcacagtgtagtattgtaagttttttttgtttgcataaagttcaatctattaaaactcatgctgtcacactcacaccagtcggtttgtgtatagcttcagatgaattaggattttgatttgactttcagacaataaagacatacaacatgatattattatggtaactagacgcttggaccaaaaagtgaagaatatagtgcagttgcctatattttcctcaacttatttttgtaagacaaccctcactaatttcatgacgtaactgacctggcaattcatcaagtgaagaatttttccccctttttccgaaaccgaataattattgactggatgatgaactcataatcctattcttcaggtgttggcagaggatgaaaacaatgtgaaagcattgttcagacgaggaaaagcaagagctgaacttggtcagacagaatcagcgagggaggacttcctgaaagccaagaaacattccccagaagacaaggagatccagcgtgagcttcggtctctcgcggaacaggataaagctctgtaccaaaaacagaaggagctgtacaaggcctctttgggccaaggcccgaaccc

SEQ ID NO: 15421 - DNA, 719 bp, Oryza sativa
  unsure (1)..(719): unsure at all n locations
ttctttttgtcggatgctgtacaggatgccggcaacaaagcccatggggatctactcaggtaagcctttcttactgttgatgatgctaaccttgtgactttaactacctttcagaaatttgatgggatgtatggccgaccaaccatgtagtgacaatcatgaatcatcacggtctgaaaataacatatcggttggtttattgtgatgttgcactcacaacaaacctgatgaatgcaactcgttttcagctcatggggatccatccaatggcaattgtcggtggaaggcaaaataggtggaaactgttaaaatgagacaattcatcaattgcaaataatcccacttcagaaaattttggagctaaccttcgatgaaattgtcgttacgacctgcctcacgaaattaaatcaataaatcatgtgattgtattcttcaagttgaacagtcaagctgcctagaaggatttttattgcctattacaatctgtatacatagtataaaattctgacttacggagtagtaaatttaacagcacacagacattgttataagaattccctagtccctgctaaacaaaggatgaattttatccttatatatcttttgattaaaaaaaaatttctgaaattctagcattagaaaacaatggtaatgccttctttctagtttttttttctgtattagnnnnnnnnnnnnnnnnnnnnnnnnnnnnnnnnnnn

SEQ ID NO: 15422 - DNA, 730 bp, Oryza sativa
tataggccaattcgagctcggtacccataaaaaattttatgatatatatagacactaattaattttacttgcaaaacaaatacatccatatattaaatcttaacatgtctggtaattatcgaaaaataaagttgatcaaatttgtaccttggaactaatatcactaccttaatgaagaatagaatcgcatcatatccattatttctcatgaaaagatacttctcgagcatttcttgatgcaaaatcatcaagaacaagtcgacgatgttgtgcgcttgtgcggttgtgccctgtgcgatgcgatgtcgtctgccgagttgccgacgacgctacaactcctatcgtctctcggacgtttctgcttccagatagacaataggcaggtactagactactagtattaggtgttggcccctccaccatcataggcccccgaccatcatgggcccccggcggtcgcctcggctgcatagccctagggccggccctgatcgtagcaaggtacactcacgaacaacagtagaggagagcaaaaaggccacgcgttttttttaagaaaaatgatgacactgaaacgcacgtatgactcgctcaccgggcttggaaaatttggagtgagcacaacaggcgtggcggacctctcagtagacctctcgcgaatacttgctacagtaaagttttccacttccctactcctctctctttcctccggcctaaggtggcttctcgc

SEQ ID NO: 15423 - DNA, 788 bp, Oryza sativa
  unsure (1)..(788): unsure at all n locations
ggagagctcctgaactgccttgcagcaatcggagtcattatggatttccctccagctatacttggcatgacggtcttggcttggggaattcggtgggtgacctcgttgctgatgtagctttggcaaagtctggccagccgacaatagccattgctggctgctttgctggtccaatgttcaatatgctggttggactgggaactgcacttgtaatacaaacagccagggtgtaccccaaagcttatgtactcgaattccatgttggaattgttgttgcatttgtatttcttcttttgagcctgatgggcaccctgttgatggtcacctggactaggtttcgggttcccaggttttggggttactgccttatggggctttacatcttgtttacagtagtgagtatagctatagcgagctcttctggatgatacatatttttatacataaatagcagctagtcgtttgcagtatatataagtgtttgcaatttttccagttgctgcagagcaatggttcatttcgatggggatggttcacgaggtgcaagatgcctccaggctgcaatacaacttcttatcttggcagctgatgcatacagcccttcacactgaattggcttgtactggtctggcatgttcctgtggattcttctgtaccttcattttacgagttcatgagttcaggccagaggggagatcttgctggcgatgtgcatcagtgcatgcactgtnnnnnnnnnnnnnnnnnnnnnnnnnnnnnnnnnnnnnnnnnnnnnnnnnnnnnnnnnn

SEQ ID NO: 15424 - DNA, 1155 bp, Oryza sativa
cagctttaccacgtatgcctcttttgtgttttctgtacttataatatttgcattgtcaagttgtcctagtttagtcaaaaagagaaaaaaaaaagaaagtaagaaaagaaaccgtgttcagtgtacattggtcatcttcagttattaaaacatacaagtagactatttgcctcttccactttctggcaatacatttatcttcttgccagctggattgaatcatgtagatcgttgtgtgaagagccaccctatctgatgtatcagatgaaaaaacctattaacttgctgtgttaacatttgatttttgttcttccccggttgtcgaaagctaaagagaactgctgtctatcattttcagggatcctttgctttccttattttcaggtgagtgtcccatttctccattaccaacttaatgcaagggacagccctttttttctcatcgaatctaaaaacaaagtcaacaaaccttgctccaattttctaatgcctctgggatcaagtgcctggttttccgtgcccgatgaatgaatcacactctcacaccccaaagcagattgtcctcccatgactcaatttagtatacttcagttcagcatttttataacccatactattttgtattctcgcatctctgatcagactgattcattattcatggaccaatgggccatctgctctgcagggtcagcataagcacagcaggttagcccattcgttctctataatctggcgtattctttcagttagtgggttaaacgcaatgatcaggtgaaaagggtgcaaattgatgagattacggtcacatttccgtgcaacccttttttatctgccatgtgtgcgttggagttttgctatttaagagcgaatagtacagtgattgtgctggttccttcattgttgaatcatctctcaacagcaatacgggcaactttcagagaaattcagacttgagcccaagagacaagggggacaagttctttttgcttcatttctaattcaccatcacgctttccacgacgttcgtttggttacttagttaatcctcaataattggggaggtgaaaccctttttggtttatgattaaaacctgtaggtaacaaggtgacaaacctggcatagtattccattggatttgtgaatcttgagagggt

SEQ ID NO: 15425 - DNA, 2174 bp, Oryza sativa
  unsure (1)..(2174): unsure at all n locations
nnnnnnnnnnnnnnnnnnnnnnnnnnnnnnnnnnnnnnnnnnnnnnnnnnnnnnnnnnttcgtcttatttgaaaagttatgaaaaaaattaaaaaaaataagtcacgcataaagtattaatcatgttttatcatctaacaacaacaatgaaaatactaattataaaaaaatttcatataagacagacagtcaaacgttggcacgggaacccacggtttgcctttttttttggacgtagggagtacgtattttccggttggatgtagcctttttaaattactccatccgtcctattttaagtggaaccatgagtttccgtatccaacttttatcgtttgttttatttgaaatttttttataattagtatttttattgttatgagatgttaaaatatgaatagtattttatgcacgacttatgtttctaaattttattaaaatttttttaaataaaacagacgatcaaagttgggcacgtaaaatcatgtttgcacttaaagtgggacggagagagtaggaacttagcctaactactagtccgtccccaaaaaaaaaggtaaaccctaactacgaatctggacacacatgacatgctgcatgtgtctagatttatagtcagtattgacatgctactcagttcattgcaaccaatttttgccctctcactccgactcgtccaacactctgtccgagagcgtcccattctcctccgtggttgcatggagacacatgcattttgcctcaacagttgttctcccatgttatgcagctcatcatctcatcgcatcctcctcctcgtcacccctcctgccccatcctcccaaccactcgtgactgcagctggatggcgacgccgtctaatccatctatcttcgtgcgccaaatgcatcatggcaccatcatcatggtatggcccctcctcccctgcatgcccaaaggatgaacggacccaccaaaagccctcataataattttaaaaaaaaattgatttactcgaagctaaaaagaagattgtgcggtcgagatctagattacttgtggataaatgggtgacggtactttctcgtctgattaggcttgcttattgtcggtaaggacgtagtagaatcatcgtttttcttttgataggatttcagggaagctaaagatttttctctagttttcatttctttaaacatgtgataagagatggaatacagaaaggtttgcacgttagtacgtgtgtatgtgtaatcgtaagagtaaaatcaaatcacatatagctaattaaaaagaggtgaaaaaggtagaatgacgctaaaaaaaagagagaagagaatgcggtcgagatcgggtttacttgtcgtgcataaatgggtgaaaagattgttttctcattttttttgtcattagtatattacaacacaggaatttcacgcgaatttaatttattattatatccaaggggtattttttcccacgtgattccggaaaaaaacatctccactcgcactcctgtacggtcgatcggacggtccacgtcgcgcgagttgatgatccaacggtcgtcatcgtctcaggcagacttaaaggcttcctcctccccaacctctgctccggcagttaccagttgagcagcctcgccgccgtctccgcctccgctattatgagttccactcctccaccaccgtaacctctactctactagccccacctcctcctcctcctcttcgccgccgccgcctccgcctccgccgccgcagatctcgccgcggtagcgggaatggtgagcgcgtcaagcctgctgctcccgtcgtccgtgcgggacttcgcctcctgcatcggcgacggagccgtccgcgtcgccgacgtcgcggcgtgcaccgcgccgtcctccacccgcgtctccacctgctcctcctcctcctccaccaccgcctcctcctcctcccgacgctctccgtcaccgtctcctaccgcgccaccctgctcgcggcccccgcgccgccgctgcagctccgcctcacgtggggacactccccgctcggccccacgctgtcgttcgcgccgtcgcccaccgcccgcgccatccagctccgacggaggaggggctcccgctccctcccctcgggctccagctccggcgacgagaacgggggtggtggtgatgagtccggtactaccgggtaccgagc

SEQ ID NO: 15426 - DNA, 3947 bp, Oryza sativa
ggcgacgagaacgggggtggtggtgatgagtccggtactacaacgccgcccccgcccccgccgctcgagctgttttgggatctcaccgccgcgcggtacgaccccgcggcgtcgtcgccggagccggtgtccgggtactacgtggtggcggtggccagcgcggaggtggtgctcgcggtgggcgacctggcggcggagttcgtcaaggctaagttcgagggccagatcccgcgcgcccgcgtcgcgcccgtctcgcgcgtggagcgcgtcgtggtgtccgacccggcggcgatgcacgccgcgcgcgtccggttcgcggagggcgggcccgagcacgaggtcagcgtcagctgcgcgcccgccgcccccggctccggcggcggaggggacgagctgtgggtgtgcgtcgacggcaagcgcgcggtgcaggcgtgccggctgcgctggaacttccgggggaaccagacggtgttcgtcgacggcgcccccgtcgacgtgatgtgggacctccacgggtggtggttccgggagccgccgggctgcgcggtggtgatgctccgggcgaggagcgcgctcgagagccgcctatggctggaggaggaggccgccgcgccgggattctccctcatcgtgcaggcgttcaagtcgccaccctgacgaacgccatcttcttcttctccaagaggtcaaatctgttcactgctctggttactgtctgtctccattgggagaatttggtggtctcaattctttaccaaaccatcaaagcaaaagcaaaatgatgtgtggttgttgtttattgcaacttaggtgttagatttttcatgttggggagaaaaaaaacacaagatcatgaacagggcatatacattgatgagattggtgtgtgtgtagtgtaggatcctcttcttttatttcttcatcttttctgaataattgttagtttggtattgtgtccgtacagttaacaaacaacaacagaaagcaatttagagtgtgttttaattctgttaattaagctgtgctgcatgaggtggtgcagccagaaaatggattgtgaagcgctggtttatgcttgatgtaaaatttaaaatcacgcattgcatttactcttttattgcccttatgcaatgcagcactgcagtgattctgaatttctgatagggtgacttgcattatttttgtactgctaccgagccgtgtgtgtgtataccaccgcataccgtgtactgcaaatctgcaattcaacaaagggaagccacagcttaagttcttgcactgtgccatcgaaatctcttgcacggtcgatacatctcatacatactgtgcggcttaactgttgcaattgagatctctggtactgattcctgacattgcatattgattacatcagttttatcttatgattgccatgtcctgctacatcttgcatatgttgttcaccagttaacactcatctgcttccatcagttgttgctctggtccaactaatcttggctactttatattgtattgctctaccatagagtccaaggctgtatgcatagtatagctggtgaagcacatggtcttctacactctacactgtgtaggcgtaatggcattcccagatttcacctttggtcccagctgcacactagcatcgggtgtacaactgtttggtgtgtgcttcacggtacaactcgtgagatgagaccttttgcttttctgctgctgctgcttctcctcacgagagaatgagttggcctggatccttccttcccctggtggttctgttttttcccctggattttcttaatctgttcttccatttgatgccaaattgccaacagaattttggggggaggaaagggttgatggtgatatcacccccacatgtgatagtattgtctcaatcatcagctctacactaaactatatttgccaagcaaccgtgttggtacatggcgacaaacttgtcccttattctgtattctcccttcttgtacgcttgctacaatagcatacgacaatgtctttattagtatttcttacatatgctcaaccataatttatctccctggctttctgttgtaaccatctgatcaccaaaataaccctgaataattattaacttttaccggaactgattaggaatctaagcgcagggaatgaagcaggagagaatccctatctttatcaactggattagatcaacgccggcaagccatctgaccttatctttggttgtttattactatggcttggttggaggttggccaaattcagttgttgctttcacgatttattatgcattgctttcaaggtatgcaacgtataggctgatgatatggcgacactgtaatgtatatatgctggatttttctggcagtgatcatactgttccagtgatttaacctctgcatttacctttaagataatctcagacccatcattcaatcttcgttgctgcacgtctcgagaactcgatgatttactcctgtctgttgagtgtttgggtagctaatgtctcgtaaggttaatgcacgtctcgagaactcgatgatttactcctgtctgttgagtgtttgggtagctaatgtctcgtaaggttaaggcatgcaagttttttgaaacaaaagcaacgggctcactctttcactatctgaaattctgaattctgttttgctttctctcttgggtcaattccaagtgtacatgtcactaatgtactggttacacatttgtatcgattccatggaagaaattagagagttgtaaaactatcaaaatcaccgcccatgatatcaatttattatatagtacgcatctttcagctagtggcatatattatcactgctctcatcatcctgagccatcgaaatatgcaaatggtccatcaattttacatcacgattgtgatagtgccatacgcaggatggccattatatattactgccaaacatcagtttggtattaggggatccaatagacatgaaaaataggcatatgtatatatgtccatatgatataacaccattttttttctctcatgttaaatctccattcggtgaagtgcttcaactcggtccccccttttgccctctatttttcccttttcattcgtaaatgctatgacaatttgcccatagcttcctttgaaggctacaaggatacttgctccattgattttttttttatagggcatattttgatttcaaaaggtcaactttgtcgattttgatcgacatagcaccaaacatctctcaaatgaaaagggaaaaaggggaaagaaagaaagagagtagtaatatcgctcctctttagatggaatttaaatgccgatgtaaatggcctcacatgaaagcactgataacatctcactgtttacctttgtactacgagtaattaaccaccaaacctgggtcattgcaaacctgctctcaatcaaaagtttaagcacaagtgaatcataaaaactatttaggaatctgtcactccatcattaacaccgaaaaggaaaaaaggcaaaagtaattaagtcacagcaaccaaaagatcaccgaaatttattccaagaataaccgaacaagctttgaacggaatgcacgggatagagctgcattacagctttagctaagctacaccagctcaacactgaagcagcagaaacatgcaataatggaacctaaggtacatctatcacagctatctgcgtgtgtagatggatggatggatacctgaaagtacttggaacaatgatgcaatggttgatgccatggcggatggatgcttgatggacagttgatgtcgtcatcatcacgccgccgccgccggtgccgccggtggtgcaggcttggaggcgacgacggggaagtcgacgacgacgaccttgtcgatcgccgccatgaacgtgccggcgaactcctggtgtctctcgtggctcatgtaggtcgtcagatcttcag

SEQ ID NO: 15427 - DNA, 1042 bp, Oryza sativa
ctcttccttgaacttcaccaggcaaagatgcttgacctcccccattgctgaagctccaaaaaaccaaaaggtgcaaagaaaaagctctcctcacactacacctccaggtgaagtgcctttgcaggagagtgtgatcatcacaccatgctgctggccaccattttaagggcagagtgagtgagtgagtgagtgagtgagttaaaagctctgcatctgctccggtgagggccaccaccaccgacaggaatcactgtaaaacttattaaggcctttcatggcagtacacttgattgaatcatgtctgcacagtccagcccccacactgttgcaaaggcagcagggaagatgaagtgatgaaccattgctgctgcctgctggtttgatcagccacacagtttagatctagcaggaggccatgattgggccagccgacatcgttgcgtggacaaccataggctgttctcctggccctgcaagatttggttttcagaggagagatcataatctggactttaatcttcagatcttggatcagagattcagagttatgtagcattgtgctggctcccaccattatcatgctttgagtgcttgaccaactaatctcaggcactttaccatggcagcatcagactcttaacaaaaataggacattggagccacatgctgctgcagttaccgtatgaatggcactgtgctgatgtctgactaacttgcttccaagtagatacagtcacagacaagatggcaaatcggtcgctgatcttgatgctgttcagggagaatttttgcatgactacatgagtgagacagctacattgtgttcctctcataccctgatccatgaactaatcaagatgccctcctcctgttttctgattgtattgacagctacttctctttgtgattttgcagatgtactgctgttgacaacaacaattcatcagtcgggatgcaataagtgagacaagctatttaatgcaatgagcccttgaatatgattaacaaataaatgtgttttctaacaagaaacctgaacaat

SEQ ID NO: 15428 - DNA, 719 bp, Oryza sativa
  unsure (1)..(719): unsure at all n locations
nnnnnnnnnnnnnnnnnnnnnnnnnnnnnnnnnnnnnnnnnnnnnnnnnnnnnnnnnagtgggtgtggaacgacagctacccgctctaccactccacggactgccccttcctggacgtcgggttccggtgctccgagaacggccgccccgacgcgtcctactaaaacaaaaggtaagggtttgcaacaagaccgaagagataaatagaatgcaaaagaatgacttattttttcatattttacagatgaaccttatccgggaccatgataattaagccgttccattcaattcaaagatgaggttgaagttgcagccacccagcttgctactgcagaagctgactgcacaactaatgtgcatttacatagactaatactgactcactgagaccctgtttagatgggactaaaacttttaagtccttatcacatcggatatttgtcactaattataaatattaaacgtagactattaataaaacccataaataatcttggactaattcacgagacgaatctattgagcctaattaatccatgattagcctttataatgctacagtaaacattctctaattatatattaattaggcttaaaaaattttgtctcgcaaattagctttcatttatgtaattaggttttggaagtagtctatatttaatactctaaattagtgtctaaatacagagactaaagttgaattcctggatccaaacacc

SEQ ID NO: 15429 - DNA, 615 bp, Oryza sativa
  unsure (1)..(615): unsure at all n locations
nnnnnnnnnnnnnnnnnnnnnnnnnnnnnnnnnnnnnnnnnnnnnnnnnnnnnnnnnnnttgtacaacaggctggagaagctgcacatcttataaggatcactcatctggcccaagtccaacagccagctcctgcgataatgaaatctgagttacaaaccagatgtcccaacccactgacgtatcactacccttgagaggatgtcaactgcgactaatagactatcacattgtgtcagattctgctaaattgtccttagtcttgcctatgttctccccccaaaattaaaccgcagacctaatggattagaatagagcccatactttgtcatcgcacatggcaaagataaacagccatgccctacaaaatgtgtcatggatgggggtgacaaaagatgatagctcaatagctgatgctactcctgaggagttaagcagacattgatgtcaggtgaaggcctgtgccccatggactgtgagctgactggccacccaaccatggagaaacctgtggagcttgagctgttaaggctcatggcgccactggctgttgcactgtgctccattacaccggtgtgggcttgcggatgcatagatgagacctgcggcgcatggc

SEQ ID NO: 15430 - DNA, 818 bp, Oryza sativa
  unsure (1)..(818): unsure at all n locations
nnnnnnnnnnnnnnnnnnnnnnnnnnnnnnnnnnnnnnnnnnnnnnnnnnnnnnnnnntttagtaatgttgctaaaaaagtggctacatttagtttgctaccaaattttgataactatataagaaatcttgccaaaattttggtaaggttttttttggcaacaaagtgaacaggcccatcgtagatctctaacgtctcagaaatgtgcttgtcttcttttaagtaaacacaaatgtatttatcggtcaaaccccatctggaagaaaataaattcctactgaatacctgaaacaatttttctgatattccaaacaaaaatgtatagcgcccgatcgtctattggctttcttttttgtttgcttgcattctctgcattattgtggttgacatctgcgtcatatttgtgaagttggtttgtatggagtttttggtttgaaagccataccaaagtattggcactttacatagcatagtcaggggttgtctagattaatgctatttcaaatcatactcttttttttataaagttgtcaaagatgtgtgtacatttagttttttacccaactttggtaaatacataaggaattaggcaactatacaatagtggctattctgccaaaacttgcaatattgtcaacttactaatgtcaaaatttgataagtttattttggctataatctgaacagcccccgagtttgtatcagtctttaggtcgctgaggatatctcggatcatgagtaatgaaatttctggtttnnnnnnnnnnnnnnnnnnnnnnnnnnnnnnnnnnnnnnnnnnnnnnnnnnnnnnnnnnnnn

SEQ ID NO: 15431 - DNA, 1463 bp, Oryza sativa
  unsure (1)..(1463): unsure at all n locations
nnnnnnnnnnnnnnnnnnnnnnnnnnnnnnnnnnnnnnnnnnnnnnnnnnnnnnnnnattaatcttctttaattgtttttctcctgactaaaacaaaacgtctcgtgcacatgggcgtgtcaaaaacaccagcttatgtctgtacttttaatggagtgtaagttttaattagtcaattatatcaaaatcgtagaactacgctgagaacactttggacgtctccatagttagatgcataacgtcaaaacatacggcatacttacaaataaattttataatcaaagaaggtacaaagaatgttaacaatagactatatgttgtgtttaagatgagaggagaagatcgagaagaatacgcaaaacaatgtaaatattactacatgattattgagtattaactattttaaatttaaaaaaaataaattaatatgattatttaaaataacttttctatataaatattttatgaaaaacgtaccatttaactgcttgggaagcatgcacgcacacaacgaaagagtttttcttctaatccacagcgccgaacccagactaaatcatcaacgtttctgggtaaaatactccctaaccctctgctccaaaggttaacacagccataaagagtccatgaagagtcattgagtgcaaatgttggacacgagatgttacaactttgataccttttcttcctagcaagaaaaatatataaatgatttttttttctgaaacaaagttttaaactctgttactaatctggacaatcaacaattgggccgtcaggaaaaaatggatgcgagaatggaagaaacggaaccgagatatttctagagaatcatatcacattgactaattcgttcaaagaaaaaaagaactctgaagccagtagctgctaatttgattaggtgaagcatggtgaagaagttgataggtgaagcgagggaagcaaacaaggacgaaggagatgaggtgaggatggtgatggaatatattggatgcatcttgcacgatttcttgtgagtgacacttgttgtgatgtgtgctttgtttccatgtgggaatctaatgcggccacagaaacggccaccggcattttggcctaccggagcagatattgcgtggcacgcttgatgatgcagtacttatttcaagaccaggaaattttgcacgtacctgcctattagtaaaaattgtgtgtattatgataaagaatattatctttacttccaaatcttctgatagaacatttccctccccaactatctgttaatgcaatatcagtcatcaaatatgtgtcactacataatatttatataggtatatcttttagttcaaagagtataattcctcctgttaaggggaatttaactatttgccacttttaggtttgccacttatctaaatgctcctcttaggcttgcgcttaataatttaccactgaagagatgatttcttaactatttgcca

SEQ ID NO: 15432 - DNA, 4258 bp, Oryza sativa
  unsure (1)..(4258): unsure at all n locations
ttcaggtgtgctccgctaaatgttctgctataaattatttaattcttgaatgtttatcaaagcaagactttttcacaacttgcttgtgtattgttatattgatgtgcatgcaatgcacttttgatcccgacaaatttatttaatgttgtgagacattgagtttgtttttaggatcaactcaagtacttgatattattgttcagtgcaaaacatgaattaaacataatattttgtttaatcattttccataatctccaggaaatttgcaaggaactacaagattcttcacctgcgaaaggtttttgcaaagatgaacatccttcaaagaatgattgcatttctgagctgcttagcagtgccatacaggatcatttgaagaattttgataggcaataccgtttaacagttaagaaatcatctctctccgggagcaaataattaagcgcaaacctaagaggggcatttggataaataacaaacctaaaaatggtaaatagttaaattcctccctattaatgccaaagtatacctctaccttccacaaaccgaaaattattcctcactcaaaccgcaaaaatgattcaaataatctaggggcaacagcaaatttaccacgatttgaatcgtcattaggaaattatgaccggaattgtcattcgaatggcattcttgtaaaataaaaaaaaagatcaaaaaatttgcaaattccccaataatctatgcagcatctcatgaccagatctgctgattgagcaatcgcaaaataagcggaggagaatccacctccacaagctgataagtggacagcatgaactacgacactgttgtagtgttgtagagaaaacgactgacgtagcaccccaaattcgtccacaccattaaacatccctttagttcgtaatgatctgtcttaaaattgacttgcactaaaacatctaattccccattcccgtcgggtacgctcaattatgcacaaaaagaatttgcaagaaacgaaatgatatttttttggtcactcagggaatcaagaatccagcaccatacatgtcgctttggtacgttagagaagaaaacaagtggataatcaattaactcagttagatgattaattggatgacaaagggatgagtcatcgactcatcgttaattacgtcttcagagaataatattttcctctgagcggacgagaaaagtcgagtatctgctctgagccgagccaattttgttgaatttaggacttaatttcataaagtcaccagcccatgcattacacagattatctaggttgtgatagcacgatccacctaatcaacaattaattctttctggttaacacataagctctttcagagtgtctaattaatataggtgtagatagatttagaggtcttattaattaatgtaagcttttttttcagtcttagcccaatgaatttcttaaccaaacataattcgagaaacgcctaggggttttctggctagctacacaagatagtgagctagataatctgggttcgaagcataacttcatctaattatttgatattaggtcattccttaatattcatgtcttttaaccatacataattcttccggaaaataatgtatgcagtcttcttgttgccaaactgatctgcattgtatagtgcttgttcttcgttaccaaaaattaccattcctcgagcgtgtacaaaatttaaatatcaaaaatgtttatatttgggaatggaaagagtagctaagttgaactaattttcattttaggtacattattgattaacctacatactatgttacacctttcattaaaccattttgaatatccaatccaaatataaaaagaacataaagataatagaagttttagaactttccaccggacatgctacgtttgtattttattcagtttatttgtctgtatgcacaaaagcaacactccattattttggactcaagttaatagtctaattcgaattatgtgcattaaaatatcgaacttacgcaagccatgacatatgttgatagtcccatgtataaacaagtaaaagaataaaagaaaacccagtttgctatatcgtgtgacaccctacgtagtacacaatacaccatatgctcattgctaaaaaagaagaatatcctagagtccaaggagtaaggaatcattggcaagtcactctccttgcaatacaaaatggaaaggaaaacaaaacgaacacaagtggctaacatttttgcgaagagcttgacatggtgacacaataggaggagaacgatgaagcatttgacaaattgttttgctaaaaccatttgacgtttcagtttgttttacacaaatacaagaaaataaaatgaaactcacatttatactaaatcagtcctttcatataggctgattttttaaaaaaaactttttagagacataaaaaaccctcatatacaaaaatgagccttgtggggctgtggcacagctaaaactctgacattgattgctcagcagggcaaaaccttgttgtgcaattatgccaattaacaatgtcgtcttaaaggaaaacaaaaacaaaaaagaaaaggaggaagaaagataaaaagttgtacgcaatttattgtcaaatcgatattatggaaataagactgaggtggtgtttggatccagggatttaactttagtctctgtatttagacactaatttagagtattaaatatagactacttacaaaactaattacataaatgaaagctaatttgcgagacaaaatttttaagcctaattaatatataattagagaatgtttactgtagcattataaaggctaatcatggattaattaggctcaatagattcgtctcgtgaattagtccaagattatttatgggttttattaatagtctacgtttaatatttataattagtgacaaatatccgatgtgataaggacttaaaagttttagtcccatctaaacagggtctcagtgagtcagtattagtctatgtaaatgcacattagttgtgcagtcagcttctgcagtagcaagctgggtggctgcaacttcaacctcatctttgaattgaatggaacggcttaattatcatggtcccggataaggttcatctgtaaaatatgaaaaaataagtcattcttttgcattctatttatctcttcggtcttgttgcaaacccttaccttttgttttgatcttttttttatatatagttgtgtgtggcttagttgaatccgttccgagtagtgaagtactgaccaaaatatccttgtttaattgttgcaaaaccaatgggcgcccacaggattagataagacttaagacccacggatttgctgatttttctgcacgacctgtggactgcagagagaatctagccatgtgattcagtgctaatgggattcttctttagttcttccaaattgtgttccaagagtttaatttgtggtatggatacattgtaaagggatcaaatggggacttgtcaactttagttaaaattctgattaaaagtggctggcctttgcatctccaacatggtcagcacaagtctgctgttcttctcctctaggatattttttatcagaccttgtgtttatcacatccttttctgtatattttttcttctaaatatgttatgctagtactactagtagtaatttgtgaaaaggaatcaaacattattgttttcaccctttccctttcatgagaatgacagccactgaaattatcctacaactaattaatacaacatcagtttatctaagctaaaattatgcaaacatagcagctgcaagttggcaagaggcatacctaaagttactgcactacattatttcaatggccatcgcctcgaaagcgattgcctggatcaggggaagcacaaagaattactactagaaaagcaagcaagcaagcaaagaatcttggctttgtaatttgccaacccacacggtgccaatgaatctagtacacttttcagcgtgtcaattcatcaaataatccaagttgcagtattgctttgggcatataattataccaattcatgttaatgtgaatctttggtttcgttcttaatacgaattggaagcatctcgaaggaacagttcaggaatggtttgtgcccacagtttcgaaaccaaagtctccccaaccagacaaggtttcagctggtaaatttcttcagagcatttctaattggataccaccannnnnnnnnnnnnnnnnnnnnnnnnnnnnnnnnnnnnnnnnnnnnnn

SEQ ID NO: 15433 - DNA, 1092 bp, Oryza sativa
gagaaagttatgctgctagaattctaggcagaaatatcaggaacccatgcatgcaggtgcaggatgatgtcagtgtgagtgtgtctacctcaactatcctgcttgattgaacaattaaagtaggcataaaggtgaaactccacgtaccaggattgcagtagtaatcggctaatcgcgaggtaaagttgatagattctgaatctgatgaagggggatttcatcttcatggctggagtcaaatcaatgtttgatcaacgcgtagttacagggtgccctgatgatttgaattaatttttttaaaaaaaaacaataagaggaatgaagagagtttaacctgtgaatcgggaaagaaacagaagcatctcatcatcgagcctagccgttgggacttgcgttgcgtgtgatctacacctccaggcacgctgcatatctagggctaaaaaaaaaagttcatcatacaaggtctcatcaggatttcaggaccgtgtgagtgcggcagagctgtctccgcttgtggctgctagtgcgggctagggtcagcgggcgccgtgtacctgcggatcgtcatggtagaaggccggcggcgagcgggacgccggagcgcggcggacggcgtcgtcagtccgccgctgcggcgtggcggcgcggaaggcgatcgatgcggcgatggcccgatgcggccgatcttttctttgtggtggtttgtgggccatgggggcgtgggatgcgagttgtgcctttggcttgtaggcccaggcgtattatgttaggaaggcccatggatgggccgagcgggggttcggagttcaattctccgacctcccaggacgatctggactggaagctgttatgtgcagccacgtccgggcacagcacacgcacatcatggcagctggcagagtctctcgagtatgagtatacagtatactcctcgatggcagccagagatcgatggctgcatcgctggtgggtagatgttggttttggccattccattttttttttactagaatgcattggtaacataaaaaaaatcaacaacgtccgatcgtatccaacgtatttagaagttgattgggtaccgagctcgaa

SEQ ID NO: 15434 - DNA, 708 bp, Oryza sativa
  unsure (1)..(708): unsure at all n locations
annnnnnnnnnnnnnnnnnnnnnnnnnnnnnnnnnnnnnnnnnnnnnnnnnnnnnnnnttgtttcatataaagagtttgtgaagcaaaaaacaatggaatagtcaaaaatattttatatgtgcacaataaacgttaagaaattttgggaacaagagaagaaacacaccgcataagaagcgatagactccaagtgggtcatgggctccccaacatatttcacagtccgcttgaagtataaatcttggttgaataccttctctgcctgtgaaacaatggacaaacaaatatgactaaatcatgttactaacagactgatatagacagaaaaacaagaagtgaattttcattgtacttgttgaaaattgtaaagaaaaaacatagaagtagaaagaaaattcacctcagcgcaaattttgcccacaattgagatagtctcaactgggtacagaccacggagagtctcagcaccaacgataatgacatcactccctgaacaaaaaatatatggttcagatttttcagaaggcaattaacatcatcaacaactcaaacaactcaccgtgaagtacagcatttgccacatcagtagcctccgcacgagtaggcctgaggttgtcagtcatactgtccacaacacgagtaacaacagcaggcttttcacccatgttgcacttgtgcagagcagacttttgaacaaaaacacctac

SEQ ID NO: 15435 - DNA, 2033 bp, Oryza sativa
ggacaaaaagagtcaatttttttcacatagcagatgctacaaattgcggtgacgtaatggtaacatacaaaatttctctaggaaacagtcaaggaccgatctgattgcaacaaaagtaaaaacaatcataatatttcatataaataacactgaactactgaaggtataccttagcaagcccggagaagttgatgggcagcaattcggaggaggcctcctgcccctggtcaggggtgagaacaacagtgccattcgcttcaagggagattgcagcctcactcttgttcaccacctgcaactccgggccgacagtgtcgagcatgacctgcgcaacaacgagaggactcccaaatgttagtagacagcaagactaactagtagatcatgaatgaattgtcaggagaactcacagcacagagcttcttggtggacttgatggcgagcttgaggttttcgagggtttcctggtggtactcagcgtctccccacgagaaatcgaacctggcaactgcaatttccgccacacacgaagaaaggattagattagaacagtgcgcaatgggtggaggtaagaggagatcgaagctggctgatccgttacccgacatgccggccttgaggcaggaggagatggtgtcgacggcgcgcgacttgggacccagcgtccccacgatcttggtcatcgccgggaaaaagctcttggaggcgaaattaattaagcgagttagggttccattcaatccaattccaaccagaaccaaaaccagcaaaaatctgaggcgaaatcatcgaaggcgaggaggaggaggaggtcttaccggcttggatggctccaggatggatgccatcctgatgggctcctccagcagcagattcgtcgaatgcatcttgcccctgttcgcttcgctcctcggatcagatcgggaggtagacgacgagcgtcagcggctgctcgatctcctcctcctccttcttcttctccaaggaatcaatcaatcaatcgaggcagcgaggcgtgtgggttgtgtgttcctagctttcacctctggaatccaatacaataacgaagacgcctttttatttgggagaagaaaaaaacgtggaatcgcagcatatgccttgcctgcctccagcaacacagttaatccgcgatgcgaaacggtggatgctgacatccgcgggtttggaccggtcccctccaccaccaccaccggtttcggccgcaccagggaatgatggcgtttggatctactcgctcggttcaaaaacatcttcactttggtttttatatctaacgtttaaccactagacttatttaaatattttataaaaaatatttaaaaaacataatttatacataaagtaattattcgtattttattgtctaatggcaacaaaatacttatcataaataatttttaaataagaaaaaggtcaaacgttgtatataaattcctacgaatgaacttatttttaaacggagggtgtatagtagatctttttttttttaaatttcaaaaaaactataactatagtgcaaaactatcagtttgcagcaatattaataacctattttcggtttgttgcaatgatattatacaaaattattacaaaactatacttttacgtggcccaagcttactgttatcacctacacatactacgcaaagttacagttttatgatgatttcctacggtataattacaacaaactgaaatatgatgctaatgttgcagcaaactaatagttttctcactataattacagtttttctaaaatttactttttttttctcagttatttgtaagtaattattacatttgagtttataatattagagacattttttattacatggtaaacgcatacgcacacacatcactacccggataacaccatacttacattctataaagaagccccctaattcatgcttaaaagacgaaaatcaacaatacattctttgatctcactaaatttataggacaaaaatagtaacgagaattctaatcgagattataaaaaccaaggg

SEQ ID NO: 15436 - DNA, 1005 bp, Oryza sativa
  unsure (1)..(1005): unsure at all n locations
nnnnnnnnnnnnnnnnnnnnnnnnnnnnnnnnnnnnnnnnnnnnnnnnnnnnnnnnnnncataactgtcaccagagacgtgctctggtgagaaattgaggatgtcccactgggcccaaaagctccatttctgtatgcattatctacataggtcttagctaatggagtttgcctaaaagcttcattattgttagctgagcacaacgtaaattgattatccataacctgatgtgcatttgtctgggaaagcactgccatcttactgtcctgaccatctttcaaagttgcctgaacacttccattatttgctttcactggagtagcggtcgatagaatattggactgtgacataaggcttctaccaacctctttacttatttttgatctctcattctgaaatatatcaagtagatgactccagtactctgtcattctcctacatatatctgtatatgcatctgaagaggcaagtatttggacgactttgacaacatcacaatgattgtaatatcttgcacaaaactccacatctgaagatgttccaatcctgcattattttatttgatggaattaacatttagaaagcatagaacaaaggcaagtttgtcatggggtaacagtcggattactattaaacactcaaatgagtactactaaggttaccaagtcaaagtaatatgatttttcgcttgttaatttagtacattccaactttctggtgctaccatgtttaaccttattcagagatggaaaaaaaaaagcttatgttgcaaattaaatgttggctactctactctaatcaattgcagactggcagtgcagaacgaatgttcataaaccccaagtactgaaggatgaggatgaaagagcttacaccagcaaatagttgcagcatccgaggaagctcctgccacacatatcaatgcccaaataattgagctcctcttgcgccacgctctattcttgaagagggtggtccaagcttgttaaccacacattctggaca

SEQ ID NO: 15437 - DNA, 3479 bp, Oryza sativa
  unsure (1)..(3479): unsure at all n locations
nnnnnnnnnnnnnnnnnnnnnnnnnnnnnnnnnnnnnnnnnnnnnnnnnnncaaaacggaaataatccacatatccggcaatcatcactgttgccatcctgggatgcatgtgttgaagcagattctggattatttccgttttgggcagtttccagattctgtaaagcgtcgagctttttgcaagctggagcctttgagcctctagtcaatactgatcttgacccaacctccgcaaaagtactagaatccatctcatattccatttcttcactgtaaccttcccgttcttccagttcagtcttgagttcttctgaatcaatgacgtgatcacatagtagttgcaggatcctaagcttcagggtaacaggaagcttatagtactcaatggctaggacacttctaccaaatctccggcctcctagatctttaataatacccatgacatagaggtactctagcaagaaagctggccaagtcaatgaatctagtaatgtccagtctaaatacctggaattgattcaagagaagtgaaaaggtcagaattgaaataacaagatataaacactcatgagaacaatagtggaaggttgaagaccacatacttcaagcaatttgaagccagttttaatccttcagaagatttggtctcaagatgccgcctaagtgcccgcagtagtgagacatgaacagcatccaacaatgtattctgcgtggtgcaattaacggatgaaacaaaatcatccagcccaaatggactgaggaacagctgcacactaaacgatcgcaggaagttgtatacagaaaaaagataacttatggcctcctctggcacagcaatgtcccctgaagacggaggcaactccaggacctgaactggtggataatgctctactggcagttccttagtgcagtttgatgaattgcttgaagattcaacatcctcagaagcatccgagccagacccactctcttgcgactcatcaggcctagtggacacctcagattcattgaccctctgcctagtaattggtggccctttcacctcagtggcgccaccggatgaaactagcaagtccagcttcctcttccggcagctcaccttcatgccaaatgcaccattctcttcaccaacaagttgtgactggagctgagcaagctctaaatcctcaccctgcccatcctcaaacaccacactgtagatcccagtgctgccatcataggatgcaaccttcccaagaagaattcgaccatgcccagcgacactccggctgatgtaacggcccacaaggcactccccctcctccttcatctgacaaccatcggcaggagtcgtggtgggcttctgatccaccaccccgccctcacatccttccatctttacctcacttgccacagcagccaccgtatgcacttgctcttgaacgccgttctcatacacctcggtcttcacttggatcggggtgcacgccgccgcatcttgctccttgtccgggatactgcccccgttcacctccgccttcacctcccctgcagcaggcgccacggccgggtacgcgtccgccgtcccgacctcgtcgacgtccatcttcgtctcgctcaccggatgcgccgcagcacgctcgtgctcgaccgcgatgacgccttcgcccgccgcctcactcgcggggggcgccgaagcaggggggtcttccaccgccgccgacgccgacgcgatgccccctgcgatctccgtctcgcgcgcatcatctgccgtcgccggggccgcggcggccgcggcgggagaggcgtggagcatccgatcagaaacctncatgggctcctccatattctcggacacccccgaaaaccctaagcgagtgcggctacagaaagcccccgcatcgcgagatcacgagcccggagtcgagattccggcggggctcatccaccgggacccgaggcgccgcccgacgcagatgcgaagccgggcacactcgcgggctacgaatctggagagagagctaaggggaaaaacgcgcaaccccccacccgattccgcggcgagatccccgcgcgacgagcggaaccctacccgatgattggattcatccgccggcagcccctcgcgtggtcgcaaccctacgcggcggcggtggcggcggcggcggcggaaggcgaggaggcggaggagaggagatgggggaagaggagatgacacaggagaagggaagagaagggaagggaaggggagcgaggcgaaaaggaaagaagtgaaccgcacgagcgagaggctcgcacccgagcctggctcgcgtcggtcggtcggtccgtgccgcgctgtggaagcggagttcgggtccggtcggttgcgcccgacccgcgtggggagacgtggagcggtggtgggatagttgtgggggggaggtggatggaccgggtggtgggtgcggggaacgaacttacgaaccgacccgggtggcgacgtgtgggggcgtgacctgacctgacctggctcgaccgcgcggggaggagtagcgtagtacgggtgtccactactagtagcacacgcacgcacggcggcgagagcagaggcgagggcgaggaggaaaatggagggagatgtgggagggagggagggagagggtgatgcacttttcaaattcaaaagtgtggagggagtcagccaggccagggtggtcgctcgcgttggcgttggcgtttgcgtttgcgtttgcgtaggtggatggatggatggatggagaggggaataccggagcagtgtgtggcgtcgttttccccgggactccgcgaggcttttgctcgcaacacacttgtgcactgtgtggaggtgtacgggtgtgtgtgtgtttctcagcttgcgcgtctcctctccttggcttggccttgggctctccttgcacgcacgttgttgttacacggggagtatgtttttcaatgtgctcaggtgttacgatttacttttgtcgatggactgtacattgttgcgctatacttctaggtagctgtcgatcatgcatcttcacatgcaggtactaattgttttattgtctgtgcctccaggcttatggtttggtgtttgcaccccgaaacaacggtgatcaagattgtaataatgcaaaacagcaagaagcatcgttaattgcagccttccctgcaggcacgggttctgtagatcacgctaactgtcaggaagacgcgtaaaggcctacaggatgcttagtgctatagacatgaccgtgagtaatggatggaagtagtatcagatacagcaacattaactatacacatctgtcccaagttcattagacatcagtagtagcatattgacatggatcagtttagttcgagtcatgcggcaaaagaaaatcaaaatcattcgtcagatgcaacaggaaaacaaaattattcgtcaggtgccccagcgctgatcacaattcacaaaaaaaaaaaaaggtgcatccagcgaagcagcctgcatc

SEQ ID NO: 15438 - DNA, 3761 bp, Oryza sativa
  unsure (1)..(3761): unsure at all n locations
nnnnnnnnnnnnnnnnnnnnnnnnnnnnnnnnnnnnnnnnnnnnnnnnnnnnnnnnnattttcaaaattttgataatttcggtaaccctggcataaaattcaatttcgaaattttaaaccctgcccgtggaacgggcacgggcgaggtgtctttggatgcccaaagcgtctccatgaaatacgtcgtcggaattccatatctttagtttcaactcggagaataatatttgcagtagaaatataaatgggttaattcatgaataatttactattaaaagtttgatatctgtattatttacgactttagaagttaatataaaaaataaactgcaatataaaacctcaaaatcaactttaattcataataaattgaggcgaaaaggacctcaaaagcagctgataaagtcataatttcttttgaaataatacaactttaatgaaaaattgtaaaaagtatatggtgattgtttgaaatcacaaatttaacaccatatcgaacaaatcgttgttcaatagggtttaaacaaatcgagaacttgggatgtgcgtacatgcatgtgagtgggttgtggggcctatcgaactttgggagtttgataggccaccccatatgcttgctatttttttttaatcaagtcaactatactgtcgaacggccgttgttcgacacgtatatctgtaaaattttacaatggttgtttgataggtatcttatcaaattacggttgttcaacacggtgctaaatttgggatttatatcgatcaatatctattttcacaattttcattaaagttgtattattttttttgaaaaaacattcgataaagtcaacaggtaaataatgaaatgcttctaatatcccgtaggctcgtagcaaaagagatgtcggagaattttacctcatcgtctttctatcgtggcgaatttacagtggattttgttgagtttactaccttattatgaaaatcttgataatgtaaaaactccaaatgtttctattacaaatatatttaacaaaatatacatgctgtttaaaaccggattcttccgccctctccggtctccaccccatgtcgcatctaggtcgcacgaagagcaaccaccagctcccaaaaagaccagaaaaagagcagttcactagaaaaaaaaatgtatatatggactcgtatagcctatcctcgatcgtatgagcccgttgcaaggtttgacggcaagtcaacacattgatccggaaatatattttttcttttaggcaaaccagaaatttcattactcatgatccgagatatcctcagcgacctaaagactgatacaaactcgggggctgttcagattatagccaaaataaacttatcaaattttgacattagtaagttgacaatattgcaagttttggcagaatagccactattgtatagttgcctaattccttatgtatttaccaaagttgggtaaaaaactaaatgtacacacatctttgacaactttataaaaaaaagagtatgatttgaaatagcattaatctagacaacccctgactatgctatgtaaagtgccaatactttggtatggctttcaaaccaaaaactccatacaaaccaacttcacaaatatgacgcagatgtcaaccacaataatgcagagaatgcaagcaaacaaaaaagaaagccaatagacgatcgggcgctatacatttttgtttggaatatcagaaaaattgtttcaggtattcagtaggaatttattttcttccagatggggtttgaccgataaatacatttgtgtttacttaaaagaagacaagcacatttctgagacgttagagatctacgatgggcctgttcactttgttgccaaaaaaaaccttaccaaaattttggcaagatttcttatatagttatcaaaatttggtagcaaactaaatgtagccacttttttagcaacattactaaaatttggtaagtttgaaaatggcatcaaagtgaacaagcccgataaacagagcaaccgatcaagaatgacgctagcactatataggatagtaggactataggtggtagtagaacaggcttcaaaagctccaaatcttccaaggaacacacataatgcaaaagtacaagagccagcaacagcgagaatgaaatctgaatcacaaaccagatgtcccaacacaatgacatatcctaacaattagatgagggcaactgcaactaatagactatcacattctgtcagattctgctaaattgtccttagtcttgcctagtttctccccccaaaattaaaccgcagacctaatggattagaatagagcccataatttgtcatcgcacatggcaaagattaacagccatgccctacaaaatgtgtcagggatgggggtgacaaaagatgatagctcaatagctgatgctactcctgaggagttaagcagacattgatgtcaggtgaaggcctgtgccccatggactgtgagctgactggccacccaaccatggtgaaacctgtggagcttgagctgttaaggttcatggcgccactggctgttgcactgtgctccattacaccggtgtgggcttgcggatgcatagatgagacctgcggcgcatggcaaccattagttccaggagctgcctgagagataggcattgcagctgtgagcacaggaggtggagccataggcggtggtagtgccggggcagcagatgttgctgttgtaggcccatcctcctctgatgctgctttaggctgttgggcaggaagctccccacaatcacctgtccaagaggtttgtgttagtgaacagggaaaaatggtatttgcgtttaacaatggcaatgagacaagaggagatcaatgttttatgtcttgttgagttaattgttgagtgtattggttgatttggtagaagatgcccagttctctttttacctgaatagggcttgcggcacgcagcatcccagctactacaccaccaacgacacggccatcaggaccggcaagcgatacactgagcccaccagttctcctccgaccaccttcttccgccattgtaaaggagccagtcagttgcagaatctcaaaccgaccctgacaatcagataaacgagatgatttagtcttaagagtttgaaaatgagcaccgtaaatacaaactcatatgcaggatatatgacgacttctcttaaattgttatcctacactcatacggccatccaaatgaaactttttgtctcttatgcttgcagttatatatatggagttatggtcttatggatgggacaccttaacccttagcacacatcccatgctagttgctgactgtttccaggatgatgttcctgagcctcatgtacaactttcagtcatgcataatatgcgataacacaaactgcccaaaatcaatgtgagctatcatggatggagcgaaaaatggtaaagtcatttaagcagagtattaccgacttttagtgacgaaaccttcaagagcatcttacatgaggtagctaagacttaagactcagataattgagatgaaacagatgaaatgtcaaaatataccccctcatagaacatttaggcaagaaaaccatttgtcgtatttactccgttatttattacagtggtgatatgggacctaaaagacttggtagagaagaccccaaactaaatagaccaaaatggttcagcttattcaggactttgtacatacccatcaaaagttaacaaaagcgggtaccgagctcgaattcgccctata

SEQ ID NO: 15439 - DNA, 1559 bp, Oryza sativa
  unsure (1)..(1559): unsure at all n locations
nnnnnnnnnnnnnnnnnnnnnnnnnnnnnnnnnnnnnnnnnnnnnnnnnnnnnnnnctttcagatctgtgggtatcaaaaccggatagagtcttctggtaagcagtagccaccaagtgctaagtgtcctacactcctactatgaactaagccatgtgaatggcacaacaactaaaggaaaggcataaacaaagaggtttttaaaagcaacctagtagcttgccaaatactgtcatgtttatcctttttaagtttttataattaagaaataggcttgacaaaacaggtttgtccattttcttaaaactataattagtccaatcattagccgcctgatgaagaatatgaggcccgtttgttgtgaagtcaattgaaacctttgtatctgtggaaggtggcttgatgtggacatgcaaaataacaaaaggtgatgcggtggccttctttcatcgaaatatatgtggcaatgttcatgtaaacattgatttaactttctttcctgtcttgttctcctcttgtttttcctatggaagcaccaatcatttgaccgtaaagagatctaggtaccatagcagcatggcaaactacacctctttgacagttccttttcgtccattttcttgttcgattagctttctaccttctgaaataaataaacgtatgccatagttaatcacctaattatcagtaaaatcccgatgatctcagtcgtgtggtctatagataaaacaaaaaactatagatgaaggaggaggtttggtagccttgcctcctcacctacagaaatggattagagagttgtatctattactctgtcttccgaaagcaaaaagcctttgtacctctccaattattgactcaagccacaaccaaaaaaccaggcttaagttattgaagaaaccagtttattatgtaaaataacagtttaagttactgtacataaacttgtttttcagatcgataattcattttaagcatatgtttttaccaaacctgagaatttttttttgtcagatcttgtgagttgtgagacatgtccacatgacctatggtactaggagagcccacctcatcactcaaaccatttcaggtgggcacaaaaaatcatttcagcaacatgtcctcagatttttttttccccttggatgaaaagctgtcgcccaccacgcagtgactagtgttgccaagaacagtgagcctgttgcaacttgcaaaagcttatctcaaccaccaacttagattgtcttcttgcagagactaactattaaatctcatcaccatgagacttcaccgagacactaactgaagaacaaattcagagtaaatgactctgtctcagcctctcaggatgaacagttaactgatctagccacagagagcaatcaattcttggctctgttcttagctagatctcgtgaaatccaggacttggggagttcagggtaaagaaaacggcagatgttttttcagcaatttcagctgaagcagagtagaagcagcagctagtataccttgggcggaggaaggattggttggcgtgggactaggccaggtggccaa

SEQ ID NO: 15440 - DNA, 2548 bp, Oryza sativa
attcgagctcggtacccgagagagagagagagagagagagagagagagagagagagagagagagagcaaccaatcgaagaggcatatggatccaagagactgagaggaaaggagaagagaggcagaaattgctgcagtcgagcgaggccaagaaagccacccgagtccccttcctcccatagatccagctcccgcattctgattgatgatggagtgaggagattgcctgaaccgatggagacattgccaacccgtggaaggagcaacacgaagaaggtgaaggcgagtgggggcagcacggatgaggcgaggcagctggaggcgaagcgcctgtccttgtactcacggagaaatcacaagcgtagaaccacacaagagatcactttctttgggctcatatggaagagaagcaagaatgacctacgtagcagcaagctcaaggcagatgatgttattcttagaagcagggatggcgtaggctcgccgatgaaaccgacctgctttctctgcttcaagccatatcgatcagacttgatgtatatccgctgcgagagttgcagaagtaggtatacttgtcagttttgcagaatgaaagtctattatctttatttgtgtattgttgttggttttgacaatttgatgttctcctgtgcacagattggtttcatggagatgccctggaacttgaggaaggaaggatagctcaattgatttcgtacagatgctgcagatgtcggaggaggccgttgccgaaatgtcctcattcagatttttactattccaaagtgcctgaaccacaacccgtcagtcaagaaaatgcagatgacatgctctcgagcgaggaagctgctggagcagatggagatccaccgctcgattcatctggaggagttgaaccaactgtagaagaaactgttggtgctaatttctcagcgaacatgaaaagctctgtcccaggaagtgttcaagagactatctatatggatggttcttcccatcctactcatcctgtcagcaagggggttgcgaaggtagaacttgtgccaaccgttaagtctgaaattgggattggggtaccgagcacaattatagtttgtttttccactactaagttttgtagattttttccagaaccaaaaagaatagttgatagaaatttcaacttgctgtccttgtatgatcctagaggctagataaatcgatccaatatttgtacttctttttgcctatcaactgttcttttgctgcataatctatgtctttcatatgtgcgctgtgaaaacatgatttcaagattgagaacgaaatcattgaagttgttactcattagaagatcatgcatttctcgtgcacttagttcaaatgggcatatatgataatctttgtttacaagaactaggttgtttagcacatgcatgataaaaagtgaaacttcaaaggcatctaatcaagtcaaggatcttgtagtgcgcatttttagttctagtgagaacagaaactctaatacatcctatattcctatgatagatgtggtgttttgtaacaaaaaatgctggaattaagttcaatggaggcatatctattgcaaaccatggtttggattgtacattccatttttcagcaccagatcagcacaaaatattcccaaaacaaggtttttcatgattgcatctaaatcttgtttgcactttgtgatgattttgttcgcatacaaagttcagagcttcctgtatcacctatatacatttgcaaagtcttagtcttttaaataatccaggaggtccggccatatgatgcatgcgttgcatggtatgtacctggtacctgccgaagatcggcccctgggggatgatagccccccacaagctgctacagtggggagcaactttgccaacgaccactctgtcatacttcaccaggctgtatgttccagaattgtgtatagtttatgattttttctgtgtgacgtttgctatcttatttacactttttgcagtatgatggtttccgggcaatagctgcggagacaggctcattgtatgagcatctaaggcaaaaagaccatcagacaagtgatgatatcatgattaccttggacaaacttcagcagattgctttgcatcatatgaaggatattgcctgccatcaagccaacaatgtagttcaaccatctgatcagagtaattctagggctccagtgccagacacagatgctgctccaccatagttaacggtgctaccaagtgagaaaccttttctttgttgctgatacggcatttttgactaataattactatatcagcgaaacctttctttgtaggagctgtaaactaagcagggacggaaccaaaatatgatcacgcctagggctatgagttattgccaaattacattaccgcttaagagttttcacaatgtttttatatattttattgggatgttgtgctaagcctaggacttaaagccctaactaccccctgccactgaaactaagcatatatcaattatcatttatgtttctgtgcaggcaattgatggagcgcgagga

SEQ ID NO: 15441 - DNA, 1342 bp, Oryza sativa
attgaggagcgcgaggatgtaatcaagaatcctgtacaaatggttgtgtttagcaggaaatggtaacttcagtcttctggtgggtatgttcttgagatttttttttgagaaaatggatcaaaacccggcctctacacccaaaaggatgtacacggccagggtatgctcttgagataatttctgcctttctggctagtttcctgctgttaaaagtaaaaccaatcattatcatgataacatatccatagaagaaaaagctcacctagaacaaacaatttcacccagctctccttggagatctattgccacaacctgagatatctgtcctgttctccataaaatgttggccttaggggtctattttggactttcagttctccataaaattcaacattaaatttaccgtaagagagataatttgactagattgtttagttgtgttcttcctgtcatagtttcagcttataaaatcattttatcatttactaattcgtcatgtgtatccctaaaaggctggttagtaggaaagcacttaaatgagaaagtttcgtaagaaaatatgctgcataccgatgttcgtatgatattttattcgtaatatgaacaatcttcttgtacgttatacactgcattcatgtaaatgttaagtcagataattcttgtttcaccatttagtctcaatggtttcgtgtggaaatactaatggcgagtgagtttggggcatcagtgctagacatcttctttggatgctccttgggttcctgaccactccataagtgtcatattgtatccagcacccttaagagctttccccttttgttactttctgtcttcctctcgcagccaagtgagccagaatgcctcttccctatcacctgtcacagagctctcccagcagcatcagtagaacctgtggcctcatatcacataagcaccatggatgctgcatgcctaccagaagtctatgaaaaatacttattggtaatccatttgataataggaaagttcactgagaatccatagcaacaaatcaaatatctagctcatggagtttcagcatcccttaatttgcagattggatccaagttacttgaatttcagacacgctttcatcgcatttgtccaccttccatattccgtaaaaccacgtcattcttataatttggacttgttcgaaatctcccttttcctgtaagatttgaactatccatgtacttatgtaataacctccttaaattacctactcccattgatgcaggctgcttcgctggatgcacctgatgcggcatttgtgaattgtgatcagcgctgctgcacctgacgaataattttgttttcctgt

SEQ ID NO: 15442 - DNA, 1087 bp, Oryza sativa
tactctgcttctttttatttggctatgaagcttttagtggcagagtcctcaagttctttagcaagaattgctctgttttcaatttgatatgtaatttgcttactgatctttaacttctggtactgtaggtgtttttgtttcaaaagtctgctctgcacaagtgcaacatggctggaaagcctgctgttgttactcgtgttgtggacagtatgactgacaacctcaggcctactcgtgcggaggctactgatgtggcaaatgctgtacttgacggtgagttgtttgagttgttgatgatgttaattgccttctgaaaaatctgaaccatatattttttgttcagggagtgatgccattctccttggtgctgagactctccgtggtctgtacccagttgagactatctcaattgtgggcaaaatttgcgctgaggtgaattttctttctacttttatgttttttctttacaattttcaacaagtacaatgaaaattcacttcttgtttttctgtctatatcagtctgttagtaacatgatttagtcatatttgtttgtccattgtttcacaggcagagaaggtattcaaccaagatttatacttcaagcggactgtgaaatatgttggggagcccatgacccacttggagtctatcgcttcttctgcggtgtgtttcttctcttgttcccaaaatttcttaacgtttattgtgcacatataaaatatttttgactattccattgttttttgcttcacaaagtctttatatgaaacaagggtttcttagtctgaaattgtttcttgcctattttgcaggtgcgagctgctatcaaagtgaaggcttctgtcattatttgcttcacatcatctggacgcgctgcaaggtagaaagatgtgaatataaacaggataatggtgtagtttaatcaaaactaatttcatatttcatctggtatctgtaatgtctgcagactaattgccaagtacaggcccaccatgcctgttctatctgttgtcattcctcgtctgaaaacaaaccaactgaggtggagtttcactggcgcatttgaagtatgtaatcagtcctt

SEQ ID NO: 15443 - DNA, 3254 bp, Oryza sativa
  unsure (1)..(3254): unsure at all n locations
nnnnnnnnnnnnnnnnnnnnnnnnnnnnnnnnnnnnnnnnnnnnnnnnnnnnnnnnnttgctgatcctcgccatccagtaagtactattgcaaaatatttgtgcaaaacacacttggtggattctttttcaattaaacaacacacggcacttttatcatgggggaggaatgaactctgcagatttctaatacatatcaatgcctattagatatatagcattaaacataacatgctagtcttattgcttgcatcatgccccactgttattgaaatgttatctaccacaaatgtttgaaagcaatagcggtatatgcagttaagttccaaacgatttgctaggacccttgttgatctttcaccttgtcctgcaggctgaatcgaccagcgctaccaatgagtcagttttgaaggttgctcttgaccatggcaaagcttccggtgtgatcaagtcgcatgatcgcgttgttgtctgccagaaagtgggtgattcctcggttgtgaagatcattgagctggacgattagacgaccagcttgtgcttgttgatgatactacggcaagtcatggtttgccagattttgactaggccaaaaacgatgcttcttggctatatgtataattcctatataggctttccaatgagcagtttttcctatggtgtaatcataggatttgccttactatttgaaacaactacgttttagttatgtaagttatcagatttcaatgcatcatatcacttcgatgggcaaatggaataatgaaatcggtactgtaccctttggtcttttgatgttcgttccacctttgtcaatgtgctgatgtgatttgcgtgttccctagaaaaatgtgatcatgtgatatagcaagggttaagggacatgacatggttgaagatctcaatgctccaatcaaattcgcagatctaattttggttgaaatgtaatctcccttgctattcaggcatgttttccacacaagaacttgagagaaaataactgctaattttggttgcaatgtaatcttccttgctattcaggcatgttttccacacaagaacttaaacagaaaataactatgttaaaacagcaaaaacagataacctgttgtggtcggcgacttccaggtttactaacttattacaaagcaactggggtcagctagaatcatacacattccacatcatttgcagatctcatttgctgaaatgggctatgatgtctgaacaaacctgacgttgctgaaaaggtcacaacaaacagctgatttatatagcttgtaatcagctcaatacagcctcatctctccctcctctataccgattatttaagcttacaatctatacacgtttattactgcattgcatgcacccattggatttcgcagtttgtacacttcaatgtgctgtacttcagtccagtctaaacagaatgtgtagctaaaggaacattttggcttcccatactagtgctgttgccaagcactacgtaaaaaatggtgcaaaatgctacttgcacaaaagaatgatcattgaccaatacccttaaccttccagaagcagttgtgcaggagaatctttagcttccgatggtcctatcataagtagtcaagttttctcttaaaaggggcaatcccgttcccacgtcattgacaggttgcttgatggacaattgttgatttccttgctaatttaagcaacacgagagactgaaaactggggagggtcagaagatatctgattagcccacagatttgcaactttaacaaagtagtgatcggcatcccaaatgatgacctccattcctacatcaggtgaagaaaataattattagttggttgatagaagcatcccatagttgaaaagtcctttgcggggaagaggtaactgcaggataagtatttaccaggtacaagactagtgggcaagagggtaagtttacatgccatcttgtcactgggaaggaagctttgaagattgggcacctcaatgtcattaatattgatgatagactcgagaagaactttagcaacaggtgcatgtaagttcttgctgtcgacaaccattgtaagagccattcctaaaccactagtccatgaattaacgcagctgttccaacaaaccaacattttactcaacattccaggatctgcaagaacccaaggcttgaaagatagcatggatatatgtaagatctgtgcaactctgtagatctccccaagagcaataaagtaatgagcacctgtgcaaccaacagaaggcatgttagttgatcatctttctgcaagcaaatgattaccgaaaaaacaaattatacagctctgctcattattcagagtcccaccttgagaaattactgtttcgccaacatttgcatgacaagattcctgccaaatcatcgcaccatgctcaattcttgggcacaggacagaagcatactgtaccatgcactgacataatcacattgctcctctttggatgctatttccaaggtacgaaggattgacacgctgtgcttatagactttaacagctgaactcatgtcttccagtgcctacgttgagtatcatatcaagaaatttcaataacccaatcaagatcatgtcatgactcatggaaacaagggcagaaggtaatggcaaacagaaacattaagtgcacatacgtatactgaaatcaagcaaaatgacatgtcatctatgaatcactttgcctggtacaatctatatatcactttggaggcaagttcaatgcagcttatagaaaagcacaatatcattttcacatttaattatgtttatcatctacaaaagaaaatgtgcatgtgactactgaagactatccgccaaagaatttaagaaaacaagtgtactgatctaaagtaacttgatataaattacaagatttgacagtgtaataaaaaaaacattttttcttttttgtcaaaaagcaggatatataaatgcctaaagacaataaggtgtatagagtctatagacaatgagacaaaaattatatttcctagataaggatgcttaccattgctattatttctgttaaatggtattctttatcaaaatccttcaaatgatcctctttggcactgttaagcagctcaaaaatgcaaacatcctttgaaggatgttcatctttgcaaaaacctttcgcaagtgaagaatcttgtaattccttgcaaatttcctggagattatggaaaatgattaaacaaaatattatgtttaattcatgttttgc

SEQ ID NO: 15444 - DNA, 1300 bp, Oryza sativa
  unsure (1)..(1300): unsure at all n locations
nnnnnnnnnnnnnnnnnnnnnnnnnnnnnnnnnnnnnnnnnnnnnnnnnnnnnnnnnnnnnnncattgcatgcacatcaatataacaatacacaagcaagttgtgaaaaagtcatgctttgataaacatacaagaataaaataatttatagcaaaacattaagcggagcacacctgaatctccctttcagtttctgtcatcacttcattcttttcatcagaaagcatagaattcttctggctttcctgaatccgtatcaattacaaaattatgaacggaagataaccaaatgatttatcagaatataatcagtagtgactgaccttaagatccttcttgtactgggatattaccgtcaatgattcttctctcagcttatggtagaaatcaatcaaaatcctatcacttgctgatttaattgaatggttttcatctgttccaaatgaagagttctgatcactgatcattagtctgtatcacatggggaaaaagggggtgaatgtggagccgaaataccatgaatactcaccatttcagtattagagaacatatcagaagagctttgcacactttctgaagaacattgcataatgtggacagcatcaatcggttcactttctttgtacaggtcgagtatggctgcattattgggtggaaaataactaaaggccttcacactttgtccagcggactcacgagttccaacatgatctgtagtttgaacattgttcaaattttcgctaacactagtaaataatgaccagccctcctggtcgctgctcattgactttggtacatcctgacaaaataaaaagattcagaccaatcagtggagaaggccatagacatatcaagacctaatacagaaaaaaaaactagaaagaggtcataacaggatttctaatgctagaatttcagaaatttttttttaatcaaaagatatataaggataaaattcatcctttgtttagcagggactagggaattcttataacaatgtctgtgtgctgttaaatttactactccgtaagtcagaattttatactatgtatacagattgtaataggcaataaaaatccttctaggcagcttgactgttcaacttgaagaatacaatcacatgatttannnnnnnnnnnnnnnnnnnnnnnnnnnnnnnnnnnnncgacaatttcatcgaaggttagctccaaaattttctgaagtgggattatttgcaattgatgaattgtctcattttaacagtttccacaaattttgccttccaccgacaattgccattggatggatccccatgagc

SEQ ID NO: 15445 - DNA, 666 bp, Oryza sativa
acagcagactgcacaacagtcacttgcaggatctttagctaggtagatcatgatctgtcttgaatacgatgattctccacatgctttttcattgtttggttgttaatttcaccaggaggattaacttcagatgatggcaagttgttatccccttccactgatggactatataatgtccgattcgactggtcaggttcatttataagaacctgagatgtccttggtgaatgccccgtgccgacaaacaggcaattgcattgatctgaccttgatggttcaggggaacatggaggtattatcacttcacttggtagaggagacattgtctgcttgctatcagggtagtcacacaatgaaattctacaaaccgggcatgttgagtgctgcatcaaccaaatatctatgcacaacgcatgaaaattgtggccacagtaaggaagaatacgaagtacgtctttctcttcatagtctgcaagacagacaacacacctgccaacaatggaaggaaatgattcagaatataatattggtgtaattgggaaaatgctaacaatcacctatagaaacacaaatcacaattcagatactagtagtatttatcagagttgacaacagtttatcaacactttaactataaaatacaatcccacaatggatgatgccaaa

SEQ ID NO: 15446 - DNA, 741 bp, Oryza sativa
  unsure (1)..(741): unsure at all n locations
tagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggnnnnnnnnnnnnnnnnnnnnnnnnnnnnnnnnnnnnnnnnnnnnnnnnnnnnnnnn

SEQ ID NO: 15447 - DNA, 6105 bp, Oryza sativa
  unsure (1)..(6105): unsure at all n locations
nnnnnnnnnnnnnnnnnnnnnnnnnnnnnnnnnnnnnnnntactatgagaccttctttgatcacagatcttacaatgtagtttgcgcatatagcggaactccatacctttatacttattgggtagtaaaacttaaagttaaatggcatggattctacagtgataaatagaaataaccacacaaataattaacaaccaggattctgaggaaaaattatctgagcctcatgggaagacagtttggtacgtcccttggatgagaacatcacaggtaattttcgtaccccattttgcattaattactagtaaattgtttgccagtggcattactgatcaataaaagctgcatcacagtcctcatcctcattatgttacttgtagactaatattttaacatgaagtcagtctgaaagtaggaagtatatgcattggtgccactgaaatatttagttataggctgagtgcttcaccatgaactttggtggtatggtaggaggtaaaacttgtgctttcactgcgaaacatatgaaaagccacaagtattttctgcacattgcactgaacaaatatatattctgccttatgtagttatgtacatctcaaaacaataccatcttcagtttattttctagggattgtgtttgaactgaagtagcaaatcactccaggcccagtttctgtcataaactgggtcaattccttttcttcttaatataaaacaggaacccctgtcctcctcctcgaggtttaccttggggcaaaaaaaaaaccctgaagtgtcgtaagttcaagcatgataatgggtcctgttgttttagtgatgagatatatagaatatgtaatactctataagttcattcatcaatacccatgctcaagtaaatcctatttgtttgaatgataaaaaagttcacggtttagttcaagctctttattataagtgtggcaagagcaagagtgcaagaccttggtcatgatggaaaaggtgaaaaaagaactgaaatcgtcaagctgacacagttcatcacaaatggttgcaggatttacctgtacttaacttgaatttgtcatagaagattgctcttatctatcatcgtctgcagaaattttgagttaggttatcgcgaccggtgtttgatttcagagctcttcattaacactttaactctgtaacttgtattggagtaatggactgaaaactgccaatgcccagttctgtcgattcaaaatcgatcaactgggttttccttcttgattcactgattcattcacacgattcattaagaaggtgaaggtatgcgactcctgatatttaagcacagaatatttcacttaagagttactaacatccaacaactaatgaaagcacattgttgacaattgacaggacatgaaactctttttttttttcctttttccattgttccccgacctcagccaagttgggcagctacttgccttggaagggtgctcgaaggccatgtgcaaggttagattaaacaccatattattttgcagcctactataggaaaaggttctctaggtctgatttctctgtttgttttcactttaattatcatctggcagctttataattttggttcctgttttgctttcacctcttttgcatattaaaaggtgtaaagaacagaggtgtgtgagcttctcccgccactttgttgtttttatattacatgaagcttgcaaaaacgtttcgtatcagaatccccactttctttggctaattacacaatactaccatcacgtctctttaatcaaagcttattggtaatcgcctctattatattaaaccttgggaggcgagttttggcttcttgtgagtactcttgaagcaagtacagctatccattaatccataccccaactgtcaatatctcaacaaaactttccttatattttcctttcttgttatggcctaacaatcagaaatgtgttctttggttcctgattgttaaccgtttagtttagcagtctaacataaaaaccaataggtatgtctaattacactagtatcagtacatgtttgccattagagggagaatccttgttaatgcatgtttcagtatctgaaatgcaataaatgcaatatcttttacttacagtgtactacattgcgtatccaaccattgatccgcagctcacatatctccccatcttttgcactcgccactgcacaaattttgctccagctagctgttgtactgcttcacagagttacagcgttagcactgtaagcttttgtttccaaggaaagggatactgaaactccctctcacccgctcaagttgttactactctgtagtctgcacaactaatttctctgcaatttgttgagtagtattttacacttgatactccactgtttttgtttctgcttctcttgtagtctggtgctccttaagttcttttaccaccagtaggagtttctttctcattgtcattggggataaaaaaaagggtatggatgggatagcaccggaggccttgtttattcatacccatctatttgttttataacaacgaggatttggagcttttacagttacagcgcatcatggatttgactgggctttttttatttttcaactttgaattaactccagctactacactgatttcccgaaaggcagagctttactcctttcagtcttatcccctcagcgccagttggacagctgttcaggctgttttttttttaacgaatggctgattaaaagaaatacagaattggtttttcatggaaaggtatgcagacctccctcatttgctgtttctggagtacgttgggctagtgtttggagactgaccaataatactaggaaaatgggttatgtgggatttttttatagttttttttacaagaactgaactaactcatgaatattcttgcattccaaataaatcctaattagttctattgtctttttacactatttggaactgtcaaagattgagacaccgttctatcttcttccatgttttttatatgagcatgaaattcaaaacacgagaaagatagggaatcatttctttcttatttttaactatgtaacgaccatttttttagaataaccgatgctgtttattttactatataaaatttgaccatggataggaagattagggaacactttaattttttttgttaatactatgtaacggcctttttttccggaataaccggtgttgtttattttactatataaagtttggccatggatagaaagattgggaaacactttagtcttgtttaaactatgtaacggccttttttttttggaataaccgatgttatttattttactacataaaatttgaccagttatagatttaaaattgttcaacgagtgaattaatgttgttgtaaaatgattcaccgagtgaattaatgttgtattgtattaattctagattttccatgcaaattaaaacttttaagtttttataaaaatctgttactaaaaatagtggccaaagttttactgtaaacacaatgatttcagttatttaaaaaggatggagggataacttgctgtacaatagctattgcccaaagtactgaactgcagggcacatcctccaatgtgattgcttttttcttgctgactttatgatataaacaacaaagtgtgaaggaaaaaacaggggaaggaaagacatactggtaaagaagaattagacaaatatacagtggtacaaatttagaataaaagaatcttacttggacatttttatagggtttgcatagcagatacttcctccattcttgaataattgttactgttaactacaaccgtctcattctaaacagaaattacttttcaattattacattatgatggatcggagttattcgcttatatttatgatggcatatacttcgataatatcacatatttttaagtattttttttacgaaaagacaaactgccaagtttaaatttgaatagtgtaagggtcaattttattcgagaatggaggaagtaactagattcaataagattacagcatatgacaaaaaatattggccttaaaatgtgccttatgctgtcatgtagtcatgctaacaaaaaaaatgcagactagggttaaatattatttttgcatttagaaataattatattggtattaatctgaagttttaatttgttcctacatcagatacatttcgcatctttatttttctcaccattttttctgaagacatcgtgcatcgcattggttatgtctactgttcaataaaatggaggtacgtactcgtatgctgtactacgtactccagtacactttttttgcagtccaaccaatcagccaagttggtcaaaggagagagagcgaaagagagcaggaaccccgccattcctgtgcagtttctgccccaaaaatctcatttttaatcatcccatttttttcccctgtctttaaaaatcttcctccatgagacttcggtaacaacagctactactggtgcctggtagtaaccagacacagagggaaagcaaaacaagagtgggtgtctcctgttgtctgtcttcctcctcgtttgagctccaagcaagcttagccaagaaacaccataaagaagagagtgagagagagtgtgtgtgtgagaggaggtgagcttctctcacatgcacatggagggaggggagggcattgctgtagcaggtgcaggtggtggccatgaagccggcttcggtttgttcagagcggccgatgtgaccatgacagaggcgcaagaagcagccaaggagtaccagtcttctccctcctcgccgtcgacgtctcctactccttccccgccgccggttgctgcctccggccatggaggggaggccgctgcaacgccgaccatgtggagtttgggcggcgagaagatgccgagtgaggctgcaggggacaacggcatgcagatgtcaggccacagtgagcatgctagcttgagctccggacggcgtaggggccggccaaaagggtccgggagacgccagatcctagccactctaggtcagtatctcccttccaaaatcccaagtttattatacatttttttgtgtgtttggaatatactcatttttccatttttgctggttattttcttgctatattcgccatcgtttgtggatttttctgtttcattgccttggatggggtccagtcagggtgatgtgtaagctcccttttgtgctgaaggaaggctagctagtcaataaccgttagttagcacagtcctgttctgctgttcttgtatcgcattcgtcccctatttttgttcaagtgattatttttgttttcccccctttcttctcagttggtactaaccttacttttgaagattttgtctaatttctgtagattattataatgcaattaaggttttgtttcacatggtcttgtagtctggttattcagaaaatgcgcatttgcttgactgattggtattctgcaatgcttgtaaaggggaatggtatgcgctatcagctggagggagcttcacccctcatgtcatcatcgtaggcacaggggaggtaaaccctctatgttattattcctttttcacaggtcatgactagcttggcattgtgatctggtagcgagagaatgaacactgactgttcttgtgcaatccgttggtacttggtaggatgtggcggggcgcataatgtccttctctcagaagggtccacgctcgatttgcatcctctctgccaatgggaccatctccaatgtggcattgagccagcctggctcgtccggtagcaccttcacctacgaggtatggaatggagttgcatcttatgatggttctatgatacttggcaaagttgtgatctttgacctgctagcttttgttaacttttgatgggtatgtacaaagtcctgaataagctgaaccattttggtctatttagtttggggtcttctctaccaagtcttttaggtcccatatcaccactgtaataaataacggagtaaatacgacaaatggttttcttgcctaaatgttctatcagggggtatatttccannnnnnnnnnnnnnnnnnnnnnnnnnnnnnnnnnnnnnnnnnnnnnnnnnnnnnnnn

SEQ ID NO: 15448 - DNA, 1004 bp, Oryza sativa
  unsure (1)..(1004): unsure at all n locations
nnnnnnnnnnnnnnnnnnnnnnnnnnnnnnnnnnnnnnnnnnnnnnnnnnnnactacatggttggtcggccatacatcccatcaaatttctgaaaggtagttaaggtcacaaggttagcatcatcaacagtaagaaaggctcacctgagtaagatccccatgggcttgtctgccgccatcctgtacagcatccgacgaagaagaaggcgccgcggccttgaattcccagccatcatcttcgaatccgtcaccatcctcctcctcctcctccgccgccgctaccgctgacccctcctgtgtacccacctccgcggcgtcggtggaggagggttgcgggtgagatccatagaggccggcgatgaggtccttgagatcagccggcttcgatccattggaggacgcgtgcgacgctccccgctgatccgcagccgtcggcggcagctcggccggtccctcctcctcctcctcgtcctcgtcggcgccgaacagggagagggggagcgggccccgcggcttctcccaggagggcggcttctccgccggggccgccgccgacgagccaccatccggattggatccgaggcggctgtcgacgaagtcaccccagtcgtcgtcgtaggcgccgaaggcgtcgaaggcggcggcggcggcgggctggggatcggcgaaggcgaagtcgccgaaatcgaggtcgtcgtcgaggaacggggcgggcggcggcgggaacgcgacggcgtccatcggggaggtggggttggggggaggtgcaatcagcaatggcgggtgcgtgcgtgcgtgcgagagatgagatggtgggcggttggaggagaagaggacggaaagcaagagggaggctcgatggtggagccgttgatcaagtcgccattgccaagctgtattccatcgtcagcgccagcaaagagaatgtgtctttttttcttattttnnnnnnnnnnnnnnnnnnnnnnnnnnnnnnnnnnnnnnnnnnnnnnnnnnnnnnnnnn

SEQ ID NO: 15449 - DNA, 4391 bp, Oryza sativa
  unsure (1)..(4391): unsure at all n locations
ccaagctgtattccatcgtcagcgccagcaaagagaatgtgtttttttttcttattttccttttttaggaaaataatttctttgatttctttcattggctttgctaggttggcctattgctggcacctgaaatgttgaaatgccaactttgagagacagatgtgctatttcaaacattggcaataaacacaccaaaattgaaagtttaatggaaattggaacgatgtgacggaaaagttagaagtttgtgtgtgtaggaaagttttgatgtgatggaaaagttaaaagtttgaagaaaaagttgggaactaaaccaggtcgaaataagaatatgcatgtttctcaaatttatatggttctatcgtttgttctttcagcttattagccgtagctaaactttgaattaaaacttggttttagaggtgatttttatttttttttattgtagtttgttttacataattagattttaagccaaaatattacttgtaagttttttttttctaataagcgttgacttataatcaattttttgcgatttacgtaaaatactttttgtatatatgagtttccttagaaaagtggttttcaatttatttttaactttataatatttaattaattcatttataccatcaaaataatcgtaacaaatcattcaactattcagcaccgcataacataccaaatcattgacaccataaaggcaatgtattgttcataggaaaaatgtctgaacttttagctcccaaagctcaagtcacaatgcagtgaaggactgaaggcacaaaaatgccgagagattgtagaatttgacaccgattgcgtgcagttcaacactcccaactacttgtagtagaattcccagcctacagtacaatgagtccatgttttggtcgtcaaatcgtcagttctgcactatccgttcctattcattcattcttgggtttgaacagttttatgagataaccaatcaaggacacgagccactgccagaagcgaacgatggaatttgacgccttcggtttgggttcgggccttggaccaaagaggcctttgtacagctccttctgtttttggtacagagctttatcctgttccgcgagagaccgaagctcacgctggatctccttgtcttctggggaatgtttcttggctttcaggaagtcctccctcgctgattctgtctgaccaagttcagctcttgcttttcctcgtctgaacaatgctttcacattgttttcatcctctgccaacacctgaagaataggattatgagttcatcatccagtcaataattattcggtttcggaaaaagggggaaaaattcttcacttgatgaattgccaggtcagttacgtcatgaaattagtgagggttgtcttacaaaaataagttgaggaaaatataggcaactgcactatattcttcactttttggtccaagcgtctagttaccataataatatcatgttgtatgtctttattgtctgaaagtcaaatcaaaatcctaattcatctgaagctatacacaaaccgactggtgtgagtgtgacagcatgagttttaatagattgaactttatgcaaacaaaaaaaacttacaatactacactgtgcgatagcttcatcgaatctcttcagtttgattaggcatgcggccatgttgagatgacatggatttttcacagccaaggccatatctctgtatttcccgaacaattgaaacatgaagtcatctcccatgtatgcaatcgcctgtaaagaggaggagctagaggattacgattagagaatcatctcacaacagttgaagaaggacaactaaccatttcatattgctgcatggcctcctcaaacttcttttctttgaaatactcattgccctcaatcttcctcctgtccgctgcttcaatcctttcctctactgtcatgtcacttcgggctttcccctgcagttgtacacaatttgtaaggttccttagaacatccaaatcaccttgaaaaccataaataaaatgaaaccaaccaacaatagtctcagattactatcagaaataataaggataagcattatgttgggtggagatggtaagaaggatgtttccctacctctttgacatcatcaaacccaataagttcaacttcatataaaagatctgccattggagggacatttgggaatgaaaagctcccttctttcccatagcctagctcccagccaacatgcaacagtgcacgctccccacttctcatgttaccaacaccaatgcctaaaccagacatttgttttttctctgtcggtaaaaagagaaaaaggcttttattccatatgtgataatcactgataaatcccaggtatactctacatgctcaagagtgtccaaaagatatttgtaggaaagttatatagttaccctgtacctgtattgtatatttagtgaaccatcagaaaacagggggggaaatatattagtaataaaaatataactatttagtctttatgtccttgcaagttgtcaatcgccctcacacacacacacacacacccaaaaaaaaaactagaatatcaatagcaagttgaaagttgctgatcgatcaactgattttcaaaacccttattagaatcatagattatttgtggcactataagatcagaatggcataagagtaagctatttgatgtgtatcatctatagaaggcatgcatgcagtgtagaagaactagggataaaatgaagtatcattattttcaccttttccaattactagttcaatgggatgctgttcttgccaagtatcctcgaatttatgcagagagccttgaacccaagctctatagtgcactgtaacagaaaaaacagaaacaaacattatgcagatgctctccttctgaataagtatatacatggtctgagaatggaagattgatctgtaatagacagacgttgacatgcttatacaaatgatggacgtgccacttggtaagaagtgctcaaagctgatgattcatagcaaagcacaagtgcatgactagttttaaatatcatttgctctaagttgttatgagtttggtgctgctatgtgccacactagttattagtaagcctgtggtgttagagaaggctgtgcgtacatcgaattgttcatcctaaaatactgttaagtatttcatgatttctggtatctgaataagaagctctttccacagaaagttccagtactggcaatttagttaaaaagaagtgtacaaaaaagaaacagagagctaggagatagtacaacagagcataaatactgagcccctagtacatgtaactttacaaatgtatgttctgagcccctgatacacagagaataagttctcttattatggaacttccatagaaacaacaacgagatgaaatgtgatgataagacaaatgctaatgaaggtggaatatattagcctcattctataaatcaccaggataaatatagggaatgatcaaaccatttatgacatacaaaagcacgtcgcgaactttgatggtttcttgccatggccttctttgatgacttgttttttaactttgtcatgaaggacctccatattagaggaaaccacaggtgggacagagccatcttgcggaggttcagtatgcacaaaagaagcttcctctacagttatctcattatcacttgaacctgaaaaaccaggatacgggttaagaacaaagggaaattgaagcatgtttaataaagtactccctattttaatacaaattctggttctatactggtcatgttgtaatgtagggtcgaagtactatatccaatgttcagtttccaatagtgcgtgtttgttgattagaaggaaagggacaacgtgagctacatttttcgctgtctagtatccactatcatgtagcacgccgaaccatttaagctcctcttaggactccagcctccaggcatgcaggggttttcttttccagatttctgttggaagtgaattgttttaaagcaggccagagaaaaaaaggacaatagacataatccatatggttactgattgttcctgtagacctatacagaaatcaactgtatcgttctatacagttgaagcaaattcagaaatcgatttatacttgaacttgtttctccggattcatcaaaacaaagggagaaagggatgccatgtcataattaatttcactattaggtctaccagtacaatttagcatttgatttgagcatcatttggggtacttgtatcaaggtggaaactgcaaaacgatttgaattctgcctgcgtgctcgggagctcaaactaatccaagcacataatcnnnnnnnnnnnnnnnnnnnnnnnnnnnnnnnnnnnnnnnnnnnnnnnnnnnnnnnnnnnnnn

SEQ ID NO: 15450 - DNA, 2332 bp, Oryza sativa
  unsure (1)..(2332): unsure at all n locations
ccggttcgaggagatgagactgagaagtcaaacagttgagaataccacgagagactccagcagcagcagccgccagcgagacgtcgccgtccggccgccgcttgatgcgggcttcccttttcgacgcggccgtatcaaggaatccccatgacgccaagctctacgctattggtccaacttcatgaagaaattcttattgcacttaagaatttatcactcgtaatccctccgtactcgtaaagtcgtttataacagcgacacggtctccaaaacacaactttgacttcttttttctataaaaatatttattgaaaagtgatatatgtatacttttatgaaagtatttttcaagacaaatctattcatataatttttatattttcaaactcaacaacttaagtgttattcatgatttatattcccaaggtttgacttaaacattgtcctaaacgacttcctttataagtatggagagagtaacttataactcgtggaattcttatatattcatgatatgtggattcagtgataaatacttaattgtcattttaagagtgacaaatagcaaaatttctctttcttacgagcctcattcaatttctgttgttcttttcacggttcaattaaataattatttatgtactttataatcataatatgttttgtaattaaatttctatcataatcttatatttatcccctttttctgttttcttaatattgtgcttcgaaggaaccttaagttcccaacaactgatgtaatatactaccttgatctaaaagtcttcttcgtatttctttaattactaagaccaagaagaaactacctcatccgattaatactccatatttagcaaaattctcagcatacatgcaatggtgttggactgttggaggatggctggtcggttccgaaataaacttaattcattgttgctaaacaaagatatactctcttcattcaagtcttggatacatagaaattacaaataggaaaataaaatagtaagaaaaatttaggtggagggaatatatatttcactacaactagacatctcttgttagctgaagtaacaagtataaaaacagaccagaaccagtagtacttgttttttagataatagatttatattaaacccagcctatacacaagtagtacttgttagctgaagtaaccagtagtgcccatcttacagtgcagaccaaaatccataactctacaactaaacttggtagtcggctgcagtgaattacagaattgcgtcaaccgggacaggatgccggcaagatggggcagcactacggcagcgtgccgtgacagacaaacgtgctggctccattcatcatcagacaaacgtgtaagatcgggcagaaacgatcccaactggccaactatgcgttctatccagaggcagcagctgaaataatgcacatgctctgaaacagtcacagctactcacaatgctccccttgaatcgaaacagtcacgtttctcgcggattgtagtagaattatatatttacatcattcattgctggagctcctagctagatatgctcacctcataacctctctgtatgaaataccaagatagcatatcaccttggcaatacaggctaagctactacagatcagagcagagcggtgcagcttcctgccaaccaactctaaaatgttccaaaaatgtgtccactcactaggataactactattacctactcgttgggaagtgaatggatcagctgaggagcagcatcacccaagacactggatgaagctttgttctgtcctgatgagctgctggatttacttccctcttcaaattgtcaagttgtacttatttagctttcgccagccagctttcagtgttttggtgccaacaagaggtacattttgacctatcatagattgtcttttcaacaagaggttgtagacaagctcattccaggtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcatttnnnnnnnnnnnnnnnnnnnnnnnnnnnnnnnnnnnnnnnnnnnnnnnnnnnnnnnnn

SEQ ID NO: 15451 - DNA, 967 bp, Oryza sativa
  unsure (1)..(967): unsure at all n locations
annnnnnnnnnnnnnnnnnnnnnnnnnnnnnnnnnnnnnnnnncatagattgtcttttcaacaagaggttgtagacatgctcattccatgtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcatttgaagcacatgttgtttgtgcatccaaaaaaaacattatcaacatgaagctaaagcactaatttccagccaaaagtgaatggccaagagattgcagaatagttctgcttttaaagcatctttgtcaacatgacgatggtttattgttgattgtcttactatatatggtactcagtcaagcatttcaatggaaactatgcacatatgttgctattattgtgaaagcagacactaaggtacctgactacaaaatttaagcaagtatccaaatcatattcttagaacaatatcccaagactgtcaaataatgcttgagcaaggaaatagttgaacaatcacatcactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaatannnnnnnnnnnnnnnnnnnnnnnnnnnnnnnnnn

SEQ ID NO: 15452 - DNA, 3743 bp, Oryza sativa
  unsure (1)..(3743): unsure at all n locations
agttcattttacatgggacatgcaggtattttagggatcggttccaagcagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaaaataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggcttgcagggtgaaacgttgcagcatatgcgatgaacatgggcacacctacaagcattggtctaaagacaaggagaaaccaagtgcggcggaggcaggactatcaggatcagcagcagatggagctcgccctacgggtgaaggcactacctccactcgaccatgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgtggtgcagggggctcagcttgggacgttctgggcacggacgtgcggtgagctactcacggttcacgactcctttgtcgagaggtacgaacagtgttttactataagttagttgcactgtaatattttttataatgacatattaatttgttattgcaggctacgtgaggccggccttctaccgatgtgtcagctggtggaggctgcggacggcgacgcagaccactgccagacgatggactatggacagggtccttcctagcagcttggtcgatcgatcgaagccagagacgcacacttttcacttagcgtgcggtgaggtacccctaacctacangacgtatcgtacttgttggggctaccgctcgcgggagacgccggtgggccagtgaccacggctggggactggcaggacgatctgacggcacgtttcgcactagtacagggcgcaccgcacctcccgctcgagctgttggcacaccaccgcaacaccggacctacgaagaggtggctgcttcagttcaccgtgagtgtttttgtaccgaaatgacaatcgtattacatatttagtccgcattaaggtgcctaacattttatcgacggcttgcaggttgagcagctacaggcggaggccgacgagtactcctacagccgatgtttggaggcgtacttgctctggctttttggctgggtgatgttctgttgcggtcacgggcacgcggtcgacaagggactcgtgcactacgccaggagcatcgccgacgccacggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgataggattgcgatcggccgccctgaggtggaccagcacgcgtacgaggagtcactgtatgaggagcgaccagaggtcgactaccctacgatgggtactctgtggtgccgacgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccacggctacccaggctcgtgcgccgttgggtctgtccacactctgcaccagggaccaggcgtactggatgaccacggttccgatggtcttcgacatctgcgttgagcctcacgcccctttccgcgtgatgcggcagttcggcttccgtctgccctttccagtaccgtttccgaccaccgtcccagctgctgttcaccggtaagatcttgcactacgccttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtacaaggcctacctacgctggtaccagccacgcacccgtactagggtcaccttcgctcccttggagcaacagccccacgttgcgagcactagagacctctatgccagacactgcaaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagttctcacctgtcgtgcagacgacgttgctcgggcagacgcagctgtacatcggccccccgtaccgactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggttagcgtctcaggcagctgtgtctacctcgcactcagcgcagttctggcagtacaccgggacttcgtcacaggcagccggcacgtcgagtagggtccaccactggaccatgctgggacctcgtcagaccact

SEQ ID NO: 15453 - DNA, 1142 bp, Oryza sativa
gccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgtgcatacatcgagtgggtcgatacagaaaatcccgttctcgacctaaccacttgtttacaagaaggtcgcttgcatgcctgcatccgaaagtactgagcaatacttacagagaaaagcggcttatgaacgacaatgtcgtgaacaacagagcgactggcgggtgctaactacggcactccctccatgggaagcccatccaagatgcaggtgtggtgatcgttgtcaggttcttcgttccataaatcctacaacattgggtcgaaggttctttgtttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacatcagaagggttctaactccacctagccgtgttgtgcagcttgaactaccaaagcaatacagggttactaaacgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaataatacctcccttaacatatgaaattgcgcaacaaccaacttcaatacatttttataacaatattaacaagttttaccaataaatacttctttatttattattaacataacatagaaaaatcttttggccgtactttttcatctgg

SEQ ID NO: 15454 - DNA, 695 bp, Oryza sativa
  unsure (1)..(695): unsure at all n locations
ccgtggatttattccaaatgggggtgcattctcatttctcaccggccggtgaccttcttcttgtgatgcttatatatgactatgtatgtagtgtgcgctactctgtccgaaatccgagtcgtttgaggtttcttttgtcgtgtcgatgaaatgaaggtagacaaaggtgatcctgcgatcgacggagtagtggcggcgctctgcgtggcgtcagctgtgatggttgccgtcgtcgacggcgccaaggaagatgggcgcgtcacgcagctgtcgaatggcttcacggcgaggcattcgccgaacgcgccggctccgttcgagccggtgctgtacgcggtcaacggcgccttcgccttcgggttcctccgcgtcggcgcggcgtcgctggacctcgacgtggtgcacctcgcctcgtcattcccggtctggcgcgccacgccggcgcgcgtcggggactggtcgcgcccggcgacgctcaccttcgacaccggcctcgtcctcgccggcgccgacgacgccgccggcgtgctgtggcagacgctgaacgccatcggcgacaccgtcgtgctgctcaactcgtccaacctcgtcgtccgccggttcgcggagacaaatacggcgtgccagagcttcgacaacccgtcggacannnnnnnnnnnnnnnnnnnnnnnnnnnnnnnnnnnnnnnnnnnnnn

SEQ ID NO: 15455 - DNA, 1106 bp, Oryza sativa
  unsure (1)..(1106): unsure at all n locations
nnnnnnnnnnnnnnnnnnnnnnnnnnnnnnnnnnnnnnnnnnnnnnnnnnnnnnnnnaacagcagcactcgatgatttgggactcaaggacatagtctaattcgaattatgtgcacacaaatggagaacttacactagccatgacatacgtaagctagtcctatgtataaacacgtatagactagaagataacccaggctgctatatcgcgtgacaccctacgtaggacacaatacaccatatgcgtcatcgctcgaaaagaagaatatcctatagtccaacgaacaaggaatcataggcaagtcactctccttgcgatacaaagaggacaggaaaacaaagctaacagcagtggctaacattttagcgaagagcttgacatggtgacacaataggaggagaacgatgaagcatgtgacaaatcgttttgctaaaaccatttgacgtttcagtttgttttacacaaatccaagaaaataaaatgaaactcccgtttatactaaatcagtcctttcatataggctgattttttaaaaaaaactttttagagacataaaaacccctcatatacaaaaatgagccttgtggggctgtggcacagctaaaactctgacattgattgctcagcagggcaaaaccttgttgtgcaattatgccaattaacaatgtcgtcttaaaggaaacccaatacaaaaaagaaaaggaggaagaaagatataaagttgtacgcaatttattgtcaaatcgatattatggaaataagactgaggtggtgtttggatccagggatttaactttagtctctgtatttagacactaatttagagtattaaatatagactacgtacagaactaattacatcaatgacagctgatttgcgagacaaaatttttaagcctaattaatatataattagagaatgtctactgtagcattataaaggctaatcatggattaattaggctcaatagattcgtctcgtgaattagtccaagattatttatgggttttattaatagtatacgtttaacattgatcattagtgacannnnnnnnnnnnnnnnnnnnnnnnnnnnnnnnnnnnnnnnnnnnnnnnnnnnnnnnn

SEQ ID NO: 15456 - DNA, 826 bp, Oryza sativa
gcgaattcgagctcggtaccctgcatataaaataatgcgtacctgtgtagatatatgctggatatatctacgaaattagtagattaacttgaaaattaacctactaaatacctttggtttgcccagatggcatatacacatataactaaagtcaccatgcatgtatgccgtatggatgtgtgttgtctgatctttgaatctgagttgagccacgtgtgcatgtgcagttggtaggaaatcggtaattttgttgaccgtgtatcccttgacttacgtggcctcgcaagtctcttgtcacggcaagggataattagagtccgattcccacacagcatacgagcacacgtagtcgtctaggattcaggggatgagtcgtccgatttcctcggtgatggcgttgatctggcggctagatggtcaaccgatcggctctagtgaattttcagagcagacactgtgacccgaagatatagctggcgccgacgaagtagtgaactattgtcctccacggtcagctcaagtactccgattggtgaggtagatcaatttgttgacgatgatgatctcgatctcgtcgggggaacgtacttcgttcgggttagatctcccagagccgaagttgtcgagtaacttgttgtcggagaatccatctcttaaacccatctcgtcgaaaacctgaagcaccaaaatccactacctggcgcgccactgtcgacgtttaatgttgcgactacggtatttggacagtatggggatcgttggtactagggtatacgcgagactgaggtaaaagaaatggggatgatgatttttatataggttcggg

SEQ ID NO: 15457 - DNA, 1330 bp, Oryza sativa
  unsure (1)..(1330): unsure at all n locations
cctataggtgtcccttgtccaagtagaactagggaaaccaatatggatacaatccgagtagtccttctcggtacccatgtagaactctggttgtcttcccttatccgaaactcctcatatatccgcaggttgtttccgtatagtatatggtatgtggtgggtcatgccgagatttagtcaactactattaggtatgtggtatccataaccctgacaaatatattaagtagtgatcattgagtgaaggttgagttttgtttagtatttctaccattgcagtttcaccgttcatcggtttatggaattccaatttcaagtttttgattaatcattcatctgcaattgagttgttgtctttcttgttattgcttgtgttattcgaatctgcacgcagggattagcttttctagcaaggctgatcgggttttggcataaccagatgagacatgatactatgattgcatagtttggatcgtgtcgattggaaaccgaatcgtgtgcgccaagttttcgccaaatcgatagttgtcctcacttgacagaagatcaggcatcccgtggcaatcaaccacctaaggtagatattttcatttatggttggccggcgtatatataatctctgtaccaacaacttataagttatatacagtttttatctttctcaaatcagaaaatcaaaatccctgaaattagcggacgattctcgtcgatcgaatttcatagattttggtctctttggtcatgttaatagattgatcattctattgtattttctctttgcgagtatacaggtgataacaatacattttggtctgtactttttgcagaagcagaactacgtgttggcatccatataatggtaaaattcgaacagaaaaaacaaaatctgtacaagcaatcacaaatcctaacccaaaataaaccctatccaaaactacagtgcagctattttcttcaagaaacacacactgggcaagaattcacaagccatacaagctgttcgtctgatccatggatggatcacgacttgaacgagctgtttgagcttcccatggacttgaggtccttgtacggccccgacgacgtcagctcctgctccatccccccggcgcgccgccgccgccgccgtctctgccacagccggtgacccacgtacgctccggcgacggccaggctcgccaggatcagcgacagcgccgccgtcacggccttcgcgccgggcgacatgccccgccgcgtcgagctccgcggcggcctcctgaccttgaagtagnnnnnnnnnnnnnnnnnnnnnnnnnnnnnnnnnnnnnnnnnnnnnnnnnnnnnnnnn

SEQ ID NO: 15458 - DNA, 819 bp, Oryza sativa
actactatagggcgaattttttctcggtaccccactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaataggtgccactgatacaagacataacagtaagagtgtaaggcttatgccatgtatattacagatatgcaattatgttaacttaaaattttgctcaaaagcagaacaaattgctcagaaccatctatcagtcatcatatatgaattagagaacataactacagaactatagtttagatattaatgcttaccttctgattgttttctcgtagttccaccagtgcccagtgttaaggatcaatacatcagcatccctccactggccccggtcagacaaccaatccatggcatctaccctaattgtatatttaacaaccccaggagctccaggtggggcacgcccttgaaggactataaaaggagatctgtaatattccacggtgcaattgtagtctctaaacttgaaaattaagaaacccatgtgttttgtgatgggattcccattaacttcgaagatggagctcttatcaggaacagcaacagagagcatacaaagaagagattcccactggttccgcccaattgaatcaccaacaaatactactctttgtttctcaacttctccagcatatttctggcatcaaatctagaaatcaaagaaatatggtgaaat

SEQ ID NO: 15459 - DNA, 860 bp, Oryza sativa
  unsure (1)..(860): unsure at all n locations
tagggcgaattcgagctcggtacccatctctcggatgcctaaccatgcgcataacattgttttctaacccagtggggagcataaggcatcgagtttccaatcgcggtgcacagttcctaagtgcgggggtcgtcaacctcatttcctgtgcaaataatttaatgctcacaagggttcagattataatatgcacactcaccgatccaatctcaccaggtatcctgctaaaagggcccaaagtcagaactacatctgcaaattaacaatcattctaccaacaatgctacatgtatgagtgctagactgaaccaagtttatccatcttgagttctttacttctccaagcccaacaaattaggtgtcacccaaactagccaacgattcatatctccattactcgaaaacaatgcgcatccgaaattcatactcgatccaccaacaatgcttatgcaccattctgaatgtttggattgcagcaagagatttcgcttgagatgtctagatttctccttcacgagattgctaaagtagacaatcgagtagattcatctaaacccccaaacccccaccaaatccaaccgagcggaagcgtacaagcaagaacttaatcgaacaaaccgaccaacctggggagatcgcagcgcgacggcctccaccgccacttggagtaggacgcgtcggggcggccgttctcggagcaccggaacccgacgtccaggaaggggcagtccgtggagtggtagagcgggtagctgtcgttccacacccactccccgtagaacaggtcgcactcctcctcctcctccccctcggcgnnnnnnnnnnnnnnnnnnnnnnnnnnnnnnnnnnnnnnnnnnnnn

SEQ ID NO: 15460 - DNA, 1237 bp, Oryza sativa
actatagggcgaatttttttctcggtaccctcaagatcataaaagaaaaggaaatcgttatgagcattcactagttgtactaaaccatgtacctattggctgcagaaggcatataaagttgctctttggacattcatctaactcaagtcacgattgtattaaaaaatgataatagggtcattcctcagttcaagttgtattggaaaccttaatagtacaagtatgcccgcgaacatgaagcttactgaactcaaagtacaaaaatatggtgacaaccacagcaatggaaggagcatgaaaagagggatggaagtacatagacactatacacgaacacaacaacattgtgtacctatgtaatatccagttgggctgtcccacgttagtgtacccttcaccaaaatacagtttatactttggtttggctcactagttttggggctgtctaagtacatgaaccagtgccattaaaattaaaatgaaatcaaatgtgatcaagattgttttaaagaaaacatttgctatactcttgagatttcctattgtaatatcatactatagatcatattgtattttgctgttgactacagagagggaagtagaataatattggtgcctctagtaagttttgcttcttccataaacaagggcaaaatgactgcataaagcttgcacacataaagaaagggctagtatttatatgctcaaaagataagtgaattccattaaatcaaatatagcataggataatcaatcttaactctatagcattttctgttgctaacaccatattaagagatatagcataagaaatgtctttggtctcaaattttataatgaatttaaaaaagctaacggagcagcaaaaactcaataaacctcagagagctgtggtatttttgatagcgtcaagaattgttgtttccagtttatcctcagcaacccacatagagcttttcttgcgcaagagctccctgtgatccgccttcttctgtactttaagcttctccttctccctccagctctccagcttctcagctctttctttcatctgtacatgatctcatctcagttatacacatatatacttcgctgggtctttttattttacacaagataattgaaacaaattaaatttgcagaaaatttctaaaaacatgtagtatactacttaatcctctaataagagactcgttcagcaaactaggcaattcaacaaacaagtcgtgtgcaaggg

SEQ ID NO: 15461 - DNA, 466 bp, Oryza sativa
ccgaaaaccttggttgtcaaaccatattgctaaggtgtgtccagtaatcaacgccacaactcccaaacggtcagtggcactgacaatgccaaatagctagaagggaaattttccctcgctcctccttggtgtgcttcatgagatttcttctacagatccacctaaacacaaattatgctcagaaccataaaccaaattcttgttaaactgaaaaattcaggtagtattcaaagataaaatgctgtgcttaccttcgactgtaattagacagctgctctatgcagctctcaggtaacaagtgcaatgaaagtttgaagctcatcatcgccactcccggcaggcaccacaactccaatcggcactatctgatggctgttcaccatcctcccaaggcgagcaatgacggtgcatctgcagtccacatactgcgcatttgagatcaggtggcggctgaggattcttgcac

SEQ ID NO: 15462 - DNA, 2687 bp, Oryza sativa
ctcggtaccccgtctacggccagctcaatccttactcgttaatatctcctttctctctgttgacgtcagaaaaatgctgcaaatcagcaccctgttggattagacgaacccttgtcgtaatgtaacagacatgcacatacctagttgtttcttttcattctttcctcctctcttcaaatattttttctcctaaattacttatccaatttacgaactgatcacactgttgtattcgttgcaattaaatctttacaacaagatatcacatgattatattatgtcaaaacaaaaacatacgtttcaaaccgttaaaacaaaatgtttcatacgtaatagtgatatgtttcaatatgtgtcttaagtgtgtttcacaaaattcctgaaactatctactactactctctctccacctcatgcatgcatacatgcatgtattttagcaagcttcaaaatgatttttctcttaaattacctattcaatctatgatccgatcacaccattgtattcgttgtaattaaatttttataataagatatcgcttgattatattttgataaaagaaaaacatgtgtttcaatccgttaatacttgttgtttcatgtgtgacagcgacatgtttcaacgtgcattttcatcatgtttcataaaatatttaaatgttccagttgctaatttttttttcaccatatatataatataatgtttcacttgttggtcaactgcaacatttgaccgtccgatttttttttaatttaaaaatgtttcacctaatgtactcatgatgtttcactacgtatagatcaaatgttgtagtgaattgaaacatcctttcgctattcgctgaaacattatttttatataaggtaaaacaacgttcgataaaacattttcgatctacttagtgaaacaattacaatatactcagcgcaacagcgtgcaacatttaaaaataattcaataataagctaattattttcatcggattatattcatgtgttgtcttgttttaaagatttaattgcaacggatttaatggtgcaattggattatgatttggataaatattttaagagaaaaaatagtataaaattcgtttgatacatgcatgatggatggcttgatacatgcatgatggatggctagcacacttgtgcatcgatcggacggtcgcgcgagacgtccgatttttcgtctcgcgccatacgtccgacacgtagcgctctccgaattaagccttagactagtaactagtaaggccggcccacgcgtatgcaggttgctccacgtaaagtaggcctgcccttatgtgggtcagatggagaggcggagtttaagggttggtttggtttgaggcctatattggccttaccaatatttggcaatttcaatattatttattgtctatttggtttggagccaaattttggcatgactaagaaaataggccatttcaacggttaatttagactattttggctttaatccaaacacaattttacctttgccaaaattagctatgccaaaagttatcaaaatttgacattgacaaaaattggtaagactaatttaggccacaaaccaaaccagcactaattctctccgaccccccgagacatcctgaatccgatcgttgttcgcccgttctcggccgggtcccgggcgtcgagtccgtcgagcgtatagaaacgaagggtgcatagctggtgcgagcggggttagattttggcttttggtccgttgcatcggtaacttcctcacctcgcgtcgatccttcgagtgtacctgtgctatactttttggtttttggcctgggcattggtagtttttcagtagccattgcagcagtggcgagtggcgactatggcatgagctagaggagatcaggagaggggaactgtaccgggaagtagcctgcgatggtcgatggatagatatggagaagagaagtgacgcgtgcaagagagcggagcgaatgcatatgcctctacgactctatcgctggaggtctccttcgggggttgcagggtcctcttctttgagttacttctctgccataatcccattttccttttaaaaatgaggtcctttttctttttctttatataaaacgtcgacggcaggctaaccgctcgagaaaaataaaacatggccacaggaaagagatccagtgatatcttgtgtacgctgcggcacatccgcacatgcagtgattcaaccaaaagaaccgagtagacagtgcatgcactgatgcacatcgccagcaagatctcccctctggcctgaactcatgaactcgtaaaatgaaggtacagaagaatccacaggaacatgccagaccagtacaagccaattcagtgtgaagggctgtatgcatcagctgccaagataagaagttgtattgcagcctggaggcatcttgcacctcgtgaaccatccccatcgaaatgaaccattgctctgcagcaactggaaaaattgcaaacacttatatatactgcaaacgactagctgctatttatgtataaaaatatgtatcatccagaagagctcgctatagctatactcactactgtaaacaagatgtaaagccccataaggcagtaaccccaaaacctgggaacccgaaacctagtccaggtgaccatcaacagggtgcccatcgggtaccgaaaaaaaatcgccctat

SEQ ID NO: 15463 - DNA, 2944 bp, Oryza sativa
tgctgcaaggcagttcaggagctctccagccatggttgagatccagaagacactcattacaaaggaaattgtggtgcttgcaatgttttcagttattggggcttctttctcaaaaatgaagtgggacagggctaaagaaatgctcacgaaaagcaccacggaccagatggggaaacgactttgagggagaagaaatactattcggctatcaaatggaatgaatgaactgaaagaatacaggagtaggagaggacatagacagatgtttgcacaaacataaaatttgttccattcagtaggaagcgttgatggtattgtgagcttaagaagaaatgctacaggccactcccaaacttttgtcacctgccaggggtagatgacaatcagtgtcatgaaaatgcagatgccgagaggaaaatattcatgttttagcaaagtctaataagaaacaaggagctaaatgtcacaaaaaattggaaatgagaacttaggatttgccagaacatgccatcgatttcctcataaaaacaaagttaaacaatcagcaagtctgttaagtttaaaaatcttttgatcattaagcaattgtatatattcaatacagtagtcgatgcattcttgtcatagtagcaaagctgacattactaacttcaaccattactataaatgggaatatttatcataagctgcctaatcacatacagataaataaactcatagcgaattgatcccagcaaggcatgatgttggtgcagctaaaaggacttagcttgtttagcatgatacattattcagtacactgagtaatcctatttatatcaaatgtacattagcactcagtgtgctgagtaattgtatctatgttaaaagtacattatcctgtgcatatagtaaatcagaataggttgcatcatgaaaaaatctacttaaaattatcaaagtacacaaacacaccatgaattgcagcattgttaccagttacctttctgtcaaagtgtactactgagttatcaaagtatttaatgtttgtttctacttaatatctacaattgtatgggtattgtataaaacaactattttttcaggggaacattggctcactactaaagtttctactagccataaagtaatctgtttctcgctgttgattgcagccagtaattgcaaactaccagggtgaagttaacactcttgaacataaaccaatcagcagcttatagcactgttcacattagtactgtattttcaagtcaagtgcacttcgaaagtaactatctatactagaatcgtttgtacaaattgaaccatagaaaagcataacaaacaagttggaccattaaactaaagcttaccctaaatgagtacaatacagtcagtgagttcaaactagaagggtaagtcaacaatcttgcacagttgtcagttgcacataaacaaattgacggtttacgaccatcttcaaatgaataccaaagaaactatttatattagaatacttgtccctgactactcaatactatattaaccacagtggagacaaaacaaactaacgggagccactcattggagcattaccttactgaacatcgtgcacaaagtagggtgttgttgcttgcgatcctccactgttaccggcaagtccatcaccacgcgaccaatgccattcaccacctccagctcggtggtgctcaccgccttcccctcagcatccaaatccatgtataccactaagcccacgaagaagacgtagaagagcacgagcccgatggcctgccagaggtatatctcggcgctaaggtagatgtagaagaggccggaggcggcgaggaggtagaagaagacgtcgcgggcgaacgacgcgggcgggacagcgaacggcgcggcgatgagcgcgacggccccgacgacgaacgcggagacgaaggctccggcggagaggatcgcggcgagccccgcacgccgcatcccgccggccccgccgagcgcggcggcggaggcgaacgcatcgggggcgccgttgccgagcgcgaggagcgtgacggcggccatggacggggagaggcggaggcgggccgcgaggcgggagaccgcgggggagaagtgggtccccgcggcggcggcgaggacgcggaagtggaggaggaggaggagcgcgagcgccgggagggaggcgcggcggtccccgcccaggaggcaggcgtggatggcgccgtagtcgaggatgcccggcgggtcggcgcggacggaggcggcgcacgcggcggcggcggcgggcgccatggcccgatgcgccgcggcggcgcggtggtggtggaatggcgagctgccgagtggggagtggagggaatcgcgggggaatgtggtggggaatttggggagtgagtgagtgcgtgcgtagcgaacagacgggacgccgacgcggagagggaatggggcggtgccgaacttggtgggtcccatcgcgagggaggaaggtcgaagcgcacacgtgatggtttggcgtgagggacaatcggcctggcctggtttggcccaagagctggttttagttccatgggccagcaccgacaattttgcgtctggaataagttcactttagatccctctatttgtcggtcagtctgattttcgtcccttaaccgcaaaaccgggtacgacccatcccccaacttacgaaaattgggcaaacaagatccctcggcagtatggagggcagttttggttgacatggcgtctacgtggagcctttgactaggtctccgtcccacgtggcattgacgtagcgattacgtggcaattttatctcgaaaaaataataaaaataatgggacccatatgtcagctacacaaaaaattaataaaaaaggtgtggcccgtgtggtcccacatgtcagcctccctcttctctctatcccatacattgccaggagagaagggcgagcgg

SEQ ID NO: 15464 - DNA, 1528 bp, Oryza sativa
  unsure (1)..(1528): unsure at all n locations
ctcttgctgcaatccaaacattcagaatggtgcataagcattgttggtggatcgagtatgaatttcggatgcgcattgttttcgagtaatggagatatgaatcgttggctagtttgggtgacacctaatttgttgggcttggagaagtaaagaactcaagatggataaacttggttcagtctagcactcatacatgtagcattgttggtagaatgattgttaatttgcagatgtagttctgactttgggcccttttagcaggatacctggtgagattggatcggtgagtgtgcatattataatctgaacccttgtgagcattagattatttgcacaggaaatgaggttgacgaccaccgcacttaggaactgtgcaccgcgattggaaactcgatgccttatgctccccactgggttagaaaacaatgttatgcgcatggttaggcctccgagagataaattagttaaactagtgttgtttaattagtagtctgtctgtagctttcatggtgttgccatctttcacctttgttttgccttgatggaaatgtgacctcgtcttgtttgttgtcagagtccagtgttctatatgttcggttaagctgtctttcttacagaaaggaaaagttgtctcttctgtttcagaaaagtatagctattctcagattgggtttctgccttttgcagaagaaagaaaaaatactgattcttgttatcatcactatcggtagcttttacatgttggaaaatttgttatccttcataattgcttactgtaacacattagactgtattacatactatggtaaacatataaatattttttatgagaaaacagtggaacatctgattttaacccttttttttaaaataaaaacttttggggcacctttgatttctcaataaaacagtccataaaggaaaaaaaagaagatgattgtgaccttgtaatttcattttcttttgagcatgtaaatgatgcctcactgatgcttgtagatcaagaagtattgttatgaataattcacatatccaattaagcattactgatatcatattctgatttcaccattattttctttgatttcttagatttgatgccagaaatatgctggagaagttgagaaacaaaagagtagtatttgttggtgattcaattgggcggaaccagtgggaatctcttctttgtatgctctctgttgctgttcctgataagagctccatcttcgaagttaatgggaatcccatcacaaaacacatgggtttcttaattttcaagtttagagactacaattgcaccgtggaatattacagatctccttttatagtccttcaagggcgtgccccacctggagctcctggggttgttaaatatacaattagggtagatgccatggattggttgtctgaccggggccagtggagggatgctgatgtattgatccttaacactgggcactggtggaactnnnnnnnnnnnnnnnnnnnnnnnnnnnnnnnnnnnnnnnnnnnnnnnnnnnnnnnnnnn

SEQ ID NO: 15465 - DNA, 953 bp, Oryza sativa
  unsure (1)..(953): unsure at all n locations
gccagagaaggaggaagccggcgagcgcggcagctccactccgtcggctgcttcggccgccccgcgctccgcccgcgatgcccagcagaaaagaggatgaggcagcgggaaacattgtgtttatctgcatgataaacaacaattgtttatccttatatttcatcttgctagtgggaatttgatcctgacagtttagctttgaccatcaaatcaattgttgtttcagcaaatcgagcttggagtgcagcgacgcgccgaagtcgccgtctgacaccggttcggggtcgtccgccgccgctgcgccgcgcgggcgcttggggtcacggcggtagtcggcgtagtcgtcgacgaggcggtcgagcacgtggtgtgcctcgcggagcttcttggcgaaggcgaggatcgatgcgtccttggcgcgcgtctcacgggcaaggcgggcgcgcgcgtcctgcaggtcgagggtctcctgcagctcggcgacggcctcgaaaaactgcatctggagcgtgttgagcagcgacaacgcttcttggtgtaggagagtcgccttcttggtgtaggagatcggggccgggagtggcggcggagaggagagtggagatggggagagagaggaggaagaagaagagggggggtgagaatgacatatggggcctacgtgggtcccacctttttgaattaatttgtgtgaaagtgacgtgtgggtcccatggggtttattattatttttagatcgaattgccacgtaaccgccacgtcaatgacacgttagatgaagaccgagtcaatagcacgtaggcgccacgtcagccaaaaccaccgtccaaaccgttaagggacctaatgtgcactggttttgacatttgagggacgtgttgaatctggttttctagttnnnnnnnnnnnnnnnnnnnnnnnnnnnnnnnnnnnnnnnnnnnnnnnnnnnnnnn

SEQ ID NO: 15466 - DNA, 1373 bp, Oryza sativa
gggttatgcgaaaggtcatgtcatggctctttccgggtatgtcgtggtggcatgtcagcgcacggtaacatgtcgtggggctgtgtcttgtgggcagttgtacacctctgatcagagtaaaactattcgaatagccgtgcccgcggttatgggcggtcgaccagattcaccgtgattagtcccaccttaataaatcgactcaatgcactgtagttcaggtgttttggttgggcctgttcaacgtggtgtagcgttgatcagtggagatttaatgctactttaattactcaacagtgttactgttttgctcaataaaacgttttacaaccgccttttatgcaaatagcctcaaaccatccttgtattccccttgcacgtctgcatcgttggtgtggcttgctgagtacggtggttgtactcagccttgctattattcccccttttcagaagtgtagtgcttctgagctgaagacggagttagaagaccaaggctcagaccccagttgagttttgcctgtggagtggagctgaagccccgctaggatcgccttttttccactgttgctgcttttgtttcggtgtgaggactaagtgcctcttctgtaagtattttacgctttatttatgtttggaactgtttattacttgtcgttttgtgtaccctagctgatcctgtacagggatttaatgcacaaaatagtctgaaaatttgggctaaatttttgggcgtgacaataatgctggatcatataattatgatggtgtttcccattcaacaggtttctgacaaacaatgcacatatacattacaagagaattgtctgtgacgtcgcagatcaaaatggggacatgtgatcaacctaacaaactgggtatttcttaaatgaacccaccccaacagaagaaaagaaagaaaaacaacaactgtccggtattcctctgtctgcaatgtagggaaaaatcattaccaacggaaatcatttgtataatcaccccccccccccccaatgcatcagctatcaatgtagaccaaaagattcagcaatatgaaagttgaattagggaaaccattattaatctacctataacaggaaaagataatctttagcatatcattttgtacccacagctttttcacataagcattttaacaaacacaaattgtgcacacacctgatgaagacaaggaagcagcagtcctccacactcacactgccacaggagtaggcgtcaacggcggtggcgttgtcggcgggggattcagtgtcggcgtcggcgaggaggagtcactgcctggggtggcggcgtctgtggcaggtgggcggaaggaggaaaggcggggggggggggggacaacgtctgcgctagtcgtc

SEQ ID NO: 15467 - DNA, 703 bp, Oryza sativa
  unsure (1)..(703): unsure at all n locations
ggcgaattcgagctcggtacccccctacggtgtctccggatactgtcaggagagacgaaagcggcttcagggataagcacggctagtcccctacggtgtctccggatactgtcaggagagacgaaagcgctatctctgatctcgccgggcacggattcgaggaggaagactaccctgttgtcgatacgagttagaatttcagaccgccaagtctacaatagttagataggctaccctaaatattgtactggtgtgattatagtgaataaagagcaacaccggctccggccaataagatgtagggttattacctgataattcaggggcccgaacctgtataaaaatcatcgtctccgtctcttttacctcaatctcgcatatatcttagtaccaacgatccttgtcggtgatataggcctgggggtatcaggtttagagggaggaggctgccccccgatgccacgtggccctcccccgaggggagtcaggcccgaggtagggtggcggccactccttccccaaagactagtcggaggaggctgccccctgatgccacgtggccctcccccgaggggagtcaggcccgaagtaggacggcggccactccttcccagaaattggatggaggacgctgccctccaannnnnnnnnnnnnnnnnnnnnnnnnnnnnnnnnnnnnnnnnnnnnnnnnnnnnnnnnnnnn

SEQ ID NO: 15468 - DNA, 314 bp, Oryza sativa
atttttttcttcgccgcctctccgacgactacctgccaccgccgcctcaaccaacatcgccgatccggtctcccgttgctgtccctcggccgctgaagtctcctcggactccatctcaaccggcatcactgccgccgccgctgtccctccgctaccaaaatcgtcacgcatcgccggtctcctccgacaaactgtttcggggacctcctcctcggcttccgcttcaaccgctgccgatatggagccacgccgtcgttcctccgccgccgaaaggtatcttgaaccaaaacattcagactgaagcacctcatgtg

SEQ ID NO: 15469 - DNA, 457 bp, Oryza sativa
tccttccctctcggcttgcggccggggtttgccttgcgacttgcgatgccttgccatgccacaccgggacgatggggtctggttgttaggctggcgtgaaagggagcgggaagttatggcgacgcgattgcgttgcacgatgcatcgtcgtgcattcacggggcgtcgctgttgtgcgccatggagatggaggggagtggaaagcaatcgaaagctcccaaagccctgaagcaacctggacagcccggcctcagctttgcttgatggcggcagctgatagtgctctgataggccatactagcgtttctcctgtgccacattgactatagaacagcgtagcacgaagctatcactcgtagttctaagtatcccgatcaacactataatacatccatccttctacaatatcccgatcaacactaataccatccttatacgcttactaattactgatact

SEQ ID NO: 15470 - DNA, 527 bp, Oryza sativa
  unsure (1)..(527): unsure at all n locations
agagcaaccgtgcagtttaaaatacaagataggataagtggtttgcataccctggcaataacaccggctactcttgactctgtatctttgcgcttgagaagctcaacaaaagcatccttccttgatctctctgcttctagaatgacctgcttgaaatttttatccaagatttcctgacagataataccatcagtatttaaattgaaaaaaaggatcatcctttaattacaaaattatcaatgaacatgtcaatgtagcaggagagcacctgaggatataacactaatgattccatgtctacagaagaaccaggctggaatgttgagttaaatgcagactgtgcattttgcaaatttggtacaataatattgcagaaatggttggcatcaacaagagattcataatcattcggttgaccattatctgaaatggtgatttcataacgatcagcaggtgtttgtgcctcgtatnnnnnnnnnnnnnnnnnnnnnnnnnnnnnnnnnnnnnnnnnnnnnnnnnnnnnnnnn

SEQ ID NO: 15471 - DNA, 561 bp, Oryza sativa
  unsure (1)..(561): unsure at all n locations
nnnnnnnnnnnnnnnnnnnnnnnnnnnnnnnnnncgatcgatgacgagcaaacacagcgcgtttcgccacgctttctcccaacccccaactccatcccatgtcggcccatcgtccattcgtcctccagaccgatcacatattcagacccgtcaacttcagcatttcacgcggccactacgacagctgcttcggctgcactttcactcgtatcagcgcgaggggaagaagaacaatccgtggttttccgtttcttcagaggcatggacagatcgtctcacgactcgtacgcgaagatgcttgatgcttcccggaggatcctgtctcgaattttgattggatcactgcgcactggacactcactactacgttaatgctgctgccagggctgcagccaaaggaccacactgtcattggctccgggacaataggaggccatatatttagccattttttagggagattttcaccaattgtacagttgcactattgctacgcagatcannnnnnnnnnnnnnnnnnnnnnnnnnnnnnnnnnnnnnnnnnnnnnnnnnnnnnnnnnn

SEQ ID NO: 15472 - DNA, 496 bp, Oryza sativa
  unsure (1)..(496): unsure at all n locations
nnnnnnnnnnnnnnnnnnnnnnnnnnnnnnnnnnntgtataaaaatcatcgtctccgtctcttttacctcaatctcgcatatatcctagtaccaacgatccttgtcggtgatataggcctgggggtatcaggtttagagggaggaggctgccccccgatgccacgtggccctcccccgaggggagtcaggcccgaggtagggtggcggccactccttccccaaagactagtcggaggaggctgccccctgatgccacgtggccctcccccgaggggagtcaggcccgaagtaggacggcggccactccttcccagaaattggatggaggacgctgccctccaatgctatgtggccctccccagaggggggtcaggcccgaggtagggcggcggccactccctggccgagactagagggagaaggccgccccaggcgccacgnnnnnnnnnnnnnnnnnnnnnnnnnnnnnnnnnnnnnnnnnnnnnnnnnnnnnnn

SEQ ID NO: 15473 - DNA, 343 bp, Oryza sativa
gggctcccccgtcgtcgtggcggcggatccggccaccccccgtcgtggtagcggcggctccagcctcccccgtcatcgtggctacggatctggctacccacgtcgtcgcggcggcggatccagccacccctgtcatcgcagcggcagatccggcctcccccatcgacgcggcggtggtggcgatgcaagccctcggcggtggtggcgatggcaaccccggccggtggaggaaagaaaaagaaaaagagagaaagagagactaaggtgggggccgtaagtgcctagtgtggtgggtttatatattcgcctcaaaacttttttcgcaatggtcccctttacctag

SEQ ID NO: 15474 - DNA, 1530 bp, Oryza sativa
  unsure (1)..(1530): unsure at all n locations
agggcatatatgagtataaatacaagccccccaggagaagaggggtcacgccacaacgcttcaaagccacaagccaacacacgtcgccagatatcaacatcagatataagtctagacataccccatccgactcctacggaggctggcaagagggatctagcaccatctctgatctcgccgagtacggattcgaggaggaagactaccctgttgtcgactacgggttggttatctagccgcctagtcgacgacggctagatgagttatcccaattattgtacttgtgtgattcagatgaataaaggagcaacaccagctgcggccaacaggatgtagggctattacctgtcagataaggggcccaaacctgtataaaaatccctgtctccatctcttttacctcaatctggcatataccctggtaccaccgatccccataccatctaaataacgtagtcgcaatatcaaacgttaacagtggcgtgctaggtagggggattttggtgcttcaaggttttgacgagatgggttcgagggatggattctccgacaacaaaatactcgatgacttcggctatagaaagatctaacccgaccggagtatgtccccgcnagagatcaatgactttaccagnaagcctccgttcgagtcgactgcccgggaagtgacatcgtcaattaattttgattctgttgggacctggattatcctcacccctaacacatagtgagaacgtccatcccgacaagtcgtggcgaggagaccgaatacatcattattcaagaccatcacgtactatttgctcctgacatgtgcacctacatatgcatggactcaatacatgcctaggtgtgcattgatttgacgacatgtacatgcacagaagacaattcagatcggctaccaaggctaattaaggtaattagtagattaattaaattgatctactaattccgtagatatattcggcatgtatctacaaaggtacgcaatattttatatacaatttatcgtacctattttccgatctatacaatattgttagataaataatttattatgtttacctagagcatgttttctatacaatatttattgtgcaagtgtttccggtgttaggccgactacggtttaatgctgggggctcgctctattttcttctgtataaatcatgtttgtttatggtttacataatgtccgatatttaatctgttcattatatcctgataatactagaagatccatgcagtcttttgagtatatactcgatattctctgctatacatcttgtcttctagaaaatatttttcaggaacgattgagcactcgagtaggatgtggtcgagtacaccgcattatcgagaacattctcgaaaaatgttgagttgtcgcacccaacctaccaacgaatattgacaacttatctcatgtatagcatcggctacagctagactatttgagaaaatgttgttaatggataattcctcgcgaacattgtcggcttgatcacccgacatgattgcgaatag

SEQ ID NO: 15475 - DNA, 1799 bp, Oryza sativa
  unsure (1)..(1799): unsure at all n locations
gaggtcccaagctcaggggccagatcaggcccccacgccttcttgtccgcctcacgggacaggactagggttcatgaaatacggttagattccaaaaaaaaaaaaaccaatgttcggacgttgctcaaatgttgttgctgtctagaaattcgataagtttcatcctaattaaaatttcaatagataaataataaaaaatcctataaatagtatgatattggtaggacctattgggatataacttttttttaaaaaaaatatgaattccacgcattttcataggacatgagaggagagggaggggcgagtaggacggaggaggaagacacggccgtctccgccgtcacgctggggaggcacagcccccagtcccccatcgtgccagtgaccgctgctgcgccggtgagacacggccccgctgtgccgttggccgccgccgccatgtcaaggtctcgaggagctgctgacccgctgctgcgctggggagatatgcctaaggctggcagtggcgtgcgtgggctgatgcagctgctgggcaggcccgcaccacttacccacttaggcctaaccacttaggagtaagtgggctgatgcggcaagcccaccacgtccggcggcgccaccacaacccacatcgagggagcatcagaaagaggaggggaacgaacaagttcgtcgctgttgcggcttgaaccctagccgctgccgccatggatttgatgacgccttcaccgncttnctcttcgncgnctttgctgccatctccaccttcgccgncatttctagtgatcttgcagactttcttcagcaccgncgcttccaatgcgtcctccaagggaccttcgtggtcatcgccggtcatgggctcatggcggcgcactcatcgtagctcatcgcacccactccacctgttttgtcaatttctgtgggtggtgctagaccagcttctgcttcaatcctgtcgacctctatgcatgtgagttcttgaattttttttccctgatgtggatcaagtgaaagggagatgcagatgcagtgaatctgagtaggatgaatccagaaagcaaggatgtaattttcagattcaaaccatatttaattttgtaaggatgtacgcatcacttcactaaaaaaagaagattatttagctcctgcttgtttgtgattagttgctttcgtgcataacaatgtgcagttttgatggcttgcctttacataacatgcttgatggtcacctgggatgtaaatatgtgatatgcctgtttgagaaacatcattgaatcttgtacattaatcttatatctttctgactttgttttgagttatatgaatagactgttctatttgctgttcgattcctgttcagcattattatgtataaactcgttacttacacactgcttttttttcacacatgaaaacaagttaaaaaaataatttacatgtaactgcttcttctttttttttttgactgtgtaactactttcggcgctcactttgaacacacaagattagccttggataactaagtttcagcactaaaataattatctgttttgttcatgagttttagagccccctagattttaagctatgtcaattatataatgcagtcgcttggctgtcaaattcctttttatgacaaaagacagtttggagatgtgcatatgactgtgtgcttacattttgcttagacgggagcgcacctttactgacagacagatggtgatgtattcacacctttactgacagacagatggtggtgtatttctttctttgcgttaagtggattatatttt

SEQ ID NO: 15476 - DNA, 680 bp, Oryza sativa
atagcatagatctaattaattactatataatttctcatcagatcgtccgacctggtggcatggagaggccaacggacgctttcaaggagacgcacaacctggtggtggcagttgaggacacctacgtcggtggactcgtttccaaccttcaggtggcggagctcatcgcgtgcatcgccagcaacaggagaacggcctactgcaaggtggtcgaagcgatcgcagagaccaccgcgccattgctgcccacggaggatcagctcgccaacataccttcaaagcgggtatacccatgcctattattagcatttaatttctccatttcatattataatttgatatttttcacagtcaatattttttattttaagctcaatcaactttattagaaaaatatagcaacattttcgataaaaaatcatatattatcggaatataatttaatgttagtttcgacgaaactagggctgcattttttcgcttagatttgagagagatttttcaatgcacgcaaaacgagaaagattattagtatatgattaattaagtaaataattataaacttgaaaaatagatttatttaatttttttaaacaacttttgtatataatttttttttgcaaaaaaacaccattgaacagtttgaaaaatgtgctaacaaaaaaaataagcaagttaaa

SEQ ID NO: 15477 - DNA, 379 bp, Oryza sativa
cgtgtccgtcggctccccgaagctggaccaggcgccgtggtcgaggctccccgagtcgttcagagacaaaggggcactcgtggagttgaagttgcgggaccaaagggtggtgctgttgccgttgtcgctccacgacagcttccccgccgcgtcgatggagagcacggaattggcgtcgccctccacggcggagtggtcgtcgttgtgggcgtaccatatgacgaccggcctggactcgttggcgttggcgctcacccagacggcgaaccagaacttggctgggaggagggggagggccggaatccggcggcgaagtccccgttgttggagacgagggtgcggttgctctcgccgggcttcaaattggtgtcgttggcgg

SEQ ID NO: 15478 - DNA, 325 bp, Oryza sativa
catcgacgacatcatcgaccctcgcatcgtccaggccgaggcctacgacgacgaccccgccagcctcgccaccgtcgagcgcatggtcaagacggccatgtggtgccttcaggaccgcgccgacatgaggccctccatgggcaaggtcgccaagatgctcgagggcaccgtcgagatcaccgagcccgtcaagcccaccatcttctgcgtccaggacgactgatctctcctaggagtactccacttcttgccacgagagacacacaaattatctttcttatttattatactagtactagttcaaatcagatcagagcagagcact

SEQ ID NO: 15479 - DNA, 1292 bp, Oryza sativa
ccaaccaagattaatttctattggtcaactacatgcaatatttaaaacttgatgtaatccatgggatacgaaacaacgtagtacaacatctccaacagcctctcccattgactctccaagttaaattttggctattctacccaaaaaacatgctccaacagcctctccaactcactggccgccaaaccctcctcctcactggctaaatttggctggccaatggtgggccccacactgacagtctcctccataccccccctctctctctctcgcatccgtctctttcccacccctcgagcacaggcaaccaggcgaggagcacggggaggagcactgctatggcaggtgaagacggtgcccgccccgccgctcgccgcagcctgccatagcatcatcctctggccgccctgccgccgcagccgccggcctccgctcgctacagcccgccgcctccgctcaccgcagccgttaccccgcctccgcccgccccgccactcgctgcaacctgtcacctcgcagcctgacgacggtgtcgaggtgggagaagggagacaaggcggcgtgaagggagtggtggcgctagcgagataggaaatgaggcggcagtggggcccgcttcccctttcggcgtcgccgtagtcttcgtcatccctcgccgtcgccgtcgactcgcatgtgcacggatttgccggccgctgcttctcccctttcatcgtcgtcgtctacttgctgcacgagcccacctcgcgcacacggatttctcccacccctttcccccttgcccgctccgatgctttgcctcgcgtgcgcacagttccaccttcggcgtcgccgaaaaggcgctcggtgatacctgcggaagaaaaagaaagtagggagagaataaagaaaagcaagcgactgacatgtggggacccactgtgatagacttaaaatagagtgggtagatggagaggctgttggagcgagtaagtagtttgactagccaaataagatggagagttggctatatgggtgtttggagagtccgatttggagaggctattggagatgctcttataactgatgagaattaattacagaatgataaaggtttagttgtccatgatctttgtgttctttgcttatgtgatgtttaaaatgggatggatggagtatttatggttaagacttactcactcttgcccaaattgatcatcatatattgaaaaccaaattttctcaatttgatcatcatataactgcatggacaaggatttcatcggagtacaattaaattaatacagcatggg

SEQ ID NO: 15480 - DNA, 739 bp, Oryza sativa
  unsure (1)..(739): unsure at all n locations
cccttactgagaggtttgggaaactgagaagcaataggtaatggggggtgaggcatcccacagcgcaacataaagtggactcttgtgctctgaataagaagtaaatcgctagcacagtcaatggcaagcactgttcctattacatactccctcgcaatctgattgttatgctggagctcattcaggtacgcttgctacatatggtcacagataatatgaggttgatacagaatattaatatcgtctacatctattggctgctcggcattgaacactgggcctagtgcatgtgcacatgtcaacacatgaatatgcaagggatcctgtagtaatggttctatcacgaaaccagggcaatgcacggggactaggcagtccgccaccctctgagcaagctgatcatccgcttctggatcatcaggaataggaaacaaatgattctgccagtctaaaagaagattaggttctggtcggagctccacacaaacgatagagctgacacagttgcggtatacccatctctctaatgcattggagaaattgtctggtggtgccatctattgaaatagtatacagataattaaaccttaatcagacaaaccagagaactatgaacataagcaattcagccatgtggcgcattgaaatttacagttacaagtctgactaggtagaagcaattccagcacagcatattnnnnnnnnnnnnnnnnnnnnnnnnnnnnnnnnnnnnnnnnnn

SEQ ID NO: 15481 - DNA, 1304 bp, Oryza sativa
  unsure (1)..(1304): unsure at all n locations
aatatctccatcctggaattttctcttacacatatatgcaccatcgtcaaagaggattgccagaaacccaccttgcaagcatagcaaggcattgctttggcatgtattctggagcagtatgtccaccaccctacacaaattaacaccaaaatactctttttagttactgagggcctgttcactttgatgccattttcaaccatattatttttttaaagttataaaaaaaatatctacgtttagtttgttgccaaatttggtcaatacataagaaattctgccaaaattttgacaatattgccatcttaccagaattttagtattgccaaaacttgataatatttattttggctacaatctaaacagaccctagatcatgcgtaccaagatattaatgtgttgcatcccttgaaggaagctaaaacgctggcacataccttgacagttgcgaatgtgaggttattggagtatgaccttatatatctgcacataagacagacggataatatatctggtcagagacagacacagtactcgcacacgtactcaattaatttgatggtatcgatgaatactgtgtgtcctcaccctgcaacttgtccatccacaaaccatggtctccactcatccacgacagagaaattcagagatctaatccaggcttgcgtgccgatgaaagggataatcatgtcatgatcaccactgtaaattaggcttctgtagcctctagttgtcaaatccagatggtatcttactgaacttttgatgtcataagtgtacagaatggcgtagatgcatctttgccacgaaggaactgttccctgcattgcagaatgaatacagnggatcattgcattgtgttgtgttatgctgtgtgacagaatgatcgaacctgcatgcaaattactgttcaattgaatgatgatgaacagatgtgtatatacctggtgaattccaagggcctctcttactgtatcattgttggcccatattctggacattgtatattctgccgtctgcatgacatgaagaaataccaaatggtaagatttggtcggctaaccaatactacccactaacatatactctcacagtcccatattataagatattttgagtgtatattatgggacggaggatatattttaattagataggatatattagtacaaggctgttcaaattttttgggaccggaggggtagcttgtactccaagaagatttgataaagaaaataattagggtccactgactctgcattctgaagaaatctcagacaagtgaaagtcttggagttggagta

SEQ ID NO: 15482 - DNA, 1505 bp, Oryza sativa
ccgggctgctctccgagcggatgaagtagtaaagaggcgcacgccggcgatgcggtccacctccacgtacccggtctccagctcgaaggggagcgccccatcgaacccggggagatgcctcaccactctcctgctgctgctgctgctgctattgcttctctctctcgcagacaggcagctgcaggtgaccaggagaagaagaagcagcagcagccgccgccgtgttaccgccgcctccgtacatagatgcatcgagaagtagatagcttcacctatttcttgtccttgtccttcatccctcacgtttttgtttgtgagatgatcgatcccttcattttggagagcgaatatgattgattgcctagctagcttacctgtctgtcctcttcgctcagcagtacaatatctagtaatcttctattcttctttttccatgctgctcctgcctccttaattacttgtcttccacttgctaattattgttgcatcgttgacccaaatcagattgatatggcggcttgtttggtaacttgatgaaaagggattggaagtttatcgaggaaattgatatgagattaagataggattcgatttttaattccaatacattgtttggtagaggtgatgaaaattgatagggagtttagttagagattatatcattaataaaaacgcatggctgagatttgcttagataaaatagaggaggaattccctcccaattacctgcccctacccaggtattaaaaagtagggagttccttcctcaattcctcatccccatcccaccaaagttcccatatctcccaaccaaacaaaacacttaatagtctcatccctctaaactcccaatcccttctaaaaactccctccaactaaacaggccgtgggtagatggatgggatgtgtacgatcacgagggcattattatttttttgggttttgctatttaactttttatcaattttttaaggtacaaaattaataaaaattctgaatctcagaaatttatttgtcttttcctcccttgcatgtttctaaaagaaacgagaaaaagagtatatatccttgacttggtgggagtgggaacgtgacgtagcatcgttcgatgccactaattaattaagcttgcccagcacagtagacgccgcagcccgcactcttataattaaaggtctgttcagacagtcaaaataaacctcattaaatttggataaaaccaaaattttagtaagtcagtaatattaccaaaattttgacaggattttttttatatatttaccaaatttagcaacaaactaaacgcagacattttttataacttttcaggaaaaatggtcaaagtagcatgttgaagaccgtatcgaagtctaaaaatatttatttaactcttttttaaaaaaatcatttaaacaatatagcgtataatatattgatttatatttttcatatagcagataatatatttttttgaaaccgagcagataatatttttccttgtcata

SEQ ID NO: 15483 - DNA, 677 bp, Oryza sativa
gtagtttatcaataatgcacccggccacaattttatcgagtaagacacacttaaggagttcgagttccttagccatggcatgtatttcatgagcctgctcaagtacaaaacgtttgtcaaccatcctgtagtcatgaaactgctccatgacgtacagatcattgctagcatcagtagcaccgaatttggcagtgcatcccacaactccttagcgtcagtcatgtgcatatacacctcgactagacgatcgataagaacgctacgaatccatcccacaaagagagtagtggtcttctcgaattctttctgcttttcagcaatgagaactccttcaggtttgccattattaatctagaagcatttcatagccatcaaccacagagtaaccctgatcttccatctcttgaagtgcacaccgatgaatttatccggccttagagcatgggaaaaactagtcatagtaaaaccacaatgcctataataaggtttttggattgttgaaaatattagcacataattatttcatttattccataaataaatcatgacattgcaaatgacataatcacatcatacgatctacacatgtaaactagacagtaaagtatgaacagattgaatatgcggaatatgtcgaatgcataccgagggttttggaaaactggctgctcagcagg

SEQ ID NO: 15484 - DNA, 1279 bp, Oryza sativa
  unsure (1)..(1279): unsure at all n locations
nnnnnnnnnnnnnnnnnnnnnnnnnnnnnnnnnnnnnnnnnnnnnnnnnnnnnnnnnnnnnncatgattctcaatggtttcaatggtgaacctacggaggcgaaaggtatctttttgatggagcttaccgtgtgaaacaagacgttgccaaccgctttcttcatcgtcgatgtgcaaggtaactacaatgttattttgggtcattgttggatccatgccaattgttgtgtgccttctaccttgcatcaatgtttaattcgatgggacggtgatgatattgaaattgttcaagcggatatgtcggccaaagttgcaatggccaatgcgacattagagtggcgtcatgggaatattcaatgcttatcggggatggatctttctagctatgattttattagtattttcgatggcaaatttgtacctatctctgtaaagccagctagtgtagcacggtgtcaggtcctgaaactaatgattcggaaaccgacatgtttaaactgtatcaagccctggattagtaaattggtacatgttcaacaatctggatcttcattgcatacgtttgaataagactccaaaggatatattattacaaaatatatgggtatttaaaaacttgtggctaactaatacagcaaaagctatagaatgacttaactctaatgtttggctatagacctaaaccatctatctaatctagacttgagaattaagttagaatgaaactaacttatgtgattgaactcccagctttggcaagaactccaaaatgactctgaaaaaggtggggttgaagcaagggtgagtacaacgtactcagcaagctattatattcaatatgaatgtatgaaatagtagcatttaagtagggctagatttaattgcagaaagcagaggatgtagaagaagaaagcctgtaatgactttaatgcaacagtatttagtaaaatcttgaattaggtttctaatcaaataccatatgagtcccggtactcaattccgtgagcacgactattcgaatagtttcatgaatattctactgcagtagatgtacgctttacccgcagtccacgacttgccaattcattaggttagtcatggcctattattaggttattaacaattgtggcacttggtccatgaactctagtccccatgcgctctgaacgtaacgttatcagcagcgagaggagttctggcgttcccggggtctttagagagaactgatcgtatgacaccatgtcatcgcaatcagggttcacaaacagactagtcatca

SEQ ID NO: 15485 - DNA, 1139 bp, Oryza sativa
  unsure (1)..(1139): unsure at all n locations
aataacttgccttgctccaatgcaaataaatccgtgataggcaacctgattatccgatcctcgaaataatacaggttgccatccaaaataaaatagactctactaagaaagacgaagaaccaaattcaataaaaatcatgaaatagcaagaaaacaataaagagcgagaaaggctgggtttgggggtgtaaatatctcctttttattgggtatagggattattgggctaatattttgtgtggaggttctcgagggttggaggctaaggtagagaagggatcaagcaactaatgtcgctatatttcatgtgtgggttttggtgccttggagaataaaggatataactggttaagtgagtatgtggctagtattggctggtggtagggttaggtagtataatatctagggttgggtatagttaagttgattatggaataggatagcgtatcaactaggctctatagtttatgtataggtctctgtaggcagagagtatgctcgatgggtgggtatggaatttggatgatgactggaatttaattaggaaggcatcggctagggtttggttgtttgctagtcattgctagagtcgggcagtataacagctagatttggtatcttttctagccggtgtcaacaaaaaggataacgactagaggaataggagatttgtgtaggtttagtggggtggaagtgttactccgacaaccgtgagtggcggcggagcggctaggatcacacagagccagagagctaactgtgcggcgtgctgtggaggtcgaggggatagtgaagctccgatcattatacgcatcaaggcgtagggtgctaggagcagcacttcgaccttgggtttgagttttgccgggctttacagccaatggttcgacgtcggggcctaggtgaccgcaaacgtctccatgaaaggcgtaaagtttcaaccagcggctttttagtggctaaagggtattttggattaaaaggaaatatttgaaaaggcaattataaattcaaacggtatttgaataaattcaaataaaattataaaatagcaaatttggtatcaaaatatagggtttgaatttagatgaatttaggtccaagtttnnnnnnnnnnnnnnnnnnnnnnnnnnnnnnnn

SEQ ID NO: 15486 - DNA, 514 bp, Oryza sativa
  unsure (1)..(514): unsure at all n locations
nnnnnnnnnnnnnnnnnnnnnnnnnnnnnnnnnnnnnnnnnnnnnnnnnnnnnnnnnntggcaaaagattgctgatgttgctgtagcaccacggttgctctggagtattggatcttgtttatagacttgcttggaactcattcggattacctgtttggaaactcgagatgcatcagtctctaccttggatatgctcgttcaaggttcgaggttatttcgaggttatgtcttgatcaaacatgaggtacgtcgtctggtctctgctacaaattaaaacatatgctataaatatttatggctaggaactattgttctactaataacaaagcaaatatttacttgcaccgtctcaagaaaaaaacaattcccgactagtacgaactaagacataactatatccaaattcacacctacgaagtagttccttatagaatggtgggttctatgttatacaattgaagttaccaaataattggtaccgacaagttgacctcaatacaaacaagccatcaat

SEQ ID NO: 15487 - DNA, 790 bp, Oryza sativa
  unsure (1)..(790): unsure at all n locations
atcgtatgatgcgacagcttgtgtagtttcctttaggaggatcaattttgcaacaagtgaatggcatttattctttcgccacgtatatgcgcatgacatgtggtccctggacctgattgtcatgtactcgggccggggccacaaataagcaaatgcgactcaactatataaagggtacaagagcacattttcttttcgaaaatggcacgatacgtaatgtagaatgatttcctgaaaccaaaggaaggtatttgtgccaacactcaattgccctgagtatttagggcagtcctagtggtggtggagctagaaaatttttcatggttatttatgtagatttggatggatttatatgaaaatttaagagtctaaggatgaatgcgaaaaggctatggagtcagctcacacatggcagcgccaccaatacatatattactaatcaaatgtgctaatttaatatcacatctcttacatcatgttttcgatactccaggtctcatgccaaacataattccatcatttttttctcatttagtatggagccttcgatgtgcatactccatgtagttgggttcccaaacggggaaaaattctccacgcgtgcatcacttctctttgccatggtgctcacttgtcatattgtgttttgtgacacgctgaggtgctgataaaccttcttttgtgacgctgaattatcatacaaaaaaccattcatttcattttacgcgatgcgagagttnnnnnnnnnnnnnnnnnnnnnnnnnnnnnnnnnnnnnnnnnnnnnnnnnnn

SEQ ID NO: 15488 - DNA, 746 bp, Oryza sativa
  unsure (1)..(746): unsure at all n locations
aagtaagtaagaattgtggttgccactcggcactcgccaccatgctcctcgtcggcgtcctcctgctgctcttcttcaacctacatctccccacggccgccattgacaccctcacgctaggccagtctctgctgtggaaccagacgctggtctccaatggcggcaacttcgagctcggcctcttctcgccgggaaagtccaacaagcactaccttggcatctggtacaagaagatctccaagaagacggttgtttgggttgccaaccgtgagcgcccgattcttgagccgtcgagctgccacctcgagctgagcgtccacggcgatctgcggctgttctcgacggcgccgtcgaacaccttgctgtggtcgtcgaacgcgtccgcgtcttcctcgccgtcgcccccgcgcaccaccgtcgccacgctccaggacgacggcaacctcgtggtgaacagcaacgcgacgcggtcgcggtcgcgatcgccgtcgtcgactacgacgacgcacgtggcgtggcagagctttgatcacccgaccgacacatggctccccggagccaggctcggctacgacaggggccgcggcgtccacagcttcctcacgtcgtggacggactccgagaacccggcgcccggcgcgttctccatggtgatcgacgcgcgcgggctggccaagttcgannnnnnnnnnnnnnnnnnnnnnnnnnnnnnnnnnnnnnnnnnnnnnnnnnnnnnnnnnnnnnnn

SEQ ID NO: 15489 - DNA, 1033 bp, Oryza sativa
gtagctttcatcccacgggcctccaacttaaatacaacatctttcaatggcttggtgttgttcataaatgcaataactgtctgagcttccagagcatggatacatctcctcaaagtgtcaactttgtgttgagccttggatatacaatagtaatgttccaaagatggtggtaagctgttaactgcagcttgattcactgaatttgatggagagttggggttggcatctgtctgggacagcacaggtcttggaacagtaattgaatcaagtggaacaacactcatagctctaacaaggactggatcgtgaccccaactcctggctgctcgtataactgaaaacggtattgttgcagaaaccaagatagtctggcgctcagaccgccttgcaagagggccaagaatatctctagatgaagtaccagatttccttcctacatgttcaagtattctatgcatatcttcacgataattgaaagacaaaagctggtcaacctcatccagtacaagaaagcggcaaccatgggtgtgtagcttgccccctgctgaaatttcagaaatacgaccaggtgttcccacaacaataagtggcttgttctttttcaatgcttcttcctgcctcgaacgattagccccaccaacaagttgttggacaagcctcttatcattagggcccaaaatcttctccacttctcgcactatctgcattcctaattctctggaaggagcaacaataactgcctctacacctgatctcttatcagaaccatcttgttctgtaggcctctttagggggcctatttcagaaagaatagggagaaggtaagcgagtgtcttccctgagcccgtatatgactggataactgcatcatgcttttgtgaaatgataggaatagcagcagactggacctcagttggagtacttagaccttccttgttcaaccgatctataagcaaaggcggcaaaccaagctcttcaaatgattttgcagagaaaagagattcatctatcttcagagtcttcttcactactg

SEQ ID NO: 15490 - DNA, 8239 bp, Oryza sativa
  unsure (1)..(8239): unsure at all n locations
nnnnnnnnnnnnnnnnnnnnnnnnnnnnnnnnnnnnnnnnnnnnnctgtaggcctctttagggggcctatttcagaaagaatagggagaaggtaagcgagtgtcttccctgagcccgtatatgactggataactgcatcatgcttttgtgaaatgataggaatagcagcagactggacctcagttggagtacttagaccttccttgttcaaccgatctataagcaaaggcggcaaaccaagctcttcaaatgattttgcagagaaaagagattcatctatcttcagagtcttcttcactactgctgatttcggtaaggtgctctttgctggtttggaattaaatgaagaaacttttggtttcaccttaagagcagaagcccttgaagacggctttggacctccaatgcgtgttgctttttctttcttaccatattcaactttgttttgcccttcaagactagctagagttagtgaagcactcttatcttgtactgtttcagtaccaagccaagcggtctggtgaaatctaaccgctcgtggtaatgaaagcattctcaatgggaggttgtcaccgaggacgaagcatgatcgcgaagatgccaatgcaagcacatgtcgatgcacttggccaacagttagcctcatctgctgctctgcttatgaaaaccaattttacagcagccgaaatgtccttactcccaactgatctcgcaaattcaccgggggtgctcttggctgtgcaaagaaccaaacaattgaatcatgtaaactgcagcattcacaacttgcaatagtaaaacaaagttagacgcaagaagtctgtggagtatcggtggcatcaatcgtgttaaactcggttgaacccccaaattttcttgggaacaaactaaattgttattcgtgctaaggttaaagcaaaaaggtaaagagaaaggcaacctacagatctagaagagaagctagggccaacgcaaatcggaggggaaaaaaagtgtgggttagtgagagatgagaaaaaaggatgcgcgtaacgggtggggtgctcaccaacgggcgaggatgcggcggaagcagcagacgccggcgccgctgcccactggagatcgacgcaggcgaggcggccggcgaactcgcgagaagggaggagacacgcgggtttagggcttagttagcctgaagccggcgactggctggcgttcgtctatccggttgagtggggagggggctcgtgtggtcagggtgtcagagacacgaggtaggagtgatgggccggcccatcaactgtggcgccggccgcaggttgtgaaagcgggccacacgggccacggcgccgccggacatgggggagaagactgtttaaatgaagacaaaccaaggataaagttgattatcaaatataattaagactaaattacaactgcgcattttcttacatccatggcatcatccattttctacctcaaatccgaaaatgtaacatgcccacaaccaaccccaatatcaacatgttttgtacatgaaaagtgacaaaatatagaaaatacttttgagatgttattgatattaaaacaaaagaatactccctctgtactcgtaaaggaagtcgttttgaacaatgatacggtcttcaaaacacaactttgacttgttatttctataaaaatatttattgaaaagtgatatatgtacacttttatgaaagtatttttcaagacaaatctattcatataatttttacattttcaaactcaataacttgagagttattcatgatttatattcctaaagtttgacttaaacattgtcctaaacaacttattttacgagtacggagggagtataccaatagatggatcagtcttggatgagctgcctccaaattttaccttacagttactaggaaactgcaacccaacttgctcacactctgccttatagcatagataatagtgagctataaattaattataaacttacgtggatgagagaggtagcaagaaaaaaaatgaagggtgttactcttgtgcaagaactagctcaatacgtgctccaagacaaatacaataaatgcataagtgagataaaagagagaggacaacaaaaattgaaggaaccttatagctaatctattatatatgttgtctttaaagtatgataatagctgatagtgagctctaatattaaatttgctcttaagacgtgaggatatgaatggaatccaggtgcttaatagccttacaatatccagtcacatattggactcctgcaaccatgagcctaatataactagtgatctttagaaatatcttagctcggattgaaatccatttacatccatgccctgatatgttacacctataatttggtcatagtacgccacaccaatttgcagttagacaacaaacttctcagtgaggcatcggttatcttcaagcaccaatccattcttaggctatttaggctactacaacagcaagagccaatgtttctatggactctagtcactctacactaacatcaacatttgccaatgacgagagtctctaggttatgggaaaagttagccagtggatagacttatcaccttactctgttataatccagcggttttaatgaaaccaataacgctgaaaagatctcaacgtattttacctggtcgtcatcgctaatccacatttttttatccatattaacatcgagccattgcaatcttcatgcctccaaaccacgacactattcactatcatcgagtcgctgcatttgagactagtctttgtcctttatcatgtcaaacttgatcatggcctcctaaccttctattttctttgccatcacaccaaagtcattatagttagcttactagatccatgtgtcatgtggtgccatgcagaccaccacacacctacactaacatcgctaagttattactataatagtcttcttcatcactttgatcgatcgtaaggacgattcctaaactgccagtgctatatactattcatagtgtttatatcctctacatcacctatgatttatattagacataactctctcaatacacatcaataatttaatgggctaatttaatgtaatttatttctcacaaggtttagatgtaatccatatatttttcatctttccttgttaactcatatgacaaaaaaatccccacattctatatgaaaatactcattccatttcaatttacttgccgttcttgtatttatctatttttccataataatcatctttttacaatttatagagatgtgttttcttccctactatttttaaatatagttatattaatgctattatctgttacaattaattgtactacttattttgaaaaaacaagatataattaataatggtaataaaattatagttcattaatattttttcgtatacaatgtaataaaacaacgacgacgacaagtaattcgaaacggagagagtacataggtgcagccagcaagggcttaatgagcaccaccacccaacccagccaaaatggccaacgagtccatcctcgtcctcctccacctccgcctacagaaccctgaccggggtcttccccaaaaccctcgccgagtcgccgggctccgccgccgtccccatcgcgaactactcgcaggctactcctccggccatgaggggctcggatccggaccggggcggaggcgagccggacatctccaagctcttctgccactacaacgccctctacttccacgactccctcggcacctgcgccgtctcctgggccaccgacgaggatccactccccaatcggtaaagcgtcgccactccgaattctcgccgttctcggtgttatatgggggggggggggggtccggtttactgaatactgcggatttaggtcttgtgtggatgttgagttgtgtgcggtggttgcaagattgctccgttcatgtcctgccactaagcatgcgtatcttagtagattcagtgcagtatgatggctttatagggggaacagcacacgagaacaatcctgttctgtaggggttctgattcggacattcggtatatgttggttcaccccgcatcaaatccactcattcatccaccagtggatcaatgccaaaaggaagtgcttaacccatatatcccttgttcgttagaactagaacatcaatcccctaaaaatgaattagggcatcaaaggggattatccatattcgggtattttgatctaaacgttcagccagaacataggtgatccatattattctacacgattatgccttgtcattatctgcagttctatctgttaacctctaaatctttgcgtcgttctcttgttcattgaccgtaaaaactacactctttgagagtatggatcaatgcctaggtctaaaccatgaaaaagtggaaagatttaatgtatgcttttggcatgctttctagaaagaaatgggaaaatagtgtaaaaacatttacttttgggaaggagtgaacaaatttatctagacagtagaatgaaaaagtcgcttgaactcttagactgattacatagacatctctgctccagttgttttgaacttcgaagacactggtatcatatctatgggcctattcattctgttcattttgttgccacgttctaccattgctattctaccaaaattggtagttctgaaagtttcccattcccactcataatgacacaaccaaaatttggaaagaaatctaacaaaacacatccaagtatccaacgctaccaaaacttgccacttcctaccctgccaaattttggtaaggttgtttttggcaccaaagtgaacaagccctatatacttcccaaatatgtttgatttgcaaatctattggtgaatgtgcatagcattttgaatggaacacagtgactgatgtattgctatgcacaattatgaagtatgtcagccacatttatggcactgtcatgtgcatatttttctagcaagcatgttcaacaagattcgtgagttgtctgtcatagtgtcatttagctcataatcgtcaactataattgactggaaatgatgctgaccatccgacccttccatattttcatcttaacactatctttttcacataaactctgtactattggataactttgtgagttattgcctataattgttttcttctatagttattctctgaaataagaaactttcatcaaagaccatagtacctgctattaccagtatgattgttttgaaactttccatttttaatcattttgatgcagtgaagtaggtggctgtgaatattatcctggtggtggtggctgtattatacttctttccagatccttgtatgaacaccacacagatttggatttaaagaatgcgctgcttcatgaaatgattcatgcttatatgtgcatcaaagatagtaatgataaccataggtactttttagtaccatgactggcctcttcttgtattacacctgaatttctgtctacttttttttttctcgttttgactaatttaaaaactgtgatcaagcagtgaccatgggccaaaattccagaaactgatgaatacaatcaatttaaactctgtagccgatcctcatgtaagttgaattcaggtgtcaattttcaatcagcatgtgcttaaatatttcttattatcgtaacgatatttttaattatatccagcgtcctcttggtggctacagcataactgtgttccatgagatcagaaagaaattttatatacacaaagtaagaacctgatctttaaaagtaaatcttattttctaatttcagattggcagctaacaatctctgtagtgtgaaagctgtggagatttgatcaagtcaaccaaaatcaaaggaccatcacaggatgactgcattgaggcaatgggtgctaatgacttgtgtgacagtttaatttgtcactggcattggtattagctatatatttctttgcattttttttgttccatgcatgccttattggtatatctctaaaggtgtgttcggaatccccagttcccaactcatccatctcgttttccgtgcgcacgcttttcaaactgtaaacagtgcgttttttacaaaaagtttctatacgaaagttgctttaaaaaatcatattgatccattttttaaaaaaagattagctaatacttaattaatcatgcgctaatgaaccgctccgttttccgtgcggaggggataggttcccatcctccattactgaacacagcctaagagtgcacataaatattcatagaaatataagctagatgtacattttaaagctaactgtgtaatttccaaaatgtgtaatttattactctctgccttgttagtgtatccttgcaatgtgggaggtaggatgtaaacctcagtttgtgatgaacaaataaatcaactattattattgttaaatttgacaaagagagatgttaaactaagaaggtaatgatgggtgtctgcttcaatatctaacattttctttgtgttgtcctgtcactttggcaattgcataatctaaaaagtggtaaatgatctgacataaatttttctttattggaggtgaaatcgacatgtccagcagccaaacaagattagtaatacctgaacaactatcatgctctttctcctccttggggtcctgggatgcaacttactctaaatttagtgtcattgagttcatggatggagtcatgatttggctttctgtattaatatatatataggcacaagaagcggtgcactggtagctatcacagagttcaaggatcatcatcaggttgtgtagagggttcaaaaggtaacatttggcttaaaaaggaggttccagttatgataacattttaagaccataaaacagtctattttgttgaaatgccttgagatgactctttactgcagatatacattttaaactcttagtatgcctactcatacaaattgatgatactgctaatttttgttggtagctttatctgtagaagcacctgattgcaaagttgaagaatcagcccctggaagttggcacaatgcgcatgcatcaattaagggtggaaaaggcaataagcatgaactggaagaaacctctgctgggtttcctcctgatgactctattggtatttctggaatggagtcctcttcaagagacacagctaataagaaaatcaaattgtcaaaggatattggtttggaccgtctaaccgccacaactgttcaggaagcaccgaagcgtccaagaacaacctcactaaagaagaatcaagagtgcagcagacagaagaaaagaaaaataagcaagtgggatggttcctactctgtaatcattgaatggttgaattactattctgtggatgagtcagatgaagatgaggtgcctttgataaataaaagaaccgaaagaagaaagcggcagaagttactgaaacttgttcttgctagggaatccaatagtggcagtgaaggtgctagttctacatcttttgtagaaaatggcagaaattctagcagtgctggctcttaccccctaagccagggggacaatgacaaatctgaaaatgtgcaagctaatcgagttgatgtaagttcattgccagatcatcctgtaagtagtcatgtagcagcagaggatcaagctggccaagctgcatcgtcaccattgaactcaccaactagaggtatcgttgttgacatttcagatggttgatggccagagttccattagtttctttcagctgaggcctggacgtacaattatccagactacagttgtaacacttacttttaattccttgcacctgtctactgctagacatgcaacgggacgatcctgtgaagcatgtgtcttgtacatgtcttcgtttcttcctttctcatttcaccttttcttttcttagcatagatcagttcagtatacttaactctgtcaggttgtgtgacccatcagtttctctccgtactagtctcttgaagaacagcaaagatcaggttttctctttggttgattgtgtgtggaagatcaatccaaatatgttcatttcttaagaagataaattcagttctattctattcataaacttttgtaaaccttctaaaatcctttaataaacaagaagcaaagtgagtaatacgaaaccattcacaaaatagagggaaaagaggcccaaattcccaagggttaannnnnnnnnnnnnnnnnnnnnnnnnnnnnnnnnnnnnnnnnnnnnnnnnnnnnnnnn

SEQ ID NO: 15491 - DNA, 1780 bp, Oryza sativa
  unsure (1)..(1780): unsure at all n locations
ataaacaagaagcaaagtgagtaatacgaaaccattcacaaaatagagggaaaagaggcccaaattcccaagggttaattggattcatggcccatttatccaaccgtcttatctccctcgtgtccttccccaattatccccttctatccacccacaccagcaagccgctcaggcgcgctctccgctccaccgccatggcgtccatcaccctcctctccctcgctcccgcggccacattgctccacctcccggcctccacttcgctctccacctccttcgtcgccgctccaggccccatctccggccgccggtccgtngtnctccgcgcccgcccgcgccgttgngnacggtcgtgtgcagcgccccggcggccgaagccgcgaaggcggagcccgcggagaagttcgggctcgacaacctgggcccgcaaaaggggtcgcggcggcggccgaagccgaaggggcgcggtatcgcggcggggaagggcgcgagctgcgggttcggcatgcgtggacagaagtcgcgctcggggccaggcgtccggcgcgggttcgagggagggcagatgccgctctaccgccgcatccccaagctgcgcggcattgctggaggtgagtctcttcgagcttcccgcttcccctcctcgccctcaatcgaagcctcacacattcaaatgcactggaaattgagtgggaacacgctagcaccttccatttggaatgcagaaatgctgggattgagaagtgacccgttgcaagttctaccttgcgattgcaggaatgcatattggcttgccgaaagtatgtgccggttcaatttgagagacttggcgcgtggcgggttcaaaggatggtgacgagatatcattggaatccttgaaatcgaggggtttgattaatccgtctggcagggagagaaagcttcctctgaaggtacactatacgacgattatccttcttttttttaagtcggttctgtagatgaccatgttttactgaaaactgaaatatgaatgccttgcatttgatctttgccagtgaattcatcaagttcaccagcagtcttgggtaatcctttagttgttgatgttgtggattgaatggctggcctttttttttcttgtagttctcaaatgttgctgtgttggtctgtccttagcagcaattaccaagttgagtattcgaagtctcaaagttgtgtgtcgggatcaattttcttagctcgtgttggacaaacacggtatgatttgacgagtgtttctattggctactcaaggatctagaacgtatgagttatgatgaacccacacatggtgtaggcctgcatatgagcatatctgtcaggcataaacatgaagtggtatcaagatcccaacaaaaccatgtgctcttacatgtaccactgcatgtctgcatcactcccaacatacccaaaatatttactgtttgtctccactcttagttggcggattgctggagtagatgcattagtgtgctactgggttgccccttatagtgggtagtggtgtggcgcttgatcactgatgtgacaaagacttctccaagggtggaacttaatgcaccttgaatagcataattgttcaacttttattgttctttctggtcctatttcatttgattgattttttctatactctaggctcctagctatgtggtacatataaggtaaaacccacagggctaaaacaggtatcaagnnnnnnnnnnnnnnnnnnnnnnnnnnnnnnnnnnnnnnnnnnnnnnnnnnnnnnnnnnnnngt

SEQ ID NO: 15492 - DNA, 4026 bp, Oryza sativa
  unsure (1)..(4026): unsure at all n locations
gcgcttgatcactgatgtgacaaagacttctccaagggtggaacttaatgcaccttgaatagcataattgttcaacttttattgttctttctggtcctatttcatttgattgattttttctatactctaggctcctagctatgtggtacatataaggtaaaacccacagggctaaaacaggtatcaagacctaagtcataatgtggggagctatcaactttatccttatgataggctttttccttcttgacatctgattctgatgttcagcagatggcgttcctttcatctttgtttgagtacaatgatactgcaatgttgctgttgttattgtatcttttatcatgcgggtagtattagtatgctaacttttgaaaacctatctgtagattttaggagatggtgatgtatcagtcaagttgaatatcaaggctggggcattctctgcttcagccaaggagaagctcgaggcagctggttgtactttaagtctggtaccaaagcggaagaaatggctaccacaatcttatctgaagaaccaagctcgtgcagaagaatactttagcaagaaaaatggtggtgctggtgaatctgatgaagcatctgcatagaattcatatacactgtacttctcctttacccttttctttaacatatacttatttctcttaccttgttccaaaagttccacgttcaacgaattttgaatccgtgcgatatgcaagcatttttttttgtgtgtttcctgtttaaatggagaaaattccttctatacccctgaaagtttagccaatcccttctacgcctccgagttttgtccactcctttgtatgcccctgaattttggttttgatccctttcatacccataccgttagttgaatgtttaattctaatgaaaaggacctttttgcccttagacatgaaggaaatctaaaaattgtagactagctatattgttggaagtgtataattttgttatataagactatcatattcatgactttattgtacaaggtattattcatggcaaagtttatttttacctaatgacataaaaactaatatttatttacctactaaaagagtatatgtagcatttgtttatggtagttcaacatattttctcctgttgtatatattatataggaatgctttccaaaactatgtttatcatttaaaaaaatgctacatgtactttttaaatatatattaaattttttatgtacataaaacttatgaatatgataatcacacaacaaattttatacttccaacaatatagtttacaaatttctacatattcctcacatattgaagggtaaaactgacttttatatacctattaaacggtcaattaacggcaagggtatggaagagatccaaatcaaaattcagaggtatacaagggagtgaaggaaattcatgggcatagaagggatcggctaaaatttcaggggtatggaaggaattttctctcttttaaatgtgatgtatgtcaaatgtcagtatgcataccccccaacacacaccctcaccctcttgtgatcttgcacttatacttcaagttgcctatagtattgttgtccatgttgtgttatagtttggtgacagtctttctaaacaaaaacaatgatggttcatctaggagctaaactctgtttcgcttatttgatcctgcctttttcaaaagaaggtagttatcatttcagtgtcttaattgatgcccatatgtgataatgtgaacttgtgggcttcttaattgtccatgtatacatttcgtgatttcctgggaaagtggacagctggacacacatgggggcatgcacacttaattgctgcactgttcatctagtgacaagaatgggcaaatgttatatagggttgcaagtcattctatgtgtgcttaacaattgattttgaacacaaatttcaacagaactcatccatgaatattgcttgtttgaagaagttatataaggacactgctatatctactgtcacataaattacaagtagtttcttgtttgacttaatacaataaggacagcacatccctcctcaaaggctcaaactgactacagttatatcatcattttgaacttcatgttcatgttctctcattttttattcagggatttaaatcgccacttactgctgcttgtttctttaggagttagttcaaagggtgacataactcaccttttactgcagcttgaaattctttttcctctctctttgattcattcttgcaccctcttgctccctgtggacgttgatgcttcttttgtttgatttgcttcttgtttcaatcgtttacataatctcaattatacctcatacttgttattttcctgttgtttttcgacatttctttaggaaaagaagtcttgactatttaggtaaattctattccatctttgactgtgaaggtgttaatttgttgagatgtttcccatttgatcaaaaacaattatttatggccttttgatgataaaatttatttgtattttagattaacacgcaaatcatcgccctcattcgggccctaggtccacgcagcatcgggagaatgactggcaaataagggtttgggtaaatttccagtggcatagaagaaaatttacccttcatttcagtgtgcagtgcagatttgctatgaactgcgtaccaagatcttgactagttgtgcttgcattgcatgttcatatcagcaatttaatactacctccgttttataatatttcatattataagactttttagcattgcccatgttcatatggatgctaatgaatctagacaagccactagcctattattgcaatgtagttgtccttaactacgattgcaagcattagaaaacttatatttccttccaaattgatccaaggtactcttcgtttcaaaatatagcgaacttggactgaatgcgacacatcctagggcctgttcactttgatgcccaaaagttgccaaaattttggcatatatagttatcaaaatttggcagcaaactaaatatagtcacttttttggcaactttaccaaaatttggtaagattgaaaatggcatcaaagtgaacaggcccctagtataataaatttgggacggaaggagtaagctagataaaaatgaagtcatttatttattgttgcatatttaatcataaatagagatatcaccatggaattagattggtgtatacgtatgcttcgtgctactgatccgaagactcccctgccaagggatcggatctcttgctcatggattatgcgtgtgagtagacagatgatctatgatcaccactgtgccatgtcgggcaagatttgtggcgcgaagttagcatcaagttggaatacattcaagaactctgttctggatgaatttggacatagcagaatgctaaatggcgacaggctgttattagagggcgatgtgcttttcatgttgtttcgggggaactgaagacactagtactgtagcacatacatctgacttgttgcttctgcctctcgaactgatccagcaatnnnnnnnnnnnnnnnnnnnnagtatcagtaattagtaagcgtataaggatggtattagtgttgatcgggatattgtagaaggatggatgtattatagtgttgatcgggatacttagaactacgagtgatagcttcgtgctacgctgttctatagtcaatgtggcacaggagaaacgctagtatggcctatcagagcactatcagctgccgccatcaagcaaagctgaggccgggctgtccaggttgcttcagggctttgggagctttcgattgctttccactcccctccatctccatggcgcacaacagcgacgccccgtgaatgcacgacgatgcatcgtgcaacgcaatcgcgtcgccataactccccgctccctttcacgccagcctaacaaccagaccccatcgtcccggtgtggcatggcaaggcatcgcaagtcgcaagcaaaccccgcccgcaagccgagagggaaggagaccaaacccccccccc

SEQ ID NO: 15493 - DNA, 19497 bp, Oryza sativa
aatccccgctgcttctccccgcgtccaacgccacgcgacgcgggacgccaagttgccacgacccagccaggtgaggagtgcgcgggggagcaaaacccagcgcagccgcgctgcggccaccggcaacgccgcgccgcgaccacgcaaccggggaaaaaagcccatcttgtcaccttcctcggccattaactgcgatccctccagctagccaccacagcttagctcgcgccagcctcgggtccacacgcccacccacccacccacccggcgttgagctgcgcctcgtccgcatttactagcatccgatcggtctgatgcccgtgtgaggtcgtgaccgtgatgacccagccacgcaacgcacgcagccgtcgagtacctggatcgaacggccggctttcatcctcaccggggagtcgaccgtcgccataaatgtaaaagcgattaacgtcctccacaccggagcatgattgatgttttgaggcggaacggaaactgaggaagaaagccgtcttctctattcaaggaagagcctgtcccggaaaacatgtcggcacggcgactgcatttatttacgtgttacagccgtataaacagagggatattggaaattcgacaaagggtaagaaagggataatcagacaattttggattattgtacatctaggggcaagggcatgtttggctttcagctcctccgaagtgaagcgggctagaccgcttaagcgctcccaccgagactgtattgggtttagtattgggtttaggctactccacaattttatttcaaacctaactattagagttaaatttaaaagttggagttattctcagctagtcctctaattgtcaaccatagcagatcgggcatgtaagtaaacccacgtcgttgtcagaatttataacagaaatggaattctagcttaagagaggaataaaacgtgagctaatgagcacaactcacttcaaccagtaattagatggatcatgtctgaccggttgcatgaagtgcgagtcgattttaatctagtaagatgaactcaacttcagttagtaattagatggatcatgagttcggttcgagctaaaactcccaacgacggatcatgagtagctcgtgccctctccttcagatttttttgtacaatctcctaacatattccatttcttatcaccaaaagttttaagaccggaaccactgatttttcaggaacaaagaaggactgaaatatctcagtataatactacctctgtcctaaaataagtgtagccatggatatccgtacccaatatttgaccgtccgttttatttgaaaaatttatgaaaaaattgaaaatatttagtcacacgtaaagtactattcatgttttatcatctaatagcaataaaattactaatcataaaaattttcaaataagacgaacggtcaaacgttgaacgtgaataatgcaaaactgcatttattttgagacggagggagtacgcagttgtaatcaggtagtcatctcagtaataaattacgcatgtctgtatttggaagagtaatgtagtaatactgtactagggttttcgcaaatcaaaagagattaattggtgtgcagtgtaggcctaccagtctaccagagactatgcgtgtatccctttcgccagtaacgatacggattgcaactggagcctatgagattcgatcacgcccctcaattccccaatccctctccctcttcatggatcctgacacgaacaatcgaacaaccacggccacgctaaattggaaaattaaaaaaatatataataattaatctcctgtgaatgatcattccttatgtgacacatcagacaaagtatatcgatttaatccgtgtttatagcgaaaaaaataaaaataaaaggaagacaagaaaaaaaattaagaagcgagggaggggaaaggaggaaagaagaaaacaccacaaattaagaagctccaaagtttgaggacgcacgcttcgcgggtgacgtacaggtgtaggggaggtaatgcggcggcggcgcgacggccgccggcgagggcgaggctgaggctaccatggattcgatcacagcttgacgacctccgggatgtcgacggggtagcggtggatgcagtcgtcccacggcccgtcggcgggcgtcttgactgtgcggaggcacttccagacggcgctgttgcacttgaatccgctgccgaagccgatctgccagacgcggtcgccgcggcgcatgcgccccttggcctcgatgtaggcgagctcgtaccagagcgagctgctcgacgtgttgccgaaccggtgcagcgtcatgcgggacgcctccacgtgctgcgcggacaggtccaggttcttctgcagctcgtcgatcacggcgcgtcccccggcgtggatgcagaagtgctcgaacgccagcttgaagtccgggatgtacggcttccacttcttgttgatgagcttgcggccgacgaggcggaagaagaagagcagctgctccgacatgggcagcaccagcgggccgatggtggtgatgttcgacttgagcgcgtcgccggcgatggccatcagctccttggacagcgagatccccgagtgcccctgctcgtcctcctcctcgtacacgcaccggtacgcgcggtcgtcggcgcccttgtgcgtgcggaccacgtgcatcagcctgtacttggccctcctcgcctccctcctcctgttcgacagcaggatcgccgccgcgcccatccggaacaggcagttgggcagcatcatgtcccgccgggttccccagtagaagtttggtgtgatgatctccgtcgacaccaccagcgcgttcgagttgggatgcacctgcgcgtgtccgtccatgtcgctcgttaatggctcacctgattagttagttagctaaacagtagtaacatcaaagagctggctagtacttacctggagcatgtcgcgggcgaggtcgagggagatgaggccggcgctgcagcccatgccggacaggttgaagctgcggatgttgctgcggagcttgtacttgttgatgatcatggcggagagcgacggtgtcggggagaagagactgcagttgacgacgaggatgtcgatgtccttgggcttgagtccggtgcggcggacgaggtcgtcgatggcggagaagattacgagctgggcctcggcgcgcgacgcctccatggacgggttaggcgggatgtagtggttggccggcgggaggcaggtctcctccccgagccccgaccgctcgaggatcctggtctggaaccgcacgctcttctcgtcgtcggtgatgaggcgcgtgtgctccatgaacgtggcgaacggcacccggcagctgggcggcggcttgtagcaggagtagtcgacgaggtacaccggccttggccgcgacatgaagtacaccgtgccgacgaacacgacggggaacaccgagcagaggatgtggacgaggtcgagctgcatcgaccgccacagcgacagcagctcaccgggccccatccgcgccagctccagcgccgtcgccgccatcaccggcaccagcagcagcgtcaggaagtggttcaccagatactggtaccccagcttcacgtacttcagcttcaccgacccggagtaccccgccgcccccggcatgatcgatgctctcactacttccccgcgcgccgccgcgcaccgcaccaacgctcgcacgccgcgtcctacgtacgactttagtttcttcttttttttgagcggtgcagcgtgcacaatttgtaggtgcgatgcggtgcggaggcggatgggtttgcagtggtgtgttggtgatggtgtgtccggtgcccggttggggggtctaatataggggacgcgcgcacggtggcggagacgagacgagatgacgaggagtaattgataaatctggggcggatggggtagtttaaagaggccggtctaccgccaccaaccggaagcgttgggctgctcttattagatttctgcatcatgggggggacacaaggttttctcccttgttttttgtttatacaagtgcaactcgtagtgacggttaacggcttaaccccggtgtcaatttggatatgtcatatgagtatatgattgctaaggagtatcatactcctcctatagctcctggactctggagaggaccatttttcagtgacaaccttgttctgcgggcattatcggaggaaaataatagagttcgtaattaagtggagtaatacacaagcaatgtgcacaggtactgtactgctcgcatctggatccaggtgagtacgttcagagtttagtcatgcatgatacactgaacataattctcttatgttgctagtagctgctgtctgtcccatctaaatttgcatctgatttttgagcaccgaatgatgtaacaagccaataacaataagtagtactattatcagtagttaatcaccaagtgtccaaatcataaccgagttagttcaactgttaagacccttgaggtcttgacccgtcgaaaaaactcttgctactctattcgtcaacacctgatttgagtccaaatcaggtcctctcctatcgccgagtgaacttatctctgaagataggtttcaaaaacttatctctgaagattggtcctgttttcttttttactcacttccttttgagatgtatgcaatggtagatcagatgagagggtaactttccctgcggaagtacggcaatacagataatggctgggactgaattgggctcccttgcatctgcaccgtatagggttgtgtgtttcgcaatggcatcaggttcaggactgcatgtgcaaattactctgttggtaccctctgcttgtacaatttaaagcactgttgttgcaggttgggtacccatcattaaactacgagatgaacactcatgtccaagtcttgcaaattcacatgtaatcttgtaagaactgaacagttttacttcgaaatagtactctttaaatgttgactctgattcgatcggatcgacttcgtcagtgtgcattacaagctctgtttggacaaattctgaccctgttaagcagctctagctggatactacttctatactagtacttttttttttgaaagatcaatagtagatggtactcctattaggctattaccattactctttggatggccacatctaagtgcctgatctggtaatgctatactcctagtatccttgaatcctgataagggtagtacagtacggagtatactcgtatttttgttacgagactccacttcataaattcatatactacagtagtaatagctcagacaagttcaggcagagcagtgatagctgatgacagaatactccctccgttccataaaaacgaatctagaaccggatataacatattttagtatgatgtatatccagattcatagtattaggatgtgtcacatccgatagtaggttggttttttatagaacggaggagggagtagctatataggtgcagacagcttctgagcttgtaagaaagagttaattgcgtatgcagtgatctgcgtagcaatagtgcaactgtacaattggtgaaaatctccctaaaaaatggctaaatatatggcctcctattgtcccggagccaatgacagtgtggtcctttggctgcagccctggcagcagcattaacgtagtagtgagtgtccagtgcgcagtgatccaatcaaaattcgagacaggatcctccgggaagcatcaagcatcttcgcgtacgagtcgtgagacgatctgtccatgcctctgaagaaacggaaaaccacggattgttcttcttcccctcgcgctgatacgagtgaaagtgcagccgaagcagctgtcgtagtggccgcgtgaaatgctgaagttgacgggtctgaatatgtgatcggtctggaggacgaatggacgatgggccgacatgggatggagttgggggttgggagaaagcgtggcgaaacgcgctgtgtttgctcgtcatcgatcgaccagaggaagggcagagactcacattaataaagcttagctgcaaccatacatccgccgcaggtgtgcaagggcaatcctgttcggttcacgtctctcttgcccttgtttcgcacgagcgaattccgtctcttcgttttggacctgtccctcatgtactacgacgaacggcacttaggggatcgacatcttcgtgggacaggattgtaaacttacaagtattattctacctgttcccttcatactacacattaaatgtgatcatctgcttatttaaaattgatcatgacctgtccatcgcgccaaactgccaatctgtattaggtttgacagaggccattacctgcaaagaaaaacgcttgcctaagttaatgctctaactgtacgtgagtacatcctgcctagcgagtggttctgattgctgggtcctttactcctgaaaagtcagtttaactataatcagttgcagagataatcttttttattttcataaacaagtattttctctgtttatgtttttatcaataaaatcgaacctctcagactcaattctttgaagctcggaggaaactacggatcggacgtccgattcctctaaaaaatcggagggtcaaatattgtagttgaccaacaagtgaaacattaagttatgtatggtgaaataaaaaaaatcagcaactgaaatatttaaaaattttatgaaacatggtgatgatacttgttgaaacatgttactattatgtattaaacaacgagtgttaacggattgaaacatatgtttttctttcgtcaaaatatagtcatgcgatatcttgttataaagatttaattacaacgaatacaactgtgtgatcggatcgtagattggataagtagtttaagaaaaaatttattttgaagattattaaaatgcatatatgcatggatagaagggagagagagaggagagagagagagtagtggcaggtggtttcgtgaattttatgaaacacattgaatatatacattgaaacatatcaatatcacgtatgaaacattcagctttaacggtttgaaacacatgattttattttattagaatataattatatgatatcttcatgtaaagatttaattacaactaataaaatagtatgatcggatcgtagattggataagtagtttaggagaaaaacaatatttaaaaagagaaaaaaaagaaaaagaaactagcttgtagcgagaatgctcgccccgggtgaccggcggggggtggagcagatcgggcgctccccattttcgatgtacttagtgaaacaattccgatatacttggtggaacatcgtgcaatatttaaaaataattcaataataagctaaaaaaattttgtccgaatatatccatgtgtggccttgttttgaagatttaattgcaacgaatttaatggtacaatcagataatgatttggataaataatttaagagaaaaattagtttaaagcgggtttgcacgcatgcgtggcactgacgtcgtgctgacatcagcgcctgatttttgcacgcattgatcgggatcgacgcccgatcggtagttccctccagtttacagtatacttgcatgcatgaatcgggcaccctattgtgagcattctcctcgaaggttacgtctcaaacatttctatttcactacatgatatttttatgttaggatgtatgtcgcatatcgaattttgagcagtgtctttaattaatatgtaaacttattgagacggcagccgtgtcaagtacgatacatacccttctaataggtcctacaagagctcaaaaacattacaagcttttagtgtccatgtttgacttatgggtaaaatgcccatacttatttgaatatacaaatgttattgtatgttattaatttgatggattcaaacaaatatatattagacttagactattgcataatatcaatgactaatttgtaaatcttgtaaaagtattgatgatggactaacagcagaaccaccaccaccaccactatcgttttttttcagtagtatagattgatgctcaaagcatctatacacttcgagtgccatcacaaagcccatatttgtttgcacttttagcacattatacatacgtacagcgtttctctaaaaaaaattccacgttttgctatcgatggacgatctgttctccaaaatatcatcaacatgaatcctacaaaataccatgttacaagcatttttcattttttttatcaccattaggtttatatctatagaccttcattagttatttaaacagaggccatttttccctaaaaagaccttcgatacacccatttctacagttttttttggggggacatttctatataatttgcatgtgagaatatgcaaacaattttgctattaaattatttatgagatttaagggtagtttgggtatttagcatgatgacaatcaaattatagggacaaaatggtcttcttgaagacgtgatggaggtttatgaatgaagacttaacggcggtgggaaaaaaaagagagaaattgcttacattatggcatgttgtagatgtccagtttgtcgatatcaattcatagaaccagttgcttatcaagtaaaatgtagaatttctcaagaatatataagttgcatgctcgttatactatttttttcagcgttttggctgggctgaacactaatgcaaaacgagtcagatcatttgctcatgattaattaagaactaactattataattaataaacaaatttgtttgactatttttttaaaaaaacttttatataaaaaggttttagacgaaacacgctatccagtagtttagaaaacacactcataataaacgagaaaatagcccataacgcacccttatttgcactttccaccatgtcaattgcatcatggcttcactttataccagtgtgggcatatcaatttcagtttactatactacagtacatcatacaccagtgagtaggagtatgtcataaggcttcactttctccagattacgtcctgaaatctgagtcataaaagacgagaataactcatgagactccttgaatttcattcacgtactgtacgttttaggaggtccatgacatgtactattacaaagataaagttgagaagtgaataatgaacagggcaagaaacggaaagttgactatgacgttacgcattaacttgatgcttatcatatatcctatatatctataaaatttatcgccactaaatatagttaatgctaattttcttttctctcatgaagccatatcactttaattgtttttagtctttggatgattaatcaagggtgtaaagtacatctcttcacatcaccttaactatttttagcctttggatgatttatcaagggtgtaaattgcatctcttccctctaaaagacaccatatatacaatccaatcatttataacatttagataatttataaaggtatgcatgaaaaaaatattatagtagataagaaagaaaattttagaactcatatcttctatattatcacacaattctaccgcagcaaccatctactcctagcatatataagacagaggccgtgtttagttcaccccgaactaacctaaacttccaactttctatcacatcacatcacatccaaaacttttctacacacataaacttctaactttttttccaaacttctaactttcctcaaacttccaacttttgtcactccacataacctaaaagaaacaaatgcgtagctctgctgaacagacaacctcactcgtcacaagtttgtgcaccttttggttttgcatacaaattaagcaacaaaagcaatccagtttgcagaaaaatatagtaatatttttaatacaaaataaatatattattaaaatatattcaatgtcatatttaattaaaccaatttggtgttgtagattttgttaaatttatttataaacttaataaaacataaataagtttggttagaaagaaaaatcaaaccaacttataatataaaaatataaaacgaagggagtattaacctattatatgtgcaagttggatcgcagttgggcgttggtaaggttggttgtttcctgccgtcgttgcaaggacggtaaggtggtctgaactctgaacttcgacatcacccagaatcttcagtttcgcggtgcatatcacaatcgtacatgacatcgagagatacacggattcacgaaaggccaaatcttacatctagttttggtggacatcaggagtgcatgatttattaacttttttcagacagtcgatcccaactcccaaccgaccgccgtgagcccgtgagaaatgaacatttggagttgccatcctccattgtgtgcaagaaaaaacgatcgattccaaccatgatagccactgacgctgatgtgaacgacacagcctttgggactagaatcttgacgtatagacgactaaagaacgtactccatgttagtttattataagcttaatcttttcgatcggaaagaataagcaaccagtctatgaataatgatatcaattcaagctcatcatctcgttgcagatttccggagttagagccagccgctcacccaaccgtttccctaatccgtcattaagatttcaataatcacgtgttggtgagccgaaccagattagctcccgtacgccatcaggaaaatcaatctaccgccgtgtacagcgccagtaatgtgtcacgccgtacgtacaacgagattataagaatgtaacgcatcgtgagcgtgaaaacgatcagctcgcttacgcttcgcctgcatttcctgcagtttcggtaacatgcgtatatggaggcccatttagggtctctgtttcttctcaagttaataaaaaaaaacagcccacaggctacagaattggtgtatagtagataaaaagacacaaaaatgaatgacaggataactactatactcagggtgtgtttgaggagattgggaagatacgcaaaacgaggtgattaattgagtattaactattttaaatttcaaaaatggattaatatgattttttaaagcaactttcatatagaaaatttttgcaaaaaacatcccatttagtagtttggaaagcgtacgcgcggaaaacgatgtgcattcttactccctatcacccaaacaaacacagccttagaacacatataccaatatatggattaggattactggtgatttgggaacaaccaactagcagtcatcttaaaaaaaaaaagagaagtcagaagatagctacagtgaattcattagtgtccagagagtgcttgtttgacaagcaagtcaaaagtgtcaaacattgataacatcaggacggttggcatgcgatcgtgcaggtttaaatgcagtcaacaaagaagtcagaaacgactcattgtacgtgtacgagtacggtcgctgttttgctttccgtgatgcggttggacgttaaggtctcatcactagcgcgatgtcccacagcgatccagccagcttcatatggttgcatatacagaaatactactactttgcattatcaactatgctccattcagcttcgtgttcagatactctctcgatacttgcgtgaagagagatcagatatggacaacgaagacgtgcaacgtgtgctttcaaaaaaaaaaaaaaaagacgtgcaacgtgttacatgaacagtacggcaaatgcgatcgaggatgttactcgagttattacggcatggccaatcaaagttgacagttaaagtccaccctcagcgaacaggtgattgatcgattagtactcctaacgctgctgtacttctcgaataaacattgggttattcaaaattgttggagtagttataactggaggagtcatacaattattataggactgtgacctcgatcaggatggtttctaactctgttcctatcaggtagccttcaactccaacacaatctacactctgattgtatttacaccctgtatatgtactacttcctccgtactcgtcgttttggtcgggactcgggagtaaaatggagtttaaccgttattattttctactaagcaacttcaaagtgaataggtttaagtgtatgtaagatattggtaaaatattttgtcgacgtttgatgtcgcgattccggtatttgaatagtatggggattgtcggagaatgaactcctccaccagggaaccgtgaggcccccctttgtgagttcggccgggggcagcgggtgagattcgaggatttggtgagcgaaactgtgtggtcttgagggggttaggcccctccaagacgatcagaccaaagaggtttatacaggttcgggccgctatgaagcgtaatatcctactcctgtgcatgattgattgaatgtagaacaccagtgcttggggttgcgagacccaagcgccagttcgctccgaagtccctcccctccaccactaggcctagacctccttttatacctcaaggggttaccacatgggcccaacaacctaacctaactccggtggagaagtattataatctttgcattaaatgcatgtcttgtttcttgacttgggaagccaagcacacgtcgtcttgatgatggggcctgtcaaatcttgccgcctgacacggggggtgcccctgtcaatcaccatttaatgggtgaaaacttctgggctccttttacaccgggaaacgggagccttgctttgaccagagcgggaggaccgactccggctgggataagaggatgagaacctctcaccatcactatttgatgggacatgtcaggctgcacaccgcctgacacacgagcagcgcacaggcgcactagccagtctcatcggtcattcgaccggtcacagaccggttgagtgcactgcacgccacattaaatgcggcgtagcgcgaccgcttgggacgccataaatacgggtaggcggacacctaacccaccgtacgtggtgacctagagatggggtcgggggagcccgacccctagtcacgggagggggcggccgccgcccgacctcgggcctgatcccccctcggggggggggggagccacgtggcgcctggggcggccttctccctctagtctcggccagggagtggccgccgccctacctcgggcctgacccccctctggggagggccacatagcattggagggcagcgtcctccatccaatttctgggaaggagtggccgccgtcctacttcgggcctgactcccctcgggggagggccacgtggcatcagggggcagcctcctccgactagtctttggggaaggagtggccgccaccctacctcgggcctgactcccctcgggggagggccacgtggcatcggggggcagcctcctccctctaaacctgatacccccaggcctatatcaccgacaaggatcgttggtactaggatatatgcgagattgaggtaaaagagacggagacgatgatttttatacaggttcgggcccctgaattatcaggtaataaccctacatcctattggccggagccggtgttgctctttattcactataatcacaccagtacaatatttagggtagcctatctaactattgtagacttggcggtctgaaattctaactcgtatcgacaacagggtagtcttcctcctcgaatccgtgcccggcgagatcagagatagcgctttcgtctctcctgacagtatccggagacaccgtaggggactagccgtgcttatccctgaagccgctttcgtctctcctgacagtatccggagacaccgtaggggactagccgtgcttatccctgaagccgctttcgtctctcctgacagtatccggagacaccgtaggggactagccgtgcttatccctgaagtcgatatccggcgtcttgtcttggcttatgttggcttgtatgttgtggcttctgttgttccgtctccactctcctcttaggaggtcttatatttatacccataggtgtccccttgtccaagtagaactagggaaaccaatatggatacaatccgagtagtccttgtcgttttcatgtggaactctattcatccttccttatgcggaactcctcttatatctgaaggttgtttccgtataagagtatgtggtgggtcctgtcgagatttagtcaactactattaggtatgtggtatctataacactgacatattttccatcgcaaaactaataataagtagtacaacattgatgctaaataattagattatttaagtatcaaagctaagcaactcaaagtcaaaaccgatgattaacagatgaagtattaaatatatttttttgcgggaatgaagtattaaattttgacttaggtattattatatatgttaagtttcaagttatcatgcatgtaacatcatgtacgttttcacgaaaatgctcacacccgcacgaccggcggggtggagaaaaatcggacgttgtctaccactacagtatgcaaagaatcttttcttttcttatttattcaaaagatttttttatcgtaaactatttatctaatctacgatctgattgcaccactaaattcgttacaattaaatctttacaataagaccacacatgattatatttcgacaaaatttttattgatttttttaatgttgcatgtggtcacttatgtttcaactagtagttttacaatgtttcagctagtgtactcatgatgtttcactgtgtacggatcaaatgttgcagtggaacgtgccgttgcaataaatcacccacatattttggaaaccctctattaagggaattttgtttattttttgttccacaaaaaatgtttcacctaatgcactcacaatgttctactatgtatagatctaatgttgcagtgaactgaaatatatcattgcaacaaaaaacccacatattttggaaaccttctattaaggaaattcgtttcattttttgtttcaccgaaaaatgttacatctagtgtacttataatgtttcactatgtatagatgtaatattgaagtgaactgaacattcttccgctatttgctgaaacattgtttttatataaggtgaaacaacaccagatttaaacgagtgaaacattttcgagaaacaattccgatatatctggtggaacatcgtgcaacatttaaaaatatttcaataataagctaattttttttcatcggaatatatccatgtgtggtcttgttttgaagatttaattgcaacgaatttaatggtgtaatcgaatcataatttggataagtaatttaaaaaaattagtttaaaagtagttttgtatgtaaatcgaacgctgacgtcagtgtccgattttttcctaaagcatcgaacgtccgacgcgtaccctctccatgttttcatctgcaaaaagtgtacaaatgagtattaattggcacgtgtctgagtctcagtgcccatgcatgttccgcttgttttaattcagttattttcgataggcaacaaacaaatgcaacttttatatgcacaagaaaaggatacagctgccgaacgcacaccaacaccaacagctcacacggttgggacgtgttgtcacgttgaggcgccgttgggcacgggtggcatcactccacccgtgggtgggcaggtttcacccggatcgagccgtacgcggacacgcatggcgtcgacctcaccactgcaaatgcgtgcggttagtccaccggtggcggcctcacatcacatggctcgctctcggtctcagccaataagccaaacgacaacgaggcaggcggcggctggaaaagcaaagcgcctccctggccgcgccgtacatgattcgagcgcgtgcgcggcgtcgcgaactggctggccggacgtgcccggatgagatagcgcacgcgccaacgtgcatatgcctacacgccgcgcgtgcggtctgggacgagtttcggtgcgtgagatgacggacgatgttcggttgcggactggcggcgatggatgacgccacgcgacgcaccgcgcagcggctggccgtttttcggttaatctatagtagctgagctgggtggtagtacaaaattatatattttttaatataattttacttaaaattaaaatttattaaatagttaccttgttgtcttaagattttgaaagaccaaacatatatattaaccatttcattattaatcttacaattattattctgttttataatccgatcacactattgtattcgttataattaaatcttttcgacaagatgtcatatgactatattctacttaaagaaaaatatatctttcaacagttaaaatttaatgttgcatgcgtgataatgtggctactccctctctctcatattacatgcatgtagtaatttttaaaataaattttcttctaaactatttatccaatctacggtatgatcgcaccattatgtttgttgtaattaaatctttacaacaatatataacatgattatattttgatgaaagtaatacatatgttttaacatatgttttcatttcataaactttttaaataattcatttgctatttttttcagcatgtataacttaatgtttcacccatgatccattaaaaatttaatcaaccatttatttcaaggacaactgtgttattgcccctattttatgttgcaattatgattttacccttcttttttagattggtgtttttacctttactttttgctaagaaagcttcagtttgccccaattctaaatggttgttaggtggcccagatttgtgagataaaataaaagagaaaaatattaacgaagtgcaaaaggactattgtacccccaacacagtattcgttcagccgttcccattcaaatattcctatccaagtcctgtgtagaactcgagcagttagcggctgaggctgggggtaggcgggtagctggcggcggctctggcacagcgccacgggaagacaacagcgggctacggcgagccagcaacagctacggcgcaacacacgggaaggcggcagatcttgcgcatcaccacgggaaggctgcggcgagcggccggcggcagcgctccggcgcagcattacaggcagttgagcagtgagcagcatggcgtggcacgacggcaacaacgacacatatacggcgggcagttcgtccacaaagacgaacgatgccgttgctgcttgattttccttttgttttttcccatctcatagtatttgtgacttgcgaggaatttatgtaaatattagtgctgaagtttcgcaaccattcgaattatgtgaaaatgctatcaaaattctatgaaattttgggatacaaattctaaaatacatgtctttttacagttgaattcacacaccgggcaaattgaattttcgtttgaaaaaagtagggatgaaaacacaaatcctaaaaaaaaaggtaaaatcataattgaaatacagaataaaggtaagaacccgtttgtttcagaattcatgcaacctgctgtaaacttgtgtgtcgggggccttgcaggcttgcagctacggtagatggaatgatgagttcggtcaatatttttttctttcacaaagctaacatgtcagggtaatcagatgttaccgtgtaacacgtctaattaataatctaaaaaagaatatagataatacacctgatcgtgagtgatgttcacccttgcggccttacctagttaccttcattaatgcctaaaatgattccgaaacaagttattctccatgccatccgtaggctacaggttccctttatagtcgactagattcattgcagaacgaacatataaattccttccattgtatatatgttgtacatctaaaataaactcacggcttttatgtacatatttgagggcacaatttcatgtgctggtagcctggtaacgtggtagcatagtacgtaccatgtgaaattgagtacgagaacgtgaaattgagcaagttcactttaggtacctcaatttatctctcagtctgaaattcatccctaaactaaaatgacaggtatagcaggtctttcaatttacaaaaccggatcaaccgagatcctaggtagtattatcaccaattttaactgattgacaagctgggctcacatgtcagtggataacatttcccggcgccatcctccgtgttcatcgtcgcgtcgatctcgtcggccagatgacgacgcacgcagcagctgtggctctgtggtcggtcaccgttagggaagaagaaggtggtggtcacggcagcggccatgccggagccggccacggccacggcggcggacatggcagcagccacggcaggccggacccatcagagcaccacccgggcaagcgcagcgcggcgcccggtgtcgggcagcctcctgcgccgctgtcgctctgcttcccctctgaatgaatcctgacccgaaccgcaccgcacccaatttcaaatcttgaatttaaatcgattgatcttgttgtgtacatagaatgaaatgaatccaaaggaattttttgcgaacgcagaatccaaaggaatcatagagaatccgcccgattcgggatttccggtgagattttcccgcatcttcaatctgcaatctatgtgttctttccaagaaatcaaggttttttcttggatacgttcatagaatcgaataatgcattgctaaacctaaaagggttcaaaaaaaacgtagtcagctttcaagtcgcatttaaatacgtagctacggccaacctgcgaaaccgagacaaattcaagagaaaattcctgtgtacccttaaaaattcacctaatcccttatacgtccttgaattttacttattttcttatatacccatgaattttagtttggatctcttccatgcctttttccgctagttgactattagttaaccgttaaatttttaatgaaaaaaacccattttaccctctgctatgaaaaaacatataaaataatagagtagaaatttgttagatgggactattatatttatgagttagttatgcaccatattatttgcgataaatatacttttagatataacataaaaaatagtacttacttattagttattaaaagttttctatgtagcacattagtatatttttcttatacgacaaatttgttgtattactgtcaaaacacatatgctacataaaaaaaagttttaataactaataaataagtactactccgtttcacaatgtaagtcataaaacttacattgtgaaacggagggagtattaattttttatatgatatctaaaagtaaatttgtcataaataatattgtgcataacaaactcataaatataatagtttcatcaaataaatttctacactccaacaatctactccattagtttattatgtttcttaatagtaaaggataaaatagatattttcataagaatttaatgatcaactaggaaaaatggcataaaaagggatccatgtaagtaaatgagcaaagaatggattaggtgaacttttatggatacatagggagttttctcc

SEQ ID NO: 15494 - DNA, 3607 bp, Oryza sativa
  unsure (1)..(3607): unsure at all n locations
cagggtcaaccagcccggcaccacccttcttgtgacccctctgtcacgaatctccaagcagtcagacggtaaggatggtgggtacttatgtacccgagctcaaatctatgttatatatatatatatatatatatatatagattaatcatctaaaggctaaaaattatcgagatgatatggattaataagagaagaaaaagagagataatttggaccatagattttatttaagcactaaaaacaattgatgtgatatgacttaatgagagaagagagaactaagtgatgatgaactatatatgtacatagtataatataaaaaaacaatcaagatatatataaaaatattatgtgaattatgtgggataataatttaacatgcttgcattttaaaagatctaaaatttaataaattataaaattatagttaatatagcatgtttgcatgatgtttaaatttaatgattgttagtgaacgactattgagcctaattaatccatgattagcctatgtgatgctacagtaaacattatctaattatggattaattaggcttaaaaatatgtctcgcaaattagtttttatttatgtaattagttttataagtatagtattctggcagggagggttaaatgtagagcatggagtaacccgtactattgctacacagggaccgagagcaagaatcccggatttggccttttgctgtgtgaggaagcgtcttacttattaaaaccactcttggcgcaggctcttctcattcaccaaattaaaatgacatttacaaaataaaatatcgatctattatatatacacacgctgaattttttttttgttgaaatgatatatctctattcaccaaaaatgatatttacaaaatgaagtatcaatctattatatattttgactttgtttttacaggcatgatgagaacagatgggtggatggcaacccaaatttaaagggcaaaactagataataaggatttcagtaaaagtactaattgatccatggcaaaagattacaagaactcgtgtgaaatcaaaataaccggaagatatattatagaacggaacataaggaaggcaataaccttctcgagaaacatgagaagaaggtagcagtagcacccagcaacaggccaacagctagccttcgagaactggaactggaaagaaaaaaaacagtaaattgcatcttgggctattttttcttacctgtactgtaacttagaccagtgaaaaagtaaacttttcactttgaaccgggtatgtttacacaatgtttcaatttagactctcttcttcttcctccaactccctttcttcctctcttttctccgtacagctcaaggtctctttctcgatcaggtgcagtgcatgaaaaggcaagaagcaaaacctttcacagggtagccacccgccgaagttgatttcgagctcaaatgcaggcggcactacgaaggcggagcttgagcgctgcaaaacttgttgaagctcgagcgacacatgtggaaatttagcgcaggcgtgcagcataacatgtagcactagctgaggtcgagcatgagcttgagagcgtggctatctgctacttgacttagttcttatcgtcagttcagaaagtagcagcaactgtctgccattgccggccagcttcttcgtatgctagttgctaccagtaggaatacttgttgtgcaccttccgctgtccttgaaattaagccacaagcactaggtagtcgagattgaaaatgcaaactaccctttgaattctttggaagattttacagattgaaggggagattgggggaagagagttggaggaagaagaagggagtccaaattgaaacatcatgtaaagatactttgcccaaattgaaaaatttagctttagcctagtccaaattgtaacaatggtaatcaaaggtggctcaaagttcaattcactaaaaaaaatgcagcaagcgaaatacaaagagcatgcacatgaactgggatttttttttctcaagatcaaccaaataatttttcacatcaaggcaggaccttccatgactgtttcctcgccagagagaggggagagagagatcgggaggaacatgcagtggcgaaggatgaggtagctgcagaaatcctccatgtcggcctactctcatgggggatgcgattccgaaattatgtgcgcaccgctggttccgcaacagctttatctgccggatgcccagatcatcagcttcagcgctcttcgcacacatcataaaaaaacaaatcaaataatggaaataaaattaaggaaaaaaccaaatcgaccaagaacacccgattcccaaaaatccaaagaaaactcactacttgggggcagcggaagcagccaccgccgggctgcgctgtcctcggtcctcgtcaacccagtgcctcctccctacctcgctgagacatggatcgagactagcagctacgctgcgctggcgacatcacatcgccatggacatccacacgaattatccagcgctaggaggaacagggccgtccgatctatcgcctaagaggcggagggctgccggatttggtggccgtggacccttcccgcgctgacccacgcaccatgtcgctgctcaccttcctactcccactcctctcactcctttttgacgccgacgcgcgccatagcttcaagatccggcgcggggtggaccaaggagtctcgagccagtccttgtggtggagtcaagctcgagtggtcaggcggaagcttgccgcccctcaccggacaagctcgccgccggtccatcgtccacgagcgagggcacagcccgagtagtactagaagggcatttcgggtaaaactacagtaccattgtgtacccaccgtccaatcccaccagctcctattaggtgaaagagctacttttgatagagcagatacacttcactaggggtaaatgtaccatgctttaagattcgtgtgcacacgtgtagggtgcagatcgtgggtgcatatgaacccaggtgcagattatccaactcctataaataattactgcctcatgttataagttaaattttaactgcatgctatgtacctggtggggagcaaggtgagtgggttagaggctgtatcaggtgttatttaatacgtagcaccttataacttataagatgaggcagtaattattttactcagccttcactaggagtggtgtacaggcaaattagaggagagatgatccagtgatttttttacttgccgtacaatttttttactcattaagcgttcacatcaccagacgagtaactttttaactcgggacaaatgggatgggaaaagcctttgcaggcggtggtagtagtaaaagcggtccatgaggatgcggcacatgagaaaggcgagaaatccgaagttggacccagaaaaaactaaaagccaggaaggcgagcgctgagaggcgcgctacttccttcgtagcgccaccatgtgcgcgcgcatatatatatatatatatatatatataaaatatttacaaatagggagagaaatagaatttaannnnnnnnnnnnnnnnnnnnnnnnnnnnnnnnnnnnnnnnnnnnnnnnnnnnnnnnn

SEQ ID NO: 15495 - DNA, 15507 bp, Oryza sativa
  unsure (1)..(15507): unsure at all n locations
gggagcaaggtgagtgggttagaggctgtatcaggtgttatttaatacgtagcaccttataacttataagatgaggcagtaattattttactcagccttcactaggagtggtgtacaggcaaattagaggagagatgatccagtgatttttttacttgccgtacaatttttttactcattaagcgttcacatcaccagacgagtaactttttaactcgggacaaatgggatgggaaaagcctttgcaggcggtggtagtagtaaaagcggtccatgaggatgcggcacatgagaaaggcgagaaatccgaagttggacccagaaaaaactaaaagccaggaaggcgagcgctgagaggcgcgctacttccttcgtagcgccaccatgtgcgcgcgcatatatatatatatatatatatatatatatatataaaatatttacaaatagggagagaaatagaatttacaaagttattacatcaccgtgtatatccatgatttccaaataagtctttctactttcaaataggcccaaactatctcaatatttttcttctttcataaaatcatatcaccttacttttacatttaatcatcattctatatactattaaaattaaattatcataaaccacgttaacttacgtaatcttatgttatgtacctatgttacacattgtttttacttattgttatcatactaagctcccgcaacaatgcgcggagtttcatctagttgtcttgatgcgtatgtaccagcaggagctaaggagacgacgacgaaaacgttggttggcgggcagccgacgtccagaacgattgggaagagggagaaggggagagagagaggagaatgaaagtgctacccactgacatgtggggcccacgtgggtcccatgctaagtcagcttgtcacgtcagttaaaaccttacacaatactacctagatctcaggtgatccagttttataaattgagagatcggttatatctgataatttggtttagcaatgaatttctgactcggtgacaaattaagggatctaatgtgaaccgactccattttaaatcgagtgaccaatcgtagagtccctccgttccgttgtttcgtgaggcgtgcactcgtactcggtgccgaaagcgtccgctcggccacatttaacccaccacagcaccacggcctaaagaaactattttgacttccgtcggcccagcactcaagttaattaacgatttaccgctcgctgcgcggaaaggaataaagtccatcagaggtccctcaacttgtcaatgaatctgattttcatccctcaaacggaaaaccagacacaacgagtccctcaactatcaaaaccggcgcagattaggtcccttagcggttttaagggtggttttggcagacgtggcgtctacgtggccaattggactcggtcttcgtctgacgtggcattgacgtggcgcttacgtgacaattcgatcggaaaaaataataaaacccgtgggacccacatgtcagtttcacattaaaaaaaggtgggacccatgtggggcccacatgtcatactcacagccttcctcttcttcctcctctctccatctatctcccctctcctccctcctctcgcagtctcgccagccggcggagataacgacggcctggagaggcgtgacctcctccgctttcgcccccttgagcctatcgccggcggccgctgggaaataagcagcacacgagcgtcaaccggagggaggagaggagcggtgcgcaagctctggcgtgggcaccggccggaggaaggagaggagcggcgcgtgtgctcgcccggcggaagtatagaaccacgggcggaggccaaagggagcgggagaaatccgcgacgcgctccgcgtccacatgctctgtcacggcgccccgcgcccccaccgattcaccacctaccttgtcacgcgcgtcaaccactgcctcccccactcgccaccaacgcctctttattctngagggcgatggcgggctcgagaggctcctcgacctcctcgacgcgggtgacgccggcgtcgatgcgcggcggcngcttgagcgcgacgacggcccggtcttcgaggccgtagagacggacncggagcacgncggtggcggcgcagagggggggcncgncggtggttcgncgaagncggggcgcgagnaagnagnanagncgncggtgcgcggtggaggcggggcacgaggaatgaggagaggcgacggtgcgcaccggcgtcggggagacggagcttgatctcgacctccatcacgggaggcatggaggagagggaaggctagggtttggggttgcgattgggattggtagggaggctgatgcggttggacttggagggcgcggcgccgggcagcgggtggaggaggaggttggagttggaggacggcggggtcgtggtcggagtggatgaggcagtgggtgtgctggctgccgcggcggcggcggcaacgtagaggtggtcttcgagctcgtcgcagttggaggtggtcttcgcgcgccgccgctccggccgccgtcgccccacttcgcccgctgccctagtgcacatcgtcaagaagagagagaggataacgggaagaagatgaggggtaggaggatgacatgtggggcccacgtgggtcccaccatttttattattttgtatgtgaaacagacatgtgggtcccacatggtttattattttttcggatcaaattgccacgtaagcgccacgtcagatgaagaccaagtcgaatttgcgacgtaggcgccacgtcagccaaaaccaccatctaaaccgtcgagagatcttatctacatcagttttaatagttgagggacctgttgcatctggtttttttggttgaaggaccgcgcggaaacgtcgccggtagaggcgtagagccggtagatttgtgacgacgtcttccgcgccgccagatcggcccacttctcatcttctttattgtgaggccggctccatatatatcatatttatggccggctattacatcttcgattcctcctccccaaacgcaaggcactttccttctcctctctctctctcgacgcatcctccaacttgtgcacgtcttcctcctcgatctccatggccgagttccttcgccggccggagttttgtctgcccatgcacatatacacatcacgcggatcgaagatgggatgaacgtacgtggagcggtggaggtgcaaccggcaggcacggtggcatctcgatcgatctatcgatcgatgaggaggccacggtggcgtctcgatcgattcgcgacatgttcgccgagatctatcgatgaagaggccggatcccgaccgtgatgcgcgtgcgggcgtgcggcgtcctcggcggcgccgatatgctttgtggtcgggtatggatgttccgtctcaacgtcaacatatcgagctaattagtatttctttggacaataatggcgatggagatctgtgctgaagctttccctctctcaaggtaggttatcaagtttgtttgcatatctcggagctgatccctatcaacggaatggatttttgtgtacaacgacgagggagaagagaatcagatatccagttccggtggcgttcatggccgcgagatccggatccggactccccattccacagtagccctaactagttgttcaatactctagatctgaatcttattatcacccttagcatgtttccattaaattttagcatctccatgagtccatgaccatgccggtacgtgcatgcagtagagtgccgccgccggtgtactgcatgcgcagtcgtgttcccaatttgctccacatgtgccttgctgccattgatgacctcgaccaccactgtgagctagtaattcaaaaggcatcagcagtgccgtggtggtgggtggtgtgagcttgaaaaggcaaatctcttcgttagaggtgggcagcatgcgtggtgggggatgggacaggggttcagcaatctttgtcctcttcatttaatttcttactcctagctgttagtagaaattttctttaccaaatttgtttttgcagattcccaacgctggagaaatcttactgcgcagactcgagagacaccgaacgctcgcacaacactaattggatcactgaagtgcatttttcaaaccgaggaagcaataaactttggatctctgaagtggcaaaaattaaaaaaagaattcgttctctcaatctcagaaagagtcttgggcaagcaaggttctctagctcaaccggatgtatacatgaacaactactcaaggttagaaacctacttttttttcctcgaaaacacattagagaattgttcctcatttaattaagaagaaagataaagaaaacaaatacaaaagagagaatataaactgtcctccccataaatcacaaccacccatccatacaccaactaaaaggcgcgacgcacaagaccagctctagctgtccagattaagcgacctacatatagaagcttatggaggacttgggctccagctaagcaccacaaattactctcattttttactgctctaatgcttgtgctaattttggtgctaactgctacagttttattcgctcaactatatccatgctggactttctgcagaatcagttaagtttcctttagtttttcttctgtatgtatgtactccttaagattttcagaaaaggctacattagttagacctgttgtcaattaaccgtgtgctttttgattcttcatgtagttgccgttcccatgtttgttgaagaaactatcgggactatgtttcgccatactcctatacacacgttttgctggatatataagaaaagggacatgtcagttatcactttgcaaaggattcagatggtcttcggcctaggaaggtacgttctacggcctttttctatatatttattctatttttttttcaattacaaaggctagaactcccaaacccaatgacgaaccttgcctgcctgcccttcagagggaagcataagttcagaaaatgccactctcaaagacatgatctttgggataagacagttgacctcccatgaaacactgaactgtgcaaagcgaaaaaaacgacttaatgaaacattattgttgactcagagtacaacttttttttatatcaagggacttgaaacacagccaaattctaattgaagcatttttatatcagacgtgaaacatatagctctaactattgaaacattacaaaaagtatttgttgaatacatccagaaaatatgttgtgcaacatttgatttaactgaaaattaccacctccactaacctcttcctcaaacaccgcccgcggctatgccatcatcaccaattctccttcaggctttgttccgtttagaggggattgagggggaataatttcacaccacaataggtgtggaataaatcccctccaatccctttcttatgggggttaaccgaacaaggcctcatagagcatggccccttacatcaccccacaccccctttttcctagctcggatctatgccattatggcactgagctccctgtcccctaggccaccatcgtcagttgcttccccttggttcctcccttcgcctaggtcgctgtcacatactataccctgagccctccccccctctcccgttctgcctatgcctatcttgagcttccgcactccggtagtgagcaacggtgtatcaaggaggatcatcatgatgagatgttgttgcattcctatgtttgaggagggagcaagaaaggaatggtgagatctggaggtagcaaggaaggagatagagtaaagctgagagtgggggggtgtgagggtgcccagtctgagtggttatcggtgtgctcagtggcgaacccagaacaaaagttaccgggggtccaatacatactaattatctaattattgactaatatattaattaatatagtgtaatttatataggatttgaataatctacccggtatcttgtgacaccggatagtataacctaggcacgcccctgggtgtgctacgggaaacattttctgaatctttgaaatgcccactagctctctctgtgacatgcatgcttggacccatattcaacgagacttggatcattgtttcgcttggacccatatacttgtctagtaaatgctataaaataaacaacgatgaaaaaccaaaaaatcaacttcaaaattaaattttagctataaaataatccacgatgaaaaaacacaaaaacatatttaaaattaaattttagcttataagcataagtataaatgaaacgaaatagtggggattgcctacagtgttgctggtacagtagcagacattgatattcaacagtattgtagaggatctacatccgagtgcaaatctctttacttgtggcatttcctttcatctcccctccatgtgccttgcagccgtgcttcagctccaaagtagcgagattactaagtagtgcatgtgcgctagaaacatatctcgcgcgcacgtggaaacgcggagactggggtggagacgacgtccttaccgtacgggatgtgtacgttgtacgttgatcattttccttaaaaaatgtaatttttctttctttttttttcaaaaagagtgtcaactccttttttttaaaaaaaatgacaacattctattgaaatatttacaactttatttaaattgaaaagtaaaaataaaattaattaaattataaaaactttcgactcaaatttcaaaaacttttgacttaaattttgaaaactgtcaacttaagattttaaagtttttttactcatatttgaaaactttcaacttaggattttaaagttttttactcacttattgatttgatgaaactaatttagtattataaatattactatatttgtttataaacttagtcaaacttaaaactgtttgactttaaccaaaataaaaacgtcttatgacctgaaacagagatgtcacactagcacgacttggcaataggcaatagaagcacgagggtggcgacaagcaaggacgacttgtctcaaccaaaggctggaccaacagcacacatcggtctcaatcatccacttgtgcgtgatgctctaaaatgatgcaactaaaaacaacttcacaccaggccaccaggggcagaatattattagaaaaaatggctttgccacgtattagaataatcgattttgcaactcaaggaggacctacagttttttttttcagtcgaacaccctactagtagtatgctacataactccttttcgaggtaaaatcccctagcactgctgatcgtatgatgcgacagcttgtgtagtttcctttaggaggatcaattttgcaacaagtgaatggcatttattctttcgccacgtatatgcgcatgacatgtggtccctggacctgattgtcatgtactcgggccgtggccacaaataagcaaatgcgactcaactatataaagggtacaagagcacatttccttttcgaaaatggcacgatacgtaatgtagaatgatttcctgaaaccaaaggaaggtatttgtgccaacactcaattgccctgagtatttagggcagtcctagtggtggtggagctagaaaatttttcatggttatttatgtagatttggatggatttatatgaaaatttaagagtctaaggatgaatgcgaaaaggctatggagtcagctcacacatggcagcgccaccaatacatatattactaatcaaatgtgctaatttaatatcacatctcttacatcatgttttcgatactccaggtctcatgccaaacataattccatcatttttttctcatttagtatggagccttcgatgtgcatactccatgtagttgggttcccaaacggggaaaaattctccacgcgtgcatcacttctctttgccatggtgctcacttgtcatattgtgttttgtgacacgctgaggtgctgataaaccttcttttgtgacgctgaattatcatacacccaaccattcatttcattttacgcgatgcgagagttggttttcggccgccgggatgccggcccgtcccacagtgtgcagcctggcctgagttggatgagaggcctggagggcaaattcccggtgcacatcagactacccatcgtctcgtcctcttgctgtctagcataaataaaccaccaaccaccagagccctagcccgtaggcgccgtcacacgagaaccctcggagcctcagccgcctctgcgaagtcgagccaaggagctgcgccggcaccgcctccacgcccttccaccgccggctccgtctcgttggtgccctttcgtcctccggctcttgtgcaggtcgctgccgcctcctctccacgcagatcgagatttggctggtaatatactgctcacgcgaatcttgcccttccgtgtttagattagattgaagagtgggagaccatacaattcaattcttagacgtaggatttcctacggaatcaaacctagctaggaactaggaccaatacataaatggaacatattattttagcctgcaatatctcataagctttgtcaatcgtcttggtctcctgactctccatgtttcgggttggaagttgccttgcagtcaccttgcagcgcaacagggtatttacctccacccgtaattgattgatgaaattgttcttcgtatggacctgtccaataacaaagaaaaacatatgcatggttgtctacaagtgcccatgttgttgcagctacccttgagtataaattgcactcccatcgggtagacacttctttccaatactgtgaatacattagtgggtctgtcagttggcacagaataaccacccactatgtgcgcccagtctttttgtaacagatcaataaaaaaaaaagatgtggacctgattcagcttagtcacaaaaatagcatgtggaatctttctgacatttccttctaatcacagtctttattccttttaatgatgtctttagttaatgataaatgataaattgccaactgtaaattttcattggtcacatgctctccaatatgctgtgctggaattgcttctacctagtcagacttgtaactgtaaatttcaatgcgccacatggctgaattgcttatgttcatagttctctggtttgtctgattaaggtttaattatctgtatactatttcaatagatggcaccaccagacaatttctccaatgcattagagagatgggtataccgcaactgtgtcagctctatcgtttgtgtggagctccgaccagaacctaatcttcttttagactggcagaatcatttgtttcctattcctgatgatccagaagcggatgatcagcttgctcagagggtggcggactgcctagtccccgtgcattgccctggtttcgtgatagaaccattactacaggatcccttgcatattcatgtgttgacatgtgcacatgcactaggcccagtgttcaatgccgagcagccaatagatgtagacgatattaatattctgtatcaacctcatattatctgtgaccatatgtagcaagcgtacctgaatgagctccagcataacaatcagattgcgagggagtatgtaataggaacagtgcttgccattgactgtgctagcgatttacttcttattcagagcacaagagtccactttatgttgcgctgtgggatgcctcaccccccattacctattgcttctcagtttcccaaacctctcagtaaggttgtcatggtctcttggccacatcctacgaggaatcggactgcagtcactggagagatctcacacccgggtcgacagtttgatgagttaagcccagtgaatcctttgggttttacaacgatgctgtctgaggttcaaattcgatcagaacaaggaagctccggggggcctttgctgaatggtcaggttcaagttacgggcctcttgcatggtggcaatggcagtttttcattcttcatttctcttccgaatggggtaaggcacaagaacgacctaccttctaatgttcacatatgtttcctaatttaaattaatgcctattatataagtttctaatttcgattgtttgtatttgtaggattccttgtatgatttgctggccctgattcaacattgctccgccccctttacctctttctggatgctgtgtgtatgggtgaacatgctgcgacttttttgagatagttgcaacttgctctacgtttgcgatgatctatgaatttttggtagaacctactttacctgtctgttcctggtaaagatgagaattttgtacctaagatattttccttaagctcaaagattcctggtcctgtttgaaaatgatcggatacggttatatcttaaagatgagaattttgtatctaagatattttccttaagctcaaagattccttttcctgtttgaaaatgaagatacggttatatttgccaagtccaataatggacttcgttatgaagttgtgcacgtgtatgtgaggctggatgtcagcatgtgtggttagtcgttgaatttcccttgcaacttcctctgcgttttatccgatgttcttgatttcttattcctctgcattttatccgatgttcttgatttcttattaatattttcactttgcaaaatgacaaaaaccattctagcaataactgaacaaaaagaaacatgaatctgcataagattgattggttccacagctgtgggaaaagtagaagccggtttggttagagcagctgtgaaactgtagatgtagaagaaatacatgttatgaagaaattttaagcataaataattttaagcattcgtgatagtacttgacaaactgaaattgttcactatttggcaacttagaagtataaagcataaacatgtataagagcaatcagattgtgacctcaccaaagctgctatatgttgtcagaaaccaaagatatatagaaaatagtactgattgataaagcataactttagcaccataggtttcaattttatgcacagtagaattaaagtttgaatgtaaaaaaaaatgtattgcactctatatttctatataaattatagaaaatcatagaactgcttggcgttggcccggcagtattatcaattgattgattctgattatctagaaactgtaatatagtgagtgtaaatttcatagtaattgatatagtctaatattttatcagaagttgaagcagcctaagtatcagtctacaaaacaatgcaatctatttttgtgtttttcaacagtcataagccgaaattaaaaaaaaacagctgcattgaaaatgaacttgtcatatatatctatagtcataagctactctaaggctcagttcgtttgtgatggttcccaacctctcattctcgatttccgcgcgcacgtttttcaaactactattttgatgtgttttttgtaaaaaagtttttatacgaaagttgtttaaaaaaaatcatattgtttcatttttgaaaaaaaaaattagctaatacttaattaatcacgcgctaatggatcgttccgtttttcgtgccagagccaaacattcccaacctgctctttcgaacagagcctaagttattacaaaacatcctaagtatcagtctacagaacattgcattccagcctatgttttccaattctcaaagaaacacatgaggtgcttcaggctgaatgttttggttcaagatcacaaaacacatgaggtgcttcagtctgaatgttttggttcaagatacctttcggcggcggaggaacgacggcgtggctccatatcggcagcggttgaggcggaggccgaggaggaggtcgccgaagcagtttgtcggaggagaccggcgatgcgtgacgattttggtagcggagggacagcggcggcggcagtgatgccggttgagatggagtccgaggagacttcagcggccgagggacagcaacgggagaccggatcggcgatgttggttgaggcggcggtggcaggtagtcgtcggagaggcggcgaagaaaaaaattccagatctagaagagaagctatggttaacgcaagaaaattcaagaaaaaatgggtgggagatagagggatgatggtcatttcatattagcttgtacattcaaactaattttattctgttcacttataaaatcatatcaagagatttttatgaaatgaccatcagacttcataattgtaacgccccgattttcgttcggaattaaaaattattaaataatgcattttctagaaattaaataaaagttaaatcaatttaatcaagtgaaataatgggagtatttgaaatttcctttaaaaatcattggccgagaatattttgtaatattttttgtgccctaatatactctccggaattttccgtaaattttcggagctcaagaagtaattttaatagcacaaagttcatttaaccaatttaataaaaaaaacaattaaatctcccctccttcactttgggccacttccggcccaagaatccttcccctcccccgtggcccgcgcgcccctccccctctcgggcctctctctctctccccctcggcctgctcgcccttgaagtctaaataaccccctgctccctctctccctcaggccgacaagtgggaccgcgggatccacttgtcaggtccatccccaaccttcctccatcccggccagcaaccgcccgaagccgccatgccgcccgttgccgcccacgtcgccgccgattccgggtcctcccgctcacgccctcgcgcccaaaccaagtaaaatcggttccccaccacctcctccaccttttcccctacttttccccaatttttggcgccaaattgagctccacttcgcccacgtcggcgtcccacgtcgccggccggttgccgcccgatcccgcctctcccggccacgatctccatccccgagccctatataaagcacccccgtgctcccctcttccgtttcccctcctcgcccgagctccccgtgccctttcccgctctccccgcgtcgctacctctctccactgtcgccggcgagctccagccgcctctagccgccgctcccgccgtccccgcgccgcgccgcttgtgccgccggcatcgccgctccacaccgcaccccggcccccacctttcttcccctaaccgtcgccgaaaccccaccgccaccgccgacccgagctacatcaccgccagccacctccagccgcacgccgtcgccgcctgagccgctccagcaccgtgccaccaccgcagccagttgcgccgccgcgagagcaggcctgtccgccactcttctccaccaaaacggctccgcaaggacgaggatgtcctcggccgccgcccctcttcaccggaaatccgccggagttccccttcccttcgcgcgccggtgagctcccctaattccttcgccttcggccggtttttcccgctgcttcacgccttctcccatcctcctaaccataccactgcattccccatgtccttgcagccgccgtccgccggttcccgctcgcggaacgccgccggaccgccgtcaccgttgtctccccgaggagcgccgccgccttcccgtcctcaccttgtcgtcctgttcgctcggtgagcatccctccctctccctctatctccccttcgccggtcgcccgcgttgcgccgccgccgccggtggccatccggctaggccgtcgtcgccgccgttcgccgccgctcggccggccggtctcggccgcgcccgcccttccctgtggccgtccgtggaccggcgtggtcctggtccacggcgcacccgaggtcgcggtggaccgtgtccaccgtgggccgcccccttgagccgctgatgcctggggcccacctgtcggcgctggttcccctttgatgacgtcagcagcaggcctttcctttgagaaattatttaataattgcgtcataaatcaataataattctagaaattcatataaatggctcaaaacttctaaaattcatatctaattcattcgaactccaaattgcgccattcaacttgcaaaattcatctaaaattgagttctacatgtaagtttactttttatgtaatgtttccttggtttttattagagtttttcctcattttgcgtgccagcgtgtagaatccgtcgttttggaagtccgcggtcgtgaggaaaagagttcggaagatcgaagtgaagaagcaaggcaagtcacacattccccttgagcattttgatcctaatttataaacgttttaccgtttgtaaataaacatgcatgtcttgctaattacatgggatccgggtattacctatctgcttgcttatgccatgtttacttgatatctgtcccttgtcaatattgggtaataaatcgactagctcatgttacttatgtgacctagctagaactatatgcttagccatgcttaattacaactagctcagttgatatgataattacagtattagacctttttagtatcagaatgagctgcgtgctcgagacatctggccatgcttcatggtcgtaattatccaactaaaatgcgactgtatggtgggctgtgggtgcatggctttgctaatcacacccatggcagttaaggaccggttcgcgggaaaccctggaagaattcagcgtacttaccccaagtcagcgtgggcaacggctgggcttgtagtgtagctttcctctagctaacgcatccaggcaagggtaggcgtgatggagtttggatgggccctgcgacggcctatgcagcttccggattcacctaggcacgagaggggactgcccgctgccttgcgaggagtggggttgaaacctaaggtgtggtgtgcttggttagagggggttatgcgaaaggtcctgtcatggcctctttccggtatgtcgtggtggcatgtcagcgcacggtaacatgtcgtggggctgtgtcttgtgggcagttgtacacctctgatcagagtaaaactattcgaatagccgtgcccgcggttatgggcggtcgaccagattcaccgtgattagtcccaccttaataaatcgactcaatgcactgtagttcaggtgttttggttgggcctgttcaacgtggtgtagcgttgatcagtggagatttaatgctactttaattactcaacagtgttactgttttgctcaataaaacgttttacaaccgccttttatgcaaatagcctcaaaccatccttgtattccccttgcacgtctgcatcgttggtgtggcttgctgagtacggtggttgtactcagccttgctattattcccccttttcagaagtgtagtgcttctgagctgaagacggagttagaagaccaaggctcagaccccagttgagttttgcctgtggagtggagctgaagccccgctaggatcgccttttttccactgttgctgcttttgtttcggtgtgaggactannnnnnnnnnnnnnnnnnnnnnnnnnnnnnnnnnnnnnnnnnnnnnnnnnnnnnn

SEQ ID NO: 15496 - DNA, 1734 bp, Oryza sativa
gttggtagaggtggccaaacgggccgggccaaaacgggcggcctgaggcacggcggaacctgtagccggcacggcccggcacggcctgctacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccttccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccgtgcctaacgggccgtgccgaaacgggccgtgccggacccgtgcccgtgccgtgccgggccgggccgcccgtttggccacctctaggtgttggattggatgattttgaaccattagaacaaggtcaatagtgccgcccgctaagggctgcaaaaatgaccacatcagcctcttagagatattgctaagagctaatgtatacaataagcatgttcacatcgactattatctatttgtttaggccctctttgtttaggcttataagccaacttataagttgaaaagtccaagccaaaacaaacaagcagctttttcatttggcttttttgaagccataagtcactctaacactattaagccaaaagctaggttagagaagttttttttggcttatatgaaatagatgtatgactccaccactaaacttgggacattaaatccactggcttataaatcatataagccaataagctgacttaaaagtctagaccaataagcctgagcctaaacaaagagccctctttagctagcttccccatccaattttttaatcttgttgctgttgtttcatcctgcatcgagtcagctcacgtgggcccacaatcgcttgtcccaatcaaagctagcctggtgctgctgcacttgcgttgggttgtgtgtgtagccagcgacaatttagtcgcccactcgtcctctctctcttgtgcaactcatggacaaatctgatatgacagttttatcgccggctaaactagtttattgtacctgctcttagatgtgtaataaaagcatttgttgagctgtatggttgatttacatcctaccgatctagtggctcggattcatctatcctataatccaacggtgttactgtgcgcacatccatctgccccttccttccccttctgcttcggcccccacttctgcaacagcggcgcacactccttcggtatcgtatcgccccccacagtcccacatcacagtcgcctcagcgccgccggttctccctaccgctcgccactccaggcccactccccgttgcatgcggccagtacgccgcgacctgcgctcctcacaccccgccgccgacacgtcctttcccctcgccgcccccgatttccacctcgaactccgtcgccggaatatcgtcccgccgttgcgcccgcctcgtcggtttgggtaccgagctcgaattcgccctatagtag

SEQ ID NO: 15497 - DNA, 13441 bp, Oryza sativa
aatatcgtcccgccgttgcgcccgcctcgtcggttttctccgcgcccctgatctcggtctcctccgcgcgcccaccggtaagtttatgcctaatgttaacgctgtgagcctgtgactgagatctgaagggttgtggtttccattatacaagagccattaataggtcttggttttttggggataactggtgggaaacgaacaatctttctgtacagaaactatcttgatttataccgtttccacaattccaattgctgtgtcgtttgttcagtacatacaatgtttccacgaagatcaggttgtggaatggggtgaactaatacatttggattggtgagatcaaggtgaatggttttttttttcagtttttttcctatgataaatttgggatgtttctcatttaggtgagatggttatgttgaactatattgtaggcaacactgacccttttatccttctcaaaataaatattatggaagctaggttgtatcattgatttattctggtgtgtaccattgctgctgtgggcagcagtttgctggttactggcagaagaaacctcataaccttgtttgcctatgtgctcaatgatgtatagttgacaccatcctccctgccgtctccacgcgtcccaccgcgccgcccccagtctccgcatagccaactgcttcctctcctctgcgcgtcatcaattgcctccactccacctcgtcaacagcctccgcacgcccactggtcccggcctcttcaacaacgtctcctgcatcaacctgattcaccggaaggtacaaatatcatcctccttccccctccccccctctctctctctttattcccatctgaaagaatcaaccaaaataaaacaacgagatgcatcattcatgtatttgatcattttacgttttcatttttaagtgcgactatccaccctttttgtttctaaagataagcgagggcatctatgcacactttttattttacaaaataaaaaaaacaatgacaaatatcatagtacattgagttgtacttcactggttctttgacgaataagtgtatgatatgcttctccataagaatggtgctggtctgcactatacttcttattaaagtcgattgcccatgcaacaaagttgcctgtatgggttatctaactcttaaatcagacaacacctattagcttgttgcacatgtcagttgttcatggttatttaattcaaggttacttaaatcttctcctatggcctttagtactgtcatccatattctgctgcagcttaactttttttcttaatatacatgtattatttacaatatatttagaaatttagtgccatgggactgactgcactgtagaacgtgttccttcgtgcctggtagtgctactttatttctcttaactctctactttgtgtgaatgaaaattgtggtggaatattctttttttagatgaatggaaagctatgtatatatatttgcttgtacaacgactgtcgtatgaaatgatatttatgttgttggaggtagaggtaaaatgtgtaataattgctgcgtattttgttgtttattatgtactctgaaagagtggataatgcaattcgggagatgaattgagaaatgaatttccaaatttgattgcatgacgtatccaatttgggaaatgaattgagatattactcctttgttcttatgtctgaaaccatatttgtacatgtcggtgaaaatagttagtgtcatgcatatatcatcagtttccatgggtcagtttaggttttctaagtaatcatcaattacatcatccacattgatttggtttttaatgaattttgctaccatttatgttgatgtgatcatatccttcttacacttagatatttggtctttgaagttctgaacataaaggttctaaaacaaacatgttgctgcttgaataagtggacaggaacaattagctcttttaatgcatagaaatacccttgaacatgtgaaccttattgatgatatggaaattggttattcccttattgatgtacacattattgtaatatgatacacaatatcatattattgtacttggcgtgaaatacatcttatgtacgacatgaattgagttaaagctcaattgtttagatcatagaaaaatattttttctatcatgaaaatttaatagttattaaagataatagaattacaccgtagtgtttagcatgtgcatattactagtctcctttgacaactgcaggatatggcaccgacgaccatggagaaggttggagaggtgtcgggatcccggtcaagggcgtagcggcggcggcggcaacgacaacgacaacggcaacggcgacggcacagcccgaccaaccgggcaggggtagctcaatcggaagctatggcatcatcgcaacaaggcgagaggaaaattcctctggagagaggcacgagcgagccggtggaggcggcggcggcgacttcacttggtgcatggcatgcctcctcctccacggaggcctcgtctgtggtcagctctcccatgcgttggccctctgtcccagttatcaccaaaagaccgcgagacgaataaaaaaaactaatttcataactcgcctggaaaccgcaagacgaatcttttgagcctaattaatccgtcataagcacatgtgggatactgtagcactttatggctaatcatggcctaattaggctcaaaagattcatctcgcgatttacatgcaaactgtgcaattagtttttctttttatttatatttaatgcttcatatatgtgtccaaagattcgatgtgatgtttttgggaaaagtttttggggaactaaacatggccatagttttatcgtgtttttatttttggaacttgtctcaccgtgcacttttgtaacttgtctcactgtgcagaacgtcaattgaagcttgtaacacttgaccctcatgttcctcgctcgtgtatgggaaatcaaaatcttcttcctgttcgtgattcttcgaccaaaacaattctagaaggagctaaagttgttattagcctttcatcttatgttggtatgtaatacactgcctttattttgtgtatattctgttatttatttttgctaactaatcattgcttttattgcgtgtttattttatgatttatttttcctaaccaatcattgcatctacagatggcacattaatggcacggtcatctggttttttcatcaattgggatgaggagagtaaagtgtgcactgtccttacatctgcacgtctaatctgctcaaagtactcatcgatggaccagtggttaggttcagatgagtattcacctgatgctacggtgagttcacatacaaacttaactgtagtctctttgttagttgacatacaaagtaataatggtcttttgagcttaggtttttgccacacacaaataaatacatgtctagcacacacatagagcacaacactttaattagaaagtaaaggaaataatacacttttgttaaataatgtgatttattcttaaaataatgtaacacatgtcttttgcatttgtatttttaggtttacgctcacttgctagataaagatgagacaactgtaccagcagccttgctacattatgacaggcactttaacattgctctgtttaaggttgatgtagactcatgtgctaagattcctagtttcagcagtgaagtgacttgtggtcaggacatatttgcccttggtagagatgatgatttaaatttgactatcaatcatgggcgtgtccaatttaagggtccaagtatgtttgagcgccactactatatgtatactggtttcacgactggtcaggtataaatatcactacgattatcttataaattagtattaacttttgttgcttttggttctgatatcgataatttaaatattttagtctggcattggagggccaattattaacttcaatgggcaagttttggggatgactaatgttctaggaatgggatttattccttcatctgttatacttcattgcttggatatgtggaaaaagtttgggtaagtttcttttgctgcattatataatactaccttcgtcccaaaaagagtttaatttgtctatctcactcatactaataatatagaacaacctttaccttttcaaactcaaatgcatttcacacatactaataaatgataattatgtgtagttatatccctcgcttgcatattgggatgaaactttcagccatgaagtttctagatccaattcatgtggagaagatctctcgcaaatgtaatattgattcgggtctaatagttaaagaggtatatattgactgttgtttcttactttcttaaacaatccttacctcttttatcacatattgttggctgtacatgacaaattgcactataggtgtcctatggatcaaatgctgagaatagaggagttagagctggtgatatcattcaatccatgaattgaaagtgtattgcaacaacagtggaggtatttattattaacagtaatagcagtaaaggtgatttattattttgtgagtgaagtggatagaaaaattacactttatgatctcctcattaactcacacatttattactcttgttgctgctgtcagttggagattgaacttatgcaaatatgcgaggatcatcttgacaaaggaagaggcattggttccagcgtagacatacaagtaagtttactttatatctgctataaatgtcattatgttggtccatagttacaagacatttttagcgggcagaccactaagagaggcaaaaaatataattataagatagcatttatttactacatataaaagacaggagcttttgtgacttctattttttgttttgatgagtgtttagtgttgctatttttgaatctaagatgtccatatttccattatagatgaatgggaaatgaaatattatatcaatagcagatgaaaatatagttcagaagccagatagaatgtaaggcaagcggaatctactaactacagtaccaaaggctagtctagaagagatacctgaacaaaccggagagaagagatacctggacaccaaaagcacatccttttcgccacaattctctgtcttccaggcatatcgcatcctgtagctgtcccttgtaggcatatcattaggagcatgaagtacattagcagaaacatgttgactagcagtcttgtaggcatatcattgggagcatgaagtacattagcagagacatgttgactagcagtatcacatcccatcatactacatgccaacatgccttccgattattgtaggagttcttatttgctcaccctgttcagcagctctactttatggcaatacaatcatggagaattatgagattgaattgtctttccaaagcagcctctatttcctgccttccattttgcccaacacaactgcctagcccagtgacatgtctctcttaacctttgggtaagaatttctcaacccatgaggaaaaacttgtagctgatctgggaatagcatcagcatgaatgaacatagcaatttctcttcaaacaacaggtgtagcacattcaaataagaaatgttggacagtttcaggatgattacagttaaagtatttgggatcacccagccatttcttttcaatattttacctttgtttaacagcatacctttttgtaacaaccacaaaaatgtttgaactttgacaggtatttagctttccatacgtgtgtaaaagaactatcaccataatttctcatcatctatatgaatttcactaaaaaacctgccttcgttcccccaagatcctgtggtaacatgaggagcaacagacagactaacatgttgcgcttgtgacagtacatatctcatttatcttttgggaaacctgttaaccatctcctaaaactttgctgccattggtatagcactgactcactaatttatccttgtcacagatatcataaatagcagatattattgagcaaggtttatcaccaatctatttagcctctcattatctgctattatcaccattacaatttacaaatgatgactttcctgcctttcaaatgaatgttttgatgaaccttaagtaggtcagcgcaacaagatgagtcatctaccttcctctttttctagtttccaccaacatttattaaggacacttacattcattgcctcagatttttaataccaagaccccctttctttttttgagtgacaaaatattatcctgtttgacctgttgatactatctttgtccaccactttgccagacagtgttcaggaataaggacatggacatacagtaaagtagggatgttggataactggcattaatcaaagtggccctgtcatcaatttacagatctccctggtagatatcaagcctttttattatttttctcatctactttatcctagtcacatgtgttctagatgcactaacagatgcactccaggtatgattggaaagtttcctaatcaacaattgaacatgtttgcataagatcttccccccataacacctcacctttagctaaatttattttgaaacctgtactcatatatacaacagaatcaccattttctggaatctatatttttcccaagttatttttaagactgagaattgtccttggtatattgcaacattgctatgtcatcatcaaataatgaggaatcaacccattattttacatttcctgtaccatcttatctatacgatcagcactgctttgcacctttctaactctggacatgtgtgcctatctggtttgttatttggcactaagtgtcgcattacacatgccgtttcaaccacccctgcctatttgggctaaaacatcatttttccaaacactagattactagacagggaatgttcatttgctttcttcttttggtttcatgtagagtctcatgttggggcatggtctcatctgttttattcctgttaatagaggcattttaggtttgtcttatcaatttcatgtaactatgtaaggctctaatctcaatgtcaattacaagttcatacaaataatttagcagatgggtccgccttgttgcattcagctatttgctcaacatgaccaacttttggaagaagtctagaagggtaactatcccataatctaggccactaacatcaaatttattgtcgtaaaactctttggagcgtttttttttttgtttatttcttcttcactaaaaggcttacccaattcaacattgtgaatgtttgatagtctctgccctgctaaatatattgggatcaaattgcctgcgctagccttaacaatccttacagaagtcattagtcagtagcatttctatctgagtttctgccccagtaataatttctccccatttttagatttggtattgttttcctttctactaccattaactatcctacaaaaatactctgtgtagttatcgcctttcctcaacagccaagtcaaatgtgttctttttgatcagatttatagctaaaggtagccatattttgggacagagggagtagtgcttatttttgcagctaaaacctcaacccaatctttgaaagcattctttctttttcctcttatattcgtattttgtcaataatatcttaacctgattggtttgtgccaagttctattaattagtcttgaaaatcagggtgttggagccaatacagctcagatttgagtttgagtgagctgttataactgagatctgctgttcctttttttacatgcatgcttacaatcccataaagaacctgtcaatttacaatttcatttttctatttttatttttactctttacgctgtaatttagggggtattagaatttaaaaggccctgaatcctcttcctaactttctgcaactttaaaattagatttattttcctagagcactatttttgtgaactcacaggaataaacttctctgcaccagagctcgagtgttttaaaaaacttcaataacttgatgaaatctcaccagagttctctcttatctgctaacccatacatctagcttttctcatgcatgtatctctatctgatatagtttgaaaggaatttgaggaatgtttaggagtacgttccaaatttctcctccttatcagtctttcagctttatcttgtcctttgactgggaaggccccctggctctaggtcctcctaggttgcccaaacattgacttgttttttctttccttttgtatcccccccttttttttacaaccttgtatacatcatttaaagctccagcatttacttcaggcttacctcaggcttcttaagatcacctttctatgttatgaccataccttcttcattcaacttcttgtcttgcatattgtctgcatatgggttcacatttttgcttgactcagcagttccaatcatcaccaacttcattcttttcatcatatatcttggtttgaatgtaatcaacaaaatcaaacaatttttttctacagtggcagaataatgtttatattttttatatctgatcaatcatacttgtttacttctagatgaagaggcttcattccttctttgagaaaggatccgtttagcatatcgcccatgccatcttgaccatatgaatcgttaggaatttgtccaactttcttggttttgtccctgttgtttgcttcatctatcacacacctttttgacctgatgatgcgcataactcttctgggcatttgtaatgaactttttcacaattgtggctaccagaattgttatgatcaacaagatatgtctcccactctgaccttagcaggagctgatttgaatttggtcagagtaggttttgggttatagcaagtcttttcaccacgtataaattttttaggctttcttctcttgttcgatatttttctcccttttaaccaccatctttatcatttgaattgtttcaatttacaggttggtatattccgcatgtgcaaaggttccacgtgcactataagtctgagattaaatatatcaaatgatgtagaggtgtttgcaagaggtatgcataaatcctttcaactactacaaagcttttatattatagtaaatgcatatggatatgggccttggttctgatactgttatatgattttttttatgtctggatatttacatgtgtatttccctctgttcgtttctatatgagggacataacttgacaatgacattatgctgtccaggcaaatacattttctctgcaagagattgtacctgggtgtttgatgatgtgggcacaggtatttttaactttgttttctctttagttgctaaatattaatttatgaaacaaagattgatacaataatctgctattcttcttttttgttgcacttttaggtctttaatttagatgatgaatttaggccctaatattgcaagatgtgcaaataacttcatttgataatgtattagtacattttatatattttgtgaagatgactatccctttaggaagtattaagttgagttgtcattcccatgtttctaaaaattttgacttttttgtttctggaatttctcttattggccagaatgatctttaatcttgtggggtagaaaaggcaggagagtacaacatttcactctcagccacatattccttatggctttctcaatctagctagttgattgttgcatttaactggaaaaaggaatcaatcttgtacatgatcatttgataaagaaattataaaacagtgcttgcttagtttaccaaaggacacttgatctagattgcttgttgtcattctcagccgtttgtaatttgcagatcttcaatcttgaaggaaagtgatgtgaccatggctaccacggatgcaaccattgctcacatcatggatgaacaagaagatatcaaggtcaaggcatccaagtgctggaatccgattcggccacctgctacactgctgatttcaaacggccgccaaatctccatacaagctccgttttcggcccgtgagtacttgatggaaagctctcggagtcctctttccaacggatccaacctcatcaccaaattccatcccagtcaaccgcagatgaagaaacaaggtgcaacatcacctgtcatgggcctttgggcttgtaacttcgtttgggaccccggcccaagtggggcccatgtgaggtgcgccccaaccaggtggagcacaaccctaggaccctcttggtcgttctcccacccttataagtagctaggtaccctttcagggtttctcgggttttgatagattaaagtttagccattgctacttacttgcagcgcgcgtgtcggctagaccgtccgtcttcttgttcttcagaaccccaacttattatttgtattaaattcctatttgcaatatcagattgcttttatgttgttcttacttgtttcttcgatttgcttgcaggaatagggttgatctgcaccggcaagatcaacaacccacggagaggtgtatcgatcgctaaggcgcaacacaacgtctcgtacagttgtagtcggatcgtcaacgtttctcccaaatcgtagttatcacaactcaccgaaagatcgagccaacaacagccttgagtgtcgagaggaactcagggttcatcagaaagcaacaaagtgatggagtcctcgtacgcaagactactgatagttcctaggtagtttatatatgtactacggagaccagggtactgctattacactggctgtggcctgggctagtggtttcagggctgttggtcgaagttaatttatgtaaactttgttttggctgacccatttgctgctgatatgggcactcgatgaaggtttcagaggctgttgcttaggtaattaaggtaagcttattttggatgaactggtagttgctgacatgaacagttgaacatttccgccgggcatgctttattgaattattgacggtcaaaatagctgttgctagtccgtttgtctttcccttggtcaaaatttgattgtccagatttgctgtattttttaaattgctggcaaagatgcttatattgataagtgtccatcttgtgggtggaattaaacatggtggtattacttagtataaacacgagttagcaaatactccctccatctcgatttgtatgatgccacaagccaatggagtgaacaatctaaaatgagtcaaaatgtatgatgccacatggagtgaacaatgttccaccatctttcccttctccttaaaccatggcctgatggcgtgatgcggagccgtttgcatttgcatgtcgctgccgtgattcctgaggccacctcgaaccgccttatgctcatggctcctcgccaccgtggtggcagtggttgacggcctcattggtatcatgtgatgtagccgccgtcctcgttgtacacgatagagttaagctggtgctatgtttgagagaggccatgctactgttgcacttgcatcgcttgtgccgccgtcgagaaaaaatcgtgcgcgttggcggcggctccccaatgttgtgttgggacttgggacagtgggcttttgaagggaaaaaaagtacgaggatcgtgacaattaggatagtttatactccctccgtcccacaatataagggattttcagtttttgcttgcaacgtttgaccactcgtcttattcaaattttttttgtaaatataaaaaataaaaagttgtgcttaaaatactgtagataataaaataagtcacaaataaaataattaataatttcaaaaatttttgaataagacgaatggtcaaatattacaagcaaaaactcaaaatcccttatattatgggacggagggagtacaattttgaatgtactccaattactatattaaaagttgaggaatcaagccaagcagaagtgtccatattgagtcatttgtccatttgcccaggcagcccagccaaggcaaaccaaccagctgccgctgctgtaaatactcctgcaacagtatttgttgcatcacgtacggataaatcaaacgtcttttttttttcatatctctctctgcttacccatgcgtactcatgccgttgtcttctcgcagttgcgctggtccaaccgtggaaacgaacacagtgaattcgaattcacggttcgttccgtcctcctccctggacgccaacccggtttgcgaccgcacctaccccaggaacaagtccgcgtacgtccgcacccgcccgctgcatgccacctatgtctgcgttattgcttctccgccaaatttaagtcttcctttacctaccttctccttgctccaatcgatctcgccggtatatatactgctccatctcgtcgctcgtctctcgcgttaacccctcgtggcctcagctcgtcgatcgatcgatctcttagtccgatctacttgcgcgcggctagctgctgctgctgctgcgtgttgggggtggtggtgcgaggagtgattggttggttgatagattgatcgatcgagcgatggccgtggcggtggaggagatcgtcaggagggccggcgggtgcgccgtgatcgacggcggattcgccacgcagctggaggcgctcggcgccgacatcaacgacccgctctggagcgccgcctgcctcatcaccaagccgcacctcatcaaggaggtaactaatcttcttttcttctctccccgtagttcaccgaccgggccgtcgcgcgtgtgcctgcatgcgtagtgctcgtcagctcatgccacgcttgcgccacatgctgcatgatgcatcttgctgtctcgtcgttgtcatggcgccatggattgctcacgttgttgcaccgccgcgatggaatgtgtatgtgccagctgagctgcgtctctgtttgttgttcggttgaccatgtgaaaagctatatattagctgttgccgtgttggtgttgcgttagagatcgatgcgattattccacaggtgtatgtgtgttcttcgtccctttggtcttggaatacaacgttcggttggtaactgtgttatcagtcaactctcgtttccttttcctccacaaaaaaaaaaagtaaacaaatcttaagatgtgatacaaactgtaagtcttgctgtcttggtcttgacctggacaagaacactgtaccttttccctttctcacctatggacctactaccgaccaaccaagttttttttcagatgtgtctagattgctttttggaaaaaaaaaagaaacaataaaagattacctactctgttgagtgcgagaggaaaaggtaggtaagcacctctgaattctctgaatgtcgaacattctcagagcattcagtttcatccatccttttccctgaagtaatgccatcgtttgactcaatttaatccattgtcaggatgactattctagtgtgtactgtgtacacttgaattgtgtttgttgcaccaacttctgataggcaggaccattcaattgtgtcaaaggg

SEQ ID NO: 15498 - DNA, 1476 bp, Oryza sativa
  unsure (1)..(1476): unsure at all n locations
tcagttcagcatcagagaaattatgcctccctttcttgtatctctctgaaggcaactatcccgggattctaagcaagaggaatgcttcttgaggaggcagaagggttactgcgaaggagcattgaattggcactggaagcacgagatgaattctggaagtcgacgctgaggaagtccaagcctgtttacaaccgtgctctggtcgccgcatccattgggagctatggagcttaccttgccgatggctcagagtacaggtaacttctaagattcagcactgcaaagccatggattagccatggatcggcacgcattgtaaccttaacctcgtatataatattttgcttgtgtcattgatgcaacattgtatctgacagtggatcgtatggagaagacatcacggcagagaaactgaaggacttccacaggcgccggctgcaggttcttgcgagcgctggccctgacttgatcgcgtttgaggccatcccgaacaaaatggaggcacaggtgaggctagtgaatctgaatctctgaaagaaaaacacagattgtgcaatgtgttccagacattcaatagcactgaaatgctgccacctttgatgtttcttgctgaaattggtgatcatgcatgcaggctttagttgagcttctggaggaagagaacatccaggtcccctcctggatctgcttcagctcagtggacggcaagaacctgtgctcaggagagagctttgcagagtgcctccaattcctcaacgccagcgacaaggtgaccatcgtgggtgtcaactgcacgccgcctcagttcatcgagggcatcatacgcgagctcaagaaggtttgcaccaacttccttcagcaccatcgactccatcttgcacacaccccaacattttctttctgcaccggttctgcaatcgtctgaaactctgaatgtgtttctgacagcaaaccaagaaggcgatcgcggtgtacccgaacagcggcgagatttgggacggcagagcgaagagatggctggtgagcacgacctgttacacttaatctgttctcatcactggcacgccaagaaagattagcacagatctgttctcatcactggcacgccaagaaagattagcacatttccgtgcgaattcttggtcgtcttgatcatcaaactgactggtttttttgatgcgtcgcatgcacagccggcacagtgctttgggcacaagagcttcgacgcgctcgcgaagaggtggcaggaggccggcgcgagcttagtcggcggatgctgccggacgacgccgtcgacgatccgggccgtctccaaggtcctcaagggcaagacgtcctattcagcaactcagatttgagaccgactacttggtagtgcaacttttaattaatagcgagaattataccgattcagnnnnnnnnnnnnnnnnnnnnnnnnnnnnnnnnnnnnnnnnnnnnnnnnnnnnnnnnnnnnnn

SEQ ID NO: 15499 - DNA, 6524 bp, Oryza sativa
  unsure (1)..(6524): unsure at all n locations
caaaccaagaaggcgatcgcggtgtacccgaacagcggcgagatttgggacggcagagcgaagagatggctggtgagcacgacctgttacccttaatctgttctcatcactggcacgccaagaaagattagcacagatctgttctcatcactggcacgccaagaaagattagcacatttccgtgcgaattcttggtcgtcttgatcatcaaactgactggtttttttgatgcgtcgcatgcacagccggcacagtgctttgggcacaagagcttcgacgcgctcgcgaagaggtggcaggaggccggcgcgagcttagtcggcggatgctgccggacgacgccgtcgacgatccgggccgtctccaaggtcctcaagggcaagacgtcctattcagcaactcagatttgagaccgactacttggtagtgcaacttttaattaatagcgagaattataccgattcagtattagtttatgctaaattttgcagcggaaattaccgtctaacgatttgtaatgctgatgtgcaaccatcgaattttatacgagcattagcatggagagtgttgcagaggcctggggatgtgatttatcttctttatccttgtaatataaggaaagtagcagccatgtatcgaatttatgagttatctatatatccaaattgcactgataatgcaaaagaacaagttgcgtgtcctattgtttttgtgaatagttgttgtattggcaatacttaattccaaaatccagaacatctacagtctagagagaagacatgtagtatgaaactacaatatgccaacaatttcaatacctaatgcggaccatgaaccaagtcagcctagtgctagtagatgcgctctgacttgccaactttccaagtgaacagaacctgaattgatgacaccttcaaaatgactgctttatctgatgttagatctgcagtgatccggccaacaatcaagcatttggatgactcaactggtgaatccatatatgaatacccaccatttgccagatgatctaatgtttatcaacagctagcaaaaaaaaatgctagttcacctgtctatccatccacaacacttattacagtgttaccccaccatgatttcctacgtacaggtgcagataggctacacatggcacccctgtgttcattctttgtaagccttctgaattataatgatgactacaacaactctacaagcccacatgaagaaggggggtggcattagccattttactgctaaaggttataactttgcaggattaccaagcgcatatacaagacaggggataactcagagaggatcctcctgtttgatttcggtgtcatcttctattttcccaactttagttggaaagtgagataggaccaaatgcccctcggaatacccattcatcaggagctttcctatctttgtcttccaatctgtgccagatctctcgttccacctgtcatgaactacccggtcacggtaattgagcattgtgccaagcccagaatttggtacccaaccatattcttccaaaacccgcgcctctccttccgtcaaatcttcaccaatctgtaaaaaatagattagttcaatgtcctacaaactccttttactcatgaaagaactcatgagtaaaaggtactgaggtagcacaaaattataaactcctttcactacggaaggtacatatgagattggaccgttgaagctaatgtcctatgtgaacatatatctggtgctaaaattttctaaaacgagaaatatattcttcggaggtatattatgaacgatatcacaaacttagttacatcagaaagaaatatagaaaaagagtcgagtgcatgaatgtatgattgtatccagcttcaaaactagtaactgcgtattctgatagaggatcctagaaacaattgtcaactggaaaagaaactaagaaaggctataacacagtttattaatggttaatgggtagttgtgtacttgtgttcataagcaaggatagaagacattatgaaaagctatgctggtaacaggtaaactgaccagttactgtaatgtttcaagtctattccagtttaccttttaaaaaaaaaatcttacaatatatttttcctcaaatgtaaccttttacaatcaccagcttcaagattacatacaacacatcaaacttcgtataattttacccttgtactggctttatcatatctattggtcacagacgatataccagtaaccagcatcaatagagctgattttttttcctcctctgatcataagtcgataatagggccttttactttgaccacatttctacgtacgttgacagtcaaaaagtgcagcacaacactgggaaaatgcaggggaaaaaaataccaaagcaagaaatcttaccaataatggcctattttcaatcagagctgtcctgccacaaccactaagcttcattgcagtaaccatcctttggatctgccattgtattggcagtgatttcacaatctcaaagaagtatgtcgcatacccatattccggtcgctcaagaacaatcctgtgaaacaaaaaaaggaaggcataaaggaaagaagcatatcaaccattttaaccggcagtacctgaataatagtattggctaagaaagattacctgttatggcttttaaaaataaaaataaatgattgcaggtctctacaccatccccattcaacaggacaatcacgaaactgaagatagcgggactacaagagataaaggtgtataaaacactaaaattgaaagcctcgtacaagtgagaaaataaaaatagcaaatgttgtctagatgtggataaatacctgctcgatgagagaaattaaacaggtcaagcagtatatagccttttcccccttctcatgcctaagtgcagatttcaacagggatgttctttgcggaaacaactgtgtattgaacaaataaaacatgtcagtaaactataacatacataaccaccccatgccatttgctcttcacaattagcccataatactaaagatgcagatgtagtccctcaaccttggggaaattaggccaataacctctaagtcatctgtatttacagacataacacaattcacactgaacttcctggtgacatgaccaacaaatgaaatcatgtaaaccaaatcatagctgctgtattgctgggggggagggtgattatatttttcagttgggaaggggaaggaaaacgcaaggtaactaacaaacatgcaaatgtttcctcttctgttgttgctgagtatggaaaattcaacattctaactactcggagagttaggaacagtaacaaggagaagcaagaacgagtccactaatacaacatggtcccagtggcagtggaatgcttctgaaaagatgatacattatccttttccttttcttcggcgttgcttgtcacatatgaagctggagcacttaaggtgtctttgtgaaagttttgcagtggtgttcgctacatcatgacaatggggaaccacccgtaggggtttactgcacaaggatcacaagggccctgcagaggaaaggcttgacccaggctagtagaataacctctacccgctaaaaatagcgggagtggtatgataccatccgaaaaaggtaagcaagtgaggcatatcagatgttatgcagattctcaacaaaccattttcaacatgtcaagtggtggggttgttgagatatttcaatgatatactgtacaatgtattttctttctcaaagacaaaaatacccattcttataagactaagtaccattttaaaatcttacttttgtaataacattttcaagatcttgaaagtcactttctgtgcagtctgggaccatatcatcttcttcttcaacaccgtagagtttaatctctttaaccagtattcctttgtccagaagaatctgcaggcacgaaagatacggaaacacagaatcagaagttggaatgaatgcttactgaataccgttattgaattaaaatagaactatgaacacgacaaatgggtacctgcagtagtcctggggcatcttcttcaagtgccgtttcaattgaatccctgcgtacatcacgtttgttatcagattctcaaaaatagttgtcaacattgacagaagttactcatgtagcatacgttgctgtttttctccttcgcctttgacgagaaaagtaagcagtaccctcatcatttctgagggaatcttcttcaagcgtcttttcacttggatccctgcatacatgatttttataagcataatctagccaaaaagagaatcagtgtgaacattaaaaatgttgcctgtgcagcatacctcagagtcttcctccttttcctttttcgagaacagtaagcaaggaccccgtcatggtttagagtattggtttttttggcagtgagctctgcgatactgatagaagtgagaccacacacaactagaggtaactcactcccggtaacttcgctttttattcgtgatgatggcagtaggccttcaacatgagaattctctgggttagatcttgctgcttctgatattcttttggagatcgctgaagaaacagagtttatagacccaactagattagagccctcagtgccatgatttggatctgttctctgtacagaagatgtaattttctctgtgaaatcccctgtgacatgcaagagttcaaaatcaatattgatgtcttttgggttttgacaaacatatgctggtgctaaatcaatcttccagaccactgttgtttaaggaatagtggtgagattttgctcaaacaaaattcagatggtaaatatcataaccttccaatgcaggttccaattttatgtcaaccaaaagggtcctatcatctgtcccttccaactgaatgtttttatccccaaaagttggtgttgaacttgaagaagggtcgcgactataaataagagtcttgccgtttaccaatagatcatgagagcacacaacttgacattgtggtggagcagcagaagatgatgtactcaagaaacctgattcacctgcagtaagttgtttatcatcacttgtttcagagtatagtaatcaatgctttcttcaccattgacatgtggaagtaaggactcgaattaaaaaagaaaaggagaagagatttacatccagcctcatgactttgctggttgtttgaaagaccttcagttagcaacctcctgttgttatcattgtcgatactacctataatggccggtgcagaagaaatttcctgcatataattgcaaacaattgaacagacccgtttctcgtttccctccctcccacagacaatgtgcaaccttgaatcactaaattcagttggcacaatgaaaaataaatttatatgttcttgatagaaaagctattgttatgcgcatgcttattgaccaagaatggaagttgtgataagtcctaatgaggcatcagggataacaaaggacatttcaaacatgatattagaacataaatttaatgcataaccaaaacagttgagaaagtgtgcttgtacctgcaacatgctatacataccatccctgaaggcagtcccttcatgaattctacatgcaaaattacaatatgaacttcatatcagtacaaaccttatatagagcatctttcttgaattacacttgtcaatgttcacatcaattcccaaaataattggagatatgttactttttttttctcttgcgaatgcaatcaactttgactttaaagttttactatagagcatccttctctatatctccatatttaggtaggattattaagaacttagtacacaggaaagtggatgtaccataaggacgggtgtacagggatttttttttctcagaaattatagctacctacattaaatgtatacattttctcaccccctcaccttttaggaatcatcccattagttccaggcttgcatgaattctccaaaccatcaattgcacattgttcagaagatactacagcagaggaagaatgattttctgccataagaattctgtagcgctcttgcagagacatatgatcaagctcctcgatttcatcatgatcattaatttggttcccaatatgcatgttgcttaccacattgaaataacttagtttgtccagattaggacatgtccctgtttgcgtctgcttttgcttgttttcattgcctgaagagaattcagtgtcatggtctatgttacaaaaaatgcatttaaaataaatggatgtgaatgaggacacgaaccttgaacagaactattttcagtaatcatattaaaagaatgattgtccaactgtaattcctctttggaatcatcatcgattgcagaagcaccctgcatagaatttcagaaacaaacatctagcatgtgttacttaaaattaattgttataaagccccaggaaattgagtgcctgttaacttcagaaagttagcagaaatnnnnnnnnnnnnnnnnnnnnnnnnnnnnnnnnnnnnnnnnnnnnnnnnnnnnnnn

SEQ ID NO: 15500 - DNA, 1029 bp, Oryza sativa
gcttaccacattgaaataacttagtttgtccagattaggacatgtccctgtttgcgtctgcttttgcttgttttcattgcctgaagagaattcagtgtcatggtctatgttacaaaaaatgcatttaaaataaatggatgtgaatgaggacacgaaccttgaacagaactattttcagtaatcatattaaaagaatgattgtccaactgtaattcctctttggaatcatcatcgattgcagaagcaccctgcatagaatttcagaaacaaacatctagcatgtgttacttaaaattaattgttataaagccccaggaaattgagtgcctgttaacttcagaaagttagcagaaatcaactacaatgaatgaaaactttacaatgagtacaagactagacttaaaaattaagcaataaataagataaagaaatgcaaaacagctacagccgaatatattcaactaaggaaacaagaaacagattgataccaaagaacaggtaaatgacgcaaaactaaaagaatccttgtgatcaagcataccagaatcacagtacctactctgagtagagtcaaggtaacattaattgcaaaagcagtttttacttaactagtaggatagcatccatgttcaagtaaactaaatgtgaattagtatgaaaatcctgcaaaagaactgaacagtgttcattggccaatggatcaaacaaaagtcaatttttaaaatcatgacagagcctctcgcaatttggttccaacacgtttaatataacaaattgctaatactaatccaacaaatgtagcttaaatatttgccttgcagtgtttttttacaatgatcagttaacttactttcagaattatttttaaaacaaaaaaaaagagtcaagggtgacagggttatctcataccatattaaactacaagaaaaatacaaggataagtaatacacctgtgctgactgagcgtgagatttctcagcccatttaaattgatttttttctaactcgtagaatatctttgacaccacc

SEQ ID NO: 15501 - DNA, 731 bp, Oryza sativa
  unsure (1)..(731): unsure at all n locations
gggtagtgtgcatttcaatctcgactacatagtgctgtggctttatttcaaaggacaccgaaaggtgcacacaaagtattcctactggtagcaactagcatacgaagaagctggccggcaatggcagacagttgctgctactttctgaactgacgataagaactaagtcaagtagcagatagccacgctctcaagctcatgctcgacctcagctagtgctacatgttatgctgcacgcctgcgctaaatttccacatgtgtcgctcgagcttcaacaagttttgcagcgctcaagctccgccttcgtagtgccgcctgcatttgagctcgaaatcaacttcggcgggtggctaccctgtgaaaggttttgcttcttgccttttcatgcactgcacctgatcgagaaagagaccttgagctgtacggagaaaagagaggaagaaagggagttggaggaagaagaagagagtctaaattgaaacattgtgtaaacatacccggttcaaagtgaaaagtttactttttcactggtctaagttacagtacaggtaagaaaaaatagcccaagatgcaatttactgttttttttctttccagttccagttctcgaaggctagctgttggcctgttgctgggtgctactgctaccttcttctcatgtttctcgagaagnnnnnnnnnnnnnnnnnnnnnnnnnnnnnnnnnnnnnnnnnnnnnnnnnnnnnnnnngt

SEQ ID NO: 15502 - DNA, 699 bp, Oryza sativa
  unsure (1)..(699): unsure at all n locations
aagtgttcatctcgaagttaaatgatgggtacccaacctgcaacaacagtgctttaaattgtacaagcagagggtaccaacagagtatttggcacatgcagtcgtgaacctgatgccattgcgaaacacacaaccctatacggtgcagatgcaagggagcccaattcagtcccagccattatctgtattgccgtacttccgcagggaaagttaccctctcatctgatctaccattgcatacatctcaaaaggaagtgagtaaaaaagaaaacaggaccaatcttcagagataagtttttgaaacctatcttcagagataagttcactcggcgataggagaggacctgatttggactcaaatcaggtgttgacgaatagagtagcaagagttttttcgacgggtcaagacctcaagggtcttaacagttgaactaactcggttatgatttggacacttggtgattaactactgataatagtactacttattgttattggcttgttacatcattcggtgctcaaaaatcagatgcaaatttagatgggacagacagcagctactagcaacataagagaattatgttcagtgtatcatgcatgaataaactctgaacgtactcacctggatccagatgcgagcagnnnnnnnnnnnnnnnnnnnnnnnnnnnnnnnnnnnnnnnnnnnnnnnnnnnnnnnnn

SEQ ID NO: 15503 - DNA, 398 bp, Oryza sativa
  unsure (1)..(398): unsure at all n locations
nnnnnnnnnnnnnnnnnnnnnnnnnnnnnnnntcacgatcctcgtactttttttcccttcaaaagcccactgtcccaagtcccaacacaacattggggagccgccgccaacgcgcacgattttttctcgacggcggcacaagcgatgcaagtgcaacagtagcatggcctctctcaaacatagcaccagcttaactctatcgtgtacaacgaggacggcggctacatcacatgataccaatgaggccgtcaaccactgccaccacggtggcgaggagccatgagcataaggcggttcgaggtggcctcaggaatcacggcagcgacatgcaannnnnnnnnnnnnnnnnnnnnnnnnnnnnnnnnnnnnnnnnnnnnnnnnnnnnnnnnnnnnnnnnn

SEQ ID NO: 15504 - DNA, 676 bp, Oryza sativa
ctatcaaaaccagtgcagatgaggtccctcggtggtttggacggcggttttggctgatgtggcgcctatgtgactaatttgactagatcttcgtcccatgtggcattgacgtggcgctcacatgacaattcgatttgaaaaataatagtcatggacccacacgttagttacaaaaagatagtaatttaaaatggtggggccacatgtcattcttactcccctcctcatcttcctcagctcttccaatctcccctctcttcatcttgtcttgttcctgctcttcttgatgatggttgttatgcaggaattcagagacgaagaattagtgccctgcagctgctgattatgatgatgatgatgagcagttgtggatttagggctggatatttgtagcaggagatatgcataggccgagagtgttcttaggataattgtatcatctcgatgtaattgactgagttaaataaaaacttccattatctaaaaaggatactctgctgctgctactaccgttgacggtaaaagagtaggcggctcgcagatgctgccgattggtggttgaatcgggtcgatgtcgtcgtcgcactgccggaggggagcacggtcatagcaatgcacgttcatgtgcctaccaagcgcctgctaaccggaactcccaccggcagaagctgcacat

SEQ ID NO: 15505 - DNA, 1133 bp, Oryza sativa
cctaatccaacaaatgtagcttaaatatttgccttgcagtgtttttttacaatgatcagttaacttactttcagaattatttttaaaacaaaaaaaaagagtcaagggtgacagggttatctcataccatattaaactacaagaaaaatacaaggataagtaatacacctgtgctgactgagcgtgagatttctcagcccatttaaattgatttttttctaactcgtagaatatctttgacaccaccaattctccctcatctttctctgtgctttcgatatgatattgatgtaatctccagtcagtgatctgaggattgttaccatctgtctcgtaggcatacaatacaaatacttccttgcaaccttgaagattcccatccaaagttattgatataggatttccacttttttgccatctgatacatttactgttctcattggcgcactccttgaagtttttgtgaaagaaatatgatgcacatccatcctgcctaatacctaaaatatcaatcaaaatgtagcatgtgacagtaaatcataaaaggaacagacatgagagatatttacattgaataatagtgaactacctggtatatcttgagggtgagtataaccaaatcctatggtttcatcaacagatttaataaactcgttgataaaaggatgacgacgagcctgaccatttccaacttctgcagccagatgccagagtagatcgctatcggtaggattaaactctacacctctgggaagacctggccaaccctgcagcaatacaataagcacaacatttaagtaaagaagcaatttaacatgatgcaagcatttgtacggaagatcttggaattgctcttggcgcatttggagattttttaggagcgcagttttaaaagaaacacatggaagaggtttccatacaaacattaacagaaacagttgataccagcaagatggcaatccacataagactccctcctaaagaattaattttactcgtttcaaggaaaaagaaatgtcctttgtagctgctattagatgtagataaaagtaatgttcaacaatggtggagggtgagaaaaattgaggagcggtgatgactgattacaaatttacaatagctgttcaattatt

SEQ ID NO: 15506 - DNA, 3157 bp, Oryza sativa
gcctgcgccggaacaacacaaagatgaggactccaaaaaagaaacatctgcaggacagaacaaggagaaaagggaggcgcggcacctctccggagcgggaggctttgactccgccggcgggcggagcagccgccgccgtcgctcggcgagcgggaggtcctcgtggtcggagtcgacgcaggggggaggaggcgggccgacctccttgtccttggccatcaccgcattagggtttgagcgggaggaagcgggggtacggaggattaaggtgagatttaggcgagatgacggcggatttgatcgccggtgagaacgtgggtttggggatggttcacggtgagaaagtgaggctaatgccgatcaggttctcgggcgagctcgcaattttggcccagagcgcgaacgtccaaaatgtagcgatctggcccatgtatcattgaaaatctgctcggtttcgatggcggatctcggcctttacccaacagttctatgggccttgggatgctcgagtaggtccgagtcgtgttaattgacggcctttttgcacacttgggcagatcatgttcgaatacatgacactgcgcgcgttgttgtggaaactgatgactacaataggataatgaatgttgagttatctggaaattaaatatagatagtagctacatatagttaatatgtattggatggttacgattaagtatgtgaattatctaatggctcttactttgtatgagtggtatggcttaatgtatatttagctcttagttctagctatatataatttttgtagatagcgactacaacatcagaagttgcaacctattatcaccatcagatcaatggagccaatggccaaaattgacactgcaggtctgcagcactgtcccacttcgtatgctacagtacccataccgggatccgctacagtagtcccctgaacagcatctgctggcgatataagctgttgatccggtggcaaaagattgctgatgttgctgtagcaccacggttgctctggagtattggatcttgtttatagacttgcttggaactcattcggattacctgtttggaaactcgagatgcatcagtctctaccttggatatgctcgttcaaggttcgaggttatttcgaggttatgtcttgatcaaacatgaggtacgtcgtctggtctctgctacaaattaaaacatatgctataaatatttatggctaggaactattgttctactaataacaaagcaaatatttacttgcaccgtctcaagaaaaaaacaattcccgactagtacgaactaagacataactatatccaaattcacacctacgaagtagttccttatagaatggtgggttctatgttatacaattgaagttaccaaataattggtaccgacaagttgacctcaatacaaacaagccatcaatcttttttaaacaacttagaagtgcatattttagaaatgcatgttgacgtgcgaaacactatatgcagtgatgttgattgtgttcggatgtttgctaaacttaaccatatcaaaattttggcactgacaaagtttagtcatttgtgagaaaattaataaagttgctcatttggtttgttggcaaatctcttgaaatgtgtgtgttgctggttttcggttaccaaaattttagcaataaaccaaatgaggtatcatctcctcgccacaagctaggcattttttattacaaaaccctactctatgtggtatgttgtatcatatcattcatattttgctcctctccttcccttcattgtctccgtccatattcatgcgattccttgatcctgtttgctaagcgtgaattattggtgcgaacttggcccacctccgctctatctactgtcgacaacaaacaagccattgcacctcaatgtagaggcaagtggcctatctcgacaacacaaacattcatgtcaacctaagccagttcaacggtgaagcgcaccggaccggagagaataccgttatcattgtggaaacggttgaaagtccttctgaaaacgccaaacatgagttgaaaggtcaaatgggaggagagaaatgtgaacatgggtgagatgatacaaacatgctccaaaagagcagggttttgggataaatgtttttatcacatggatctgtgatagatgtgttctaaaatatggggtttcgtgatatctactcttatttgtttggtatggttagatcagttagagcaagtttaataactactggctccaaatcatttatagtcaatctaataactcattcatacaataattacttataaacatatactacatcattaacatatggtccacctcttatacacatataacattttggaattcgtattgcagctggatataaatttatagcccgattttcttctctcttctctcctctctcttttacatgtgcttatagctgacttgtagcctgctattgtactcgctcttaggccctatttagttcccaaataaaaacttttcaccccgtcacatcgaacgtttggacatatgcatggaatattaataaaaaaaactaattaaacagattgcgtgcaaattgcgagacgaatcttttaagcctaattgcgccatgatttgacaatgtggtgctacagtaaatgtttgctaatgatgaattaattaggcttaatgaattcctctagtagtttacaaacggaatctgtaacttgttttattattagattacgtttaatacttcaaatgtatgtccgtatattcgatcgtgacatgcaaaaacttctaaacatggccttaggtcttgttcgtttctccaacaagtcggagatgaaattttggatactcgtggcacgcttttcaaactactaaatggtgtatttcgtgcgaaaactttatatatgaaagttgctctaaaatatcatattaatccatttttcaagtttataataattaaaactcaattaatttttatattcatcttaatcttcaggagattcaaacaccacctcggtgattcagtgaatcaaacgagtccgttgtgttggtaaataaaaagcgttggtcgcttcgttggacagtaaaacgaagtcatgcgcagccagccagtccaggccgatcaaatatcatcgttggagtaccaatcaagtgctgtcgcccag

SEQ ID NO: 15507 - DNA, 1449 bp, Oryza sativa
gttgctgcgccacgtcacgctccgggccccgcatccccctcctcgtttcgcgtgcccactgtccaccagtctgagagccactgtccccatcatcccatggtcccacgcccgacgctgtagctgacaggtgggtccacaccatatcggccccacatgtcggtgggaggagggctcgctttattggagtttgttcgtttctttcccgttgtcctatgcccactgccagccgcggcccaccatagacgctgacatgcgggcccggatttccccgaggtccacgaagcgatccacgtagtactactcgaaacagcacggcctcgtcgccgctccgcgagatcgcctcgcagccgttggatgcctgacatgcgccacgtgatgcgtgccactaaaccatcggctggccagagcgcggcgtacgaagagagcttttacaccgacatgtgggtcgcaccaacgcgttgggcccagctgcagtgggagtagggggcttgggagtagtactcgggcgcgtagctgatacggttttgacaccgtgatgggcacctccctaccattgggcccttgccccttacttttgtacaaaagcccctccttttctgtattctcatatttatatcccatcaacttgcaactcttcattccagttcgcttcctccctcccacctcttctccacttcttcttcctcctcccctttcacactccacttctttggtctgctcttcttggtatccttctcctacgcatagttaagctccgagctcagaaggtaggttggtaggtttctattgcttcttctcagctgggagagtgaaaataccgaggagaaaaggcacatcaagattgtttctttcggtttcttgggcttctcttgcggcaacatgaagaagctcttcttcttcctcttcctgctgatactggccgcctcggttgttcacggcgaggacggtgagatttcccttctttctttttctcttgtgttgcttgatctcatattgacccttttgacactgactctgctatcccattcttggatgtggttgcatggctcgatctcgccatctttgctattacatcatcgataatatctttgtttattaggctagttttcttgctgcaatcctggagaccttgaatgatagcgactgtgattgggactggtcgagtgagcgatgtccctttctacccggatttctgcttgtcgtattgtggtctctggtgttattggagttgtcctgtaccccttgatggttaaagttcaccgttggtagtagctttctcttgacaatagattaacacaaatcacaaaacatggctaatcttagttaatgagttattactcctagctagagtggtctgtaatggagtacttgtagtagctacccagtcagtagtagcttttggggtttggatttgactactcatcctgctcacccttattctctgcttgt

SEQ ID NO: 15508 - DNA, 10235 bp, Oryza sativa
  unsure (1)..(10235): unsure at all n locations
ctttagccattggcaccagcctttgtggggcctccttgtctgcctcttttctcctcaaactatgttcactccatactccatgtatgcatcagcaactggttggtgccaatggcttaggtcatgaacttttaaccgttgcagtgggggttcggtgttaatcataaggctaacccttcggttgttactcggtatttatagttcagcatgcctgggtgattgtcatgtgcccttgtcagcactcagcaccctgtgccgagtgtgcgagagagtccggtcagtctctcctttgactggttggtgacggttgttttcccgggaccacctggcagtgtcactgctagtattaatggagtcacgtctcctagcttgtgcggcccagctggttgtcgcattggaggttttgccttgcctgcgcagaggcagcagcagagggcggtgcagcgtgcaggactggactgaactgtgcttcgctcgctgtggccatccgcatgaaaagcccgggattttgcgctgcgtcgtggtggtggtggctcctgtttccaacgtatttcccccgtaccaagttgccttgtgctttacagctagcttggtgtactcccaacatcccccatgcccatttttctgtagggaaatcgatgtgctgctgtatttgtccaactgttctttttcttgttgctactagtagttgtacgagttagggggtgtttgggagagagagggtaaactttagcccctctctcaacaacttacttcctgcgttccaaaaattcctccgttcttaaaaaaaaaccctgtgtccagattcaaattcaggagtggtttttttcggaggaataagtctctcggggagggactgtttttgagagaggtaacccctctctcccaaacacccccttagtgatcagttactaatcctccatttacatttgcatgtgatccttgtttgtcctcaatgatttgtcggagttttgaactgtgccgtatttctctttattcgtcatgttcggtacggagtaaatgaaaaataaacttgacatgagctacgttaacgttgtttatcttacatttttggcgtgcaggggcgtacatcggcgtcaacattggcacggccatgacgtcggtaccggcgccgacacagatcacgacgctgctccgctcgcagaacatccgccacgtgcggctgtacgacgccgacccggcgatgctcgcggcgctcgccaacaccggcatccgcgtcatcgtctccgtgccgaacgagcagctcctcgccatcggcaactccaacgccacggcggccaactgggtggcgcgcaacgtggccgcgcactacccttccgtgaacatcacggccatcgcggtcggctccgaggtgctctccacgctgcccaacgcggcgccgctcctcatgccggccatccgctacctccagaacgcgctggtggccgcggcgctcgaccggtacatcaagatctcgacgccgcactcctcgtccatcatcctcgactcgttcccgccgtcgcaggccttcttcaaccgctccctggacccggtgctggtgccgctgctcaagttcttgcagtccacgggctcgccgctgatgctcaacgtgtacccgtactacgactacatgcgctccaacggcgtcatcccgctggactacgcgctgttccggccgctgccgccgaacaaggaggcggtggacgccaacaccctgctgcactacaccaacgtgttcgacgcggtcgtggacgctgcctacttcgccatggcgtacctcaacgtcaccaacgtgccggtgatggtgacggagaccgggtgtccgcacaagggcgacccgtccaacgagcccgacgccaccttcgacaacgccgacacctacaacagtaacctcatccggcacgtgatgaacaccaccggcacgccgaagcaccccggcgtcgccgtgccgacgtacatctacgagctctacgacgaggacacccgccccggctcgacgtcggagaagtactggggcctgttcgacatgaacggcatcccggcgtacaccctgcacctgacaggctccggcgtgctgctcgccaacgacacgacgaaccagacctactgcgtggcgcgggagggcgctgacgagaagatgctgcaggcggcgctcgactgggcttgcggcccgggcaaggtggactgctccgcgctgatgcaggggcagccgtgctacgacccggacaacgtcgaggcgcacgccacctacgccttcaacgcctactaccatggcatgggcatgggctccgggacgtgctacttcagcggtgtcgccgtgatcaccaccaccgatcccagtaagttcacaaaaccataagagattcctgctttccaaacatttggatttgagcttatttcgttctctctgttttcttcaggccacgggtcttgcgtttacgctggaaggtacgctctttttttcccctccccataacgtctttacattctcgcgatgtttgaaacagaattcaagtgcgtttcgctcaaatctgtcatttatttttggacgtgcagtggtgggaagaacgggacgtcgttgctgaacggcacatcgctggcgccgtcgtcgaactccacggcgggggactccggcgcgcaccgggcgatcggggacgtctcgtcgttcgtccgcgccgtcgtcgcggcgctgctgttgagcgtcgtcctcctgttgtaggcagtgagacgagagtggttagtttagtaggcaaggcagcagagtccgtaggaattcatggggggattctttttttggtgtcgagtgggattggcctcggtgttatgggtgggtggtgatcattgagaacgaacaagatgatgtgcctgtgttcatctgttgctctaagatgttgtctgggaacttggtattgggtggtacgttgcctggaaaaggaaattggtactaggttgtatttgcagaaggtgtcagtgtttgtgcgctgaccacaatcaaaatcttcttctgagccaactgcttcactcgtttcctttgttctgaatcgttgatcgattcatggatttttgcggctttccgcttccttcgatcgcgacgaacgcgcggacttgcattggttgggccgaaagggatagccacttacaagaggcccatatagtttgggccggaacggtgtaatgccacagctatgtgcggcccatagataccggcctccaccctaatcgtggtaatcgaggcctataaaacccagcgcctctgcgtctcctccatatcctcgcgcgccgccggatcccgcagccttggctccctccctgttccttcccttccatcaaagatccaatctgaatctgtttcttttctcgtttgcgcttcgaagaacagatctgttttctcgtcttctgattgcgtttcgatgtgatttgctctttttttcgaagcactcttctcgtttacaactcgatcgctgctgattcgaagcttgcgtttctgaagggctgccaaatcatactcgaggatctatggacatgcagcttctggtaatagattcccgcattttctcgtaggtccaacatatttttttttcaatgaaatctatatctatacctaataaaaaaatacgtaaggattccgatatttcttcgtccgtcatcccacgcgccactaaaatctgttttaatccgagtcgggtcggtcggttttcattgtattgcaaaaccgcagttgatatagtatatgtatcttccatgtaatcacataacacaagtggtaatttgcttgcttggttaatgtggaaaatcttcactccggcctctcctgtaataagtctactttcgctccctcgtgtaatgtgtctataggacctccttgcctaacgggtcgggccggcgcacgttgttttggcccttattttttcgcccaaaaatcattaaatgtttacataaaaaaattaatcactttgaaccatcattttaagatataaaattgctgtaaattttacatgtgcgttttaatttatttctaactaaatagaacccacgtgaagaacaaaaaaaaaagtaagtcttcgggtaaagtttttttttcatcgtccatcacacgcggaatcaccttcgtatatttcggcaataatttgtttttttataacgagggtttgtttagattgtagtcaaaataaaccttatcaaattttggcaggattttttatgtatttattagagtttgataaaaaaactaaatggatgcacatatttggtaactttactaaaatttgataagctttatttaagctacaatctgaacaggccctgacatcagtttcctaatctgcaaaagcgatataaaatttcaagatttggaagacatgtacaaatttgaaattttgtacacatgtatcatacaagtacacatgcaatattagcaatccatatttgtttgatattcacccgttacaacgcacgggcatatttgctagtcctatatataaattggttgtgtgatctccatgaaacaaaatcatcctctttggatttttttgtttgttcgtttctgttttgtttcatctgtttgcgatctggtcaaccggtttatggctcgatgatgactactcttgctttaaccacaccgaatacgaaggcttgacgaagcgtgctttgcccccaccgctacgttgtgctcttctgtctcgtcgattcctcgtgaaatctcctcgtgtcgaagaattagactgattttttcttctttgatgagagattgagatggatggattcggcgagattggtgagcatggtagtatggacgccaatgcctctttcgatggctcttcacatgtggaaaaactttggcctttactgagagcctaacaatcatcagtttattcacaagtctttggtgattctttttccagttttgaaactgctcgaggactttaccgagctagaattcgtatataattaggatgaaaataatttgtacgacaacatagcagatgcaacagcagccgcaatatgttttccaaacgaaaactgcagaaatctgaatagaacagcaaatgagacgtttgtcggcattgtcattgcaatctgattacgacaacagcaaattagaagttgttgacttgataagcatttacgtcatccgtcttaccaaacctgacttgctacaactaaaattatccagttacacgcacagggaccggacaggaagggtatgaacaccttcgtcgtcatttttttcaacggatgctactgctagttgaacgagttaagaagtggtcttttgcagtagatagtatagcagataaatagataaatatcattatcccagtatcaatcaagtgatcaacgaatcctgcgaccatttctgacgaaatgatttctggtaggatttctgactaaatgatttttgctaggatcagcgttgctcccagtcgtcaactggtgcaatgcgctgtgcgcatcaccgcagaaatatcccggtgagatacaaaagaaatcaacgacttgctcaaagtaaaaccaaagcgaatgacaggacaaacaaattgacagcgctcaccattgtcaagtgccaacgacgcgcagctgccaacaaaccttcattaactagggggtggccactccctctgctttcctacgtactccagcgacgagttctgttcaggccgccggttgctttcatccgaggacactagggccgagcagcagagtaactggagtactggacaatctatgcgatgacacttcagtagttcacagcatccaaaatctggcaaactgccctactaattatggtcccataaacctccaataccagcgaaattgcaataacgatcatggtccaagaactagcggctaccggtcggagatgggaccttagctagttattgcccgtaaagatataaatttatttaaaacatttaaaacttagatttaaatttagaaatttatgatataatcttttgattccattctgaaccgtgcgagcaattaaaaaaatgttcgattttgacccggacccatggtgcggtgcaatacaacatcgctcttgcagtttgattgctgctctcgttggttaattaacgtgggggcatatccatccatttctaagggataaagcctcgatgcgtaaccaagaaattactaactttcataaatgcgggctatgcatatgcctatatatcgggggtgctgcatcgctactgaacgggcttcacagcgacatgagaccaactagtgatagacctaaagctaaagcgatgataaagacggatggcttcctgctgaagcaggcagatcaaagaaaatttcagacctgattcacatcaacacgcgagagagaaaggatggaaatgagcatcaggtctttatatagagataaaagttcgtcttctttaaaatctgagaaatcttgttgactagcacttccgaaaaacttgaaacagacattattgtcacgctgaaacttactgccaccaaaaacttattgtcacactgattggatacaagtcgcggtttgtatatcgtctaaaatccaaataaactgtaaaaaagtagtccattggcacgtaaacatcgttgaagaagccaatgctgcatcatgccatgaccggctgacggctaatacataacttgtggattcatgatggccaaacaaagcttggcccttcaatcaatgccatgacagatacctatgagtactatataggaggccaacaaacaagttaatcactcttcgctaagtaagtaagaattgtggttgccactcggcactcgccaccatgctcctcgtcggcgtcctcctgctgctcttcttcaacctacatctccccacggccgccattgacaccctcacgctaggccagtctctgctgtggaaccagacgctggtctccaatggcggcaacttcgagctcggcctcttctcgccgggaaagtccaacaagcactaccttggcatctggtacaagaagatctccaagaagacggttgtttgggttgccaaccgtgagcgcccgattcttgagccgtcgagctgccacctcgagctgagcgtccacggcgatctgcggctgttctcgacggcgccgtcgaacaccttgctgtggtcgtcgaacgcgtccgcgtcttcctcgccgtcgcccccgcgcaccaccgtcgccacgctccaggacgacggcaacctcgtggtgaacagcaacgcgacgcggtcgcggtcgcgatcgccgtcgtcgactacgacgacgcacgtggcgtggcagagctttgatcacccgaccgacacatggctccccggagccaggctcggctacgacaggggccgcggcgtccacagcttcctcacgtcgtggacggactccgagaacccggcgcccggcgcgttctccatggtgatcgacgcgcgcgggctggccaagttcgacctcctcgccggcggcgagcaccggtactggacgaccggcctctgggacggcgagatcttcgcgaacgtgccggagatgcggtccggctacttcaccggcgtcccctacgcgccgaacgccagcgtcaacttcttcagctaccgcgaccggctgccgggcgccgtcggcaacttcatgctggacgtgaacgggcagatgcggcggcggcagtggagcgagacggcggggaagtggatcctcttctgctcgttgccccacgacgcgtgcgacgtgtacggctcgtgcgggccctttggagtctgcagcaacgccaccaacccggagtgccggtgccccgccggcttcgagccgcggtcgtcggaggagtggaggctggagaacgccgccggaggctgcgtgaggcggcaccctctcgagtgtcacggagacgggttcctggcgctgccgtacaccgtgcggctcccgaatggctccgtggaggcgccggccggagctgggaacgacaaggcgtgcgcgcacacctgcctggtcgactgctcctgcacggcctacgttcacgacggagcgaagtgcctcgtgtggaacggcgagctcgtcaacatgaaagcctacgcggctaatgagaatggccaaggcgatcctggcctcgccggagcggtgcttcacctccgtgtcgcccactcggaggttccggcgtcgtcgacggagcactcgtggaagaaatcgatggtaatccttggaagcgtcgttgcggcggtggtgctgctcttggcgagcctcgtcaccgtggtggcggtggcggcggtgttgcggatgcggcgtaggaggggcaaggtgacggcggtgcaggggtcgctgctgctgctcgactaccatgccgtgaagaccgcgacgagggacttctcggagaagctcgggagcgggagcttcggcacggtgttcaaaggcgcgctgccggacgggacgcccgtggccgtcaagaagctcgacggtctccggcaaggcgagaagcaattcagaacggaggtggtgacgctcggcatgatccagcacgtcaacctcgtccgactccgtggcttctgctgcgagggaaacaagagggcgctcgtgtacgactacatggccaatggctcgctggactcgcacctgttcgtcatgagcggctccagctccggccccgactccaagcaggtgaccctgacttggagccaacggtacaacgtcgcggttggtgtggcacggggcttggcttacctgcacgagaagtgcagggagtgcatcatacactgcgacgtcaagccggagaacatcctcctcgatcaggagatggcggcgaggctcgcggacttcggcatggccaagctcgtcggccgcgacttcagcagcgtcctgaccaccatgcggggcacggtgggatacctcgcgccggagtggctagccggcacgccggtcaccgcaaaagccgacgtgtacagcttcgggctcctgctcttcgagctcgtctcgggccggcggaacagcaccgcgccgtcgtcgtcgtcggagggcggccctgggatttacttcccggttcatgccgtggtcaagctaaacgaaggcgacgtggccgggctggtcgacgagagggtggccaaggatgccgacccgaaggaggttgagagactctgcaaggtcgcgggctggtgcattcaagacgaggaaggcgaccggccgaccatggggctcgtcgtgcagcagctcgaaggcatcgccaacgtaatgttgccgccgatcccttctcggcttcatatcctggcgattgagaacgaatgggtcagaggtgttccagaggatgagcgctgctcaaagagcggtagtaaaccagaaacagaagcaatagaagaaatgtagaactgaaaagaatctgggagcaccctacagctgaagtgaagatgcagcgtcagatatgaaaatgtagttgtaatgtcagcatagttgatatttcccgtgtggatgtatagccagtactgtactgcaactgttctgtaaattccttaaattccggaaacaggatcagacaagtaccttctctcgttttgttcccatctaattctggtccatccttgctgacagctgcacctttattgaagaaatccattagtgctacccagaagtccttaactaattgttgaaaacaacttgttgacaaaattgcagatccactcctccacactcactataattctgttatgtacaatttttagatgggaaaattttctgataactacaaagggcataagaagcatatatctacacgggcaactagtaacaacctatacagattaagaactaaatacaaccccaaagaatgaacgaatatcactatgtaactacaagaccaacatatcaagatgtacactttacaggtaaagatgaagatgatgatacagagtaaagagctttaagtaaagaaatgaacttcacaactgtttcttcagagaaccacttgagtttccatgtatgcactgtgtaaatttcatctggttgcttgctctgtgaatttgtaatgctaccgttactgcaaaatcttccttcatgtgcatggttgtccaaaactaatgtcaaacatctcttgtcacagtgatccacaacctgaatacatgaagagagaatattgaatgagtgatatcaactttcaatctgacagaacagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcgaattcgccc

SEQ ID NO: 15509 - DNA, 756 bp, Oryza sativa
  unsure (1)..(756): unsure at all n locations
tctggcaaactgcccttactaattatggtcccataacctcccaataccagcgaaattgcaataccgatcatggtccaagaactagcggctaccggtcggagatgggaccttagctagttattgcccgtaaagatataaatttatttaaaacatttaaaacttagatttaaatttagaaatttatgatataatcttttgattccattctgaaccgtgcgagcaattaaaaaaatgttcgattttgacccggacccatggtgcggtgcaatacaacatcgctcttgcagtttgattgctgctctcgttggttaattaacgtgggggcatatccatccatttctaagggataaagcctcgatgcgtaaccaagaaattactaactttcataaatgcgggctatgcatatgcctatatatcgggggtgctgcatcgctactgaacgggcttcacagcgacatgagaccaactagtgatagacctaaagctaaagcgatgataaagacggatggcttcctgctgaagcaggcagatcaaagaaaatttcagacctgattcacatcaacacgcgagagagaaaggatggaaatgagcatcaggtctttatatagagataaaagttcgtcttctttaaaatctgagaaatcttgttgactagcacttccgaaaaacttgaaacagacattattgtcacgctnnnnnnnnnnnnnnnnnnnnnnnnnnnnnnnnnnnnnnnnnnnnnnnnnnnnnnnnnnnnnn

SEQ ID NO: 15510 - DNA, 484 bp, Oryza sativa
  unsure (1)..(484): unsure at all n locations
tatatatcatatcaatggcgggctatacatctcggattcctcctcccaaaacgcaaggcacttcccttctcctctgtctctctgaacgcatcctccaacttgtgcacgtcttcctcctcgatctccatggccgagttccttcgccggccggagttttgtctgcccatgcacatatacacatcacgcggatcgaagatgggatgaacgtacgtggagcggtgaaggtgcaaccggcaggcacggtggcatctcgatcgatctatcgatcgatgaggaggccacggtggcgtctcgatcgattcgcgacatgttcgccgagatctatcgatgaagaggccggatcccgaccgtgatgcgcgtgcgggcgtgcggcgtcctcggcggcgccgatatgctttgtggtcgggtatggatgttccgtctcannnnnnnnnnnnnnnnnnnnnnnnnnnnnnnnnnnnnnnnnnnnnnnnnnnnnnnnnnn

SEQ ID NO: 15511 - DNA, 310 bp, Oryza sativa
gtatggaaatagaatggaatcagacgcgtgaagagctacacgtgcgtgagggacaaatccaagaaatttgccgtgcaggaaaaaaaggagggcctcgtcactctcgaaatggaaaccgagtgggaaaagaacgacagaccacacaaatgctccgaattttgtaagtaagtgtgtgtagtataggctaagaaaagagaaagataagacatgataaaagataagtagataaattatgaagggggtaagatttcccataaacggacatatatacggacggtgatgaattagtatagtaaagtaattcagagct

SEQ ID NO: 15512 - DNA, 446 bp, Oryza sativa
caccgactgctggggcggcagatcagaagaggactagagccgagacccaacgatgccggtttggccgctgataccgccactgacagccttcccttcgatcttggcagtgcctcggactatcgcaaccgtgagaagaataagagagcttgctgccgttgtccttgtgccccctcccccggctttgcccacgatagctcaggcggcggtggcgaggcggaggggacgacggctagggatggcgatagtgctggttgccgcttgtgctatcctagctggggccgagcgatcacgtacgagctctgagtgaccttgcaaaagcattaatttcattttatcttccctagatctgcattttccaaaggatttattaattgttggatttagtcttagacagagtacttactagtgttatcacactagtgcgtcatgcattaaggccattccca

SEQ ID NO: 15513 - DNA, 617 bp, Oryza sativa
  unsure (1)..(617): unsure at all n locations
nnnnnnnnnnnnnnnnnnnnnnnnnnnnnnnnnnnnnnnnnnnnnnnnnnnnnnnnnnnnnnnaacacatctatcacagatccatgtgataaaaacatttatcccaaaaccctgctcttttggagcatgtttgtatcatctcacccatgttcacatttctctcctcccatttgacctttcaactcatgtttggcgttttcagaaggactttcaaccgtttccacaatgataacggtattctctccggtccggtgcgcttcaccgttgaactggcttaagttgacatgaatgtttgtgttgtcgagataggccacttgcctctacattgaggtgcaatggcttgtttgttgtcgacagtagatagagcggaggtgggccaagttcgcaccaataattcacgcttagcaaacaggatcaaggaatcgcatgaatatggacggagacaatgaagggaaggagaggagcaaaatatgaatgatatgatacaacataccacatagagtagggttttgtaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15514 - DNA, 724 bp, Oryza sativa
  unsure (1)..(724): unsure at all n locations
nnnnnnnnnnnnnnnnnnnnnnnnnnnnnnnnnnnnnnnnnnnnnnnnnnnnnnnnntggccgaggacccttcccgcgctgacccacgcaccatggggctggtcaccttcctactcccactcctctgactccttctggacgccgacgcgcgccatagcttcaagagccggcgcggggtggaccaaggagtctcgagccagtccttgtggtggagtcaagctcgagtggtcaggcggaagcttgccgcccctcaccggacaagctcgccgccggaccatcgtccacgagcgagggcacagcccgagtaggactagaagggcatttcgggtaaaactacaggaccattgtgtacccaccgtccaatcccaccagctcctattaggcgaaagagctacttttgatagagcagatacacttcactaggggtaaatgtaccatgctttaagattcgtgcgcacacgtgtagggtgcagatcgtgggtgcatatgaacccacgtgcagattatccaactcctataaataatgactgcctcatgtcatacgttaaagtttaactgcatgctatgtacctgggggggagcaaggcgagtgtgttagaggctgtatcaggtgttatttaatacgtagcaccttataacttattagatgaggcagtaatattttactcagccctcactagagtggtgacaggcgaattagaagagagatgactcagtgattttt

SEQ ID NO: 15515 - DNA, 1428 bp, Oryza sativa
  unsure (1)..(1428): unsure at all n locations
nnnnnnnnnnnnnnnnnnnnnnnnnnnnnnnnnnnnnnnnnnnnnnnnnnnntccacaggtgtatgtgtgttcttcgtccctttggtcttggaatacaacgttcggttggtaactgtgttatcagtcaactctcgtttccttttcctccacaaaaaaaaaaagtaaacaaatcttaagatgtgatacaaactgtaagtcttgctgtcttggtcttgacctggacaagaacactgtaccttttccctttctcacctatggacctactaccgaccaaccaagttttttttcagatgtgtctagattgctttttggaaaaaaaaaagaaacaataaaagattacctactctgttgagtgcgagaggaaaaggtaggtaagcacctctgaattctctgaatgtcgaacattctcagagcattcagtttcatccatccttttccctgaagtaatgccatcgtttgactcaatttaatccattgtcaggatgactattctagtgtgtactgtgtacacttgaattgtgtttgttgcaccaacttctgataggcaggaccattcaattgtgtcaaatttacttcggacgtgaatatcacgattcttttcgaaagatcaaatgtcacaattgtttcaacttctttatgcaggttcacatgcaatatcttgaagcaggtgccgatgtcatcatttcctcatcataccaggtatcatcggtctggcgatcttcattccccagctgacataaagagtaatctttcagtttcagcatcagagaaattgatgccttcctttcttgtatctctctgaaggcaactatcccaggattcttagccagaggaatgcttcttgaggaggcagaagggttactgcgaaggagcattgaattggcactggaagcacgagatgaattctggaagtcgacgctgaggaagtccaagcctgtttacaaccgtgctctggtcgccgcatccattgggagctatggagcttaccttgccgatggctcagagtacaggtaacttctaagattcagcactgcaaagccatggattagccatggatcggcacgcattgtaaccttaacctcgtatataatattttgcttgtgtcattgatgcaacattgtatctgacagtggatcgtatggagaagacatcacggcagagaaactgaaggacttccacaggcgccggctgcaggttcttgcgagcgctggccctgacttgatcgcgtttgaggccatcccgaacaaaatggaggcacaggtgaggctagtgaatctgaatctctgaaagaaaaacacagattgtgcaatgtgttccagacattcaatagcactgaaatgctgccacctttgatgtttcttgctgaaattnnnnnnnnnnnnnnnnnnnnnnnnnnnnnnnnnnnnnnnnnnnnnnnnnnnnnnnnn

SEQ ID NO: 15516 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnttgcatgtagaattcatgaagggactgccttcagggatggtatgtatagcatgttgcaggtacaagcacactttctcaactgttttggttatgcattaaatttatgttctaatatcatgtttgaaatgtcctttgttatccctgatgcctcattaggacttatcacaacttccattcttggtcaataagcatgcgcataacaatagcttttctatcaagaacatataaatttatttttcattgtgccaactgaatttagtgattcaaggttgcacattgtctgtgggagggagggaaacgagaaacgggtctgttcaattgtttgcaattatatgcaggaaatttcttctgcaccggccattataggtagtatcgacaatgataacaacaggaggttgctaactgaaggtctttcaaacaaccagcaaagtcatgaggctggatgtaaatctcttctccttttcttttttaattcgagtccttacttccacatgtcaatggtgaagaaagcattgattactatactctgaaacaagtgatgataaacaacttactgcaggtgaatcaggtttcttgagtacatcatcttctgctgctccaccacaatgtcaagatgtgtgctctcatgatctattggtaaacggcaaagactcttatttatagtcgcg

SEQ ID NO: 15517 - DNA, 248 bp, Oryza sativa
ccctcatccctcctctctctcccgcatcttctcctcgcactctctcgccccctcgccgccatgcggcggatttttcatagaatcgaggcgctcctcctccgcagtccgcaccaccatcgcgccgcgcgccttccctccatcgtcgcacctccccaacatcgccgcgccggcgcccaccatcgtcactgccgcccatcgctctccactgcgccccctcgccgccgtgcgccctcccaaccctaacccct

SEQ ID NO: 15518 - DNA, 15754 bp, Oryza sativa
gcgaagaaaactgatgttcgactccagaagaatcacagaaagattcaaatgcagaatttttgaattcagagccattatcactacgaatggctcgaagagcactaggaaactccaaagccaaactacgagcaagagactgaaagaagccaaacgtttcctcttttgattcaagaaaatagacccaagagtagcgagagaaatcatccacaacaaccaagacataccacttccccccaactgactggacctgagcaggaccaaccgtatccatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactattgcgagacaagtggtcaaagccaatatgaccaagacgacgatgccagaaaaacaaatccctattctctgaggcaatgaaacaacgagaaggaccaggagcagaagagtcaaagttagcaaagaaaactcgaccaacttgagaaatgttaaaaacaggagattcagaagcatcaagaactcgagacctatcctttttgaaacgaacttctagattttcatcacagagttgtgaaacagagagcaaattgtacttaagcttacttacaagcgcgacatccttcagcatgaatttgtcattgaccttgattgttcctttagccatcatgcgtccactgctcgcatccccaaaagtgatggtctcatcaccggatgcacgagtgagagaagtaaaccacttggcttcaccggtcatgtggcgtgagcaaccggagtccacaagccaagaattacttctccccactccaaaatcctacaagaaaaacaaagcaaatctcgatgattcagtactggggttagtgagaaatgacttaggaatccagtactgaaccatgcgaggggtacaagcatctttagtgttatgagcagaattatatgcaagatgaccatgtctgttttgccccaaccttgctaggtcacgtcgagggtgcacatctcggcgaggaaagcgagatacaccacttgaacgacatgcacacttgaacctctcagggactctagtatctcttctagtcctaaaacgttcttgtcgctcttttctagcctttctaaagcagaaacctaccaaatgaccagctttcccacaataggtgcactcatacttggttttctctacaggcttggtttgtttctggttttgcttgtgctcaacttgttttggatttttgggtctaggtaactctacaggcttagacttgctagtcataggtaccatctttggttctgaggttttgggtgaactagaactagtgtttccaatgaaacctgcagacttgaaggttataggcttttgagctagttctatcatcccatctgtgacacctaatatctcatgggtacctatcctcaaagactcatcaaaatcatagcctataccttgattgtttatggacactttggattagtctaggatcatgttcaactttttctttccttgagcaaacctctctaaagattgttgtaggtaaaagttctctctcttagcagactcaagatcaactttcagagaaatgcatgatgaacaagaatcaatagatttgatagaatcaatgacagttttagcatcttttagttcagtttccaggatagcacaattagcacatgaagaatgaataggttccttagtagcaaaagattctaacaaatcattcttggtcctaagcatggcaacttgttgtcttaattcatcattgtcactagtgagaatgggacaattttcacacctaccaatcctatcatgaaattttttttcttttagttctttcaattccatctcaagcaaacccatatcaactttcatttcatagcaagtagagcaagcaacactagcactagaaggattcccagctcctaaagcacatgatttcaacttatccttgaggagattaatttcagagagatatgaagcacaagtagaacaggtatcctcctcaggaatcatggatcgaagcctagcaatttctagcgccataccatcattttcagattttagtttctcaattttatacttagaagacctatacttgtcactaatttcaatcatcaagtgtgccattctttctttgcttagttcatcatcaacagagtcattatctgagcaaaaatcatcacaaagagaaccatccaaggaagggatatcatcaagacatacctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttatggatcgccttcttcatcaaatccttattcccctttcgcccttgtccctcgggcttcttggtcgtcttgtcactcttcttcttcaacttgggacaattcactcttatgtggttaggctctccacactcaaaacacacaaatggttcattggtttttcctctttttctatctctcacatttttgtaagctcttgagaattttctagcaaaaagagcaagatcctcttcaggaatcttctctaattgctcctcagtgactgagtgtaaagcggcaagagagaagccaccacacacaaaagctgagtcattagaagaagtactaccagagggatcagctaccaaagccatcgagtgtttgaggcctttccgatggaaaatatccatctcatgggtttttagctttgagtaaagcttgcccatggtaaggtcactcagaggtgcactctctgtgatggaagtaactttcatttcccaaacaccataatcaagacaattcaaaagatggcgagcattatcattattagaaaattcttttccaacagatctcaacttcgaaacaatttctccaaaacgcttgaaataagaatcaatggactctcctgggtgcatctcaaatctttgatattctttatgaaattgattctgacgaaccaattgaatatcattgtttcccttatggaaattgcacagagcagtccacatgtcatgagcggacttgtggtgttgaacacaattaaattcaccagaagaaattccaccaatgattgcatttcttgcacgataattaaaatcaacctgagccacatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagaatatttttcctccatagcggcgttcgttgccacggttaggttacaatgaacttaaccttgctctcataccaattgaaagaccaagaacagctatagagggggggtgaatatagcaattcaaatcttgcccccgaaaatactcatcaagccggatttctcaaaaatccttactagaaccgcggctattagagaagccggatctagaaaagaagagagaaagaaattcccgaaactagaagagaaagagaaaaggaatttcccaaactagaagagaggtgaggaggagataacaaaactcatcatcgcaaagttcaaattgcaagtagaatttaaattgcggaatttaaatgaacaaggcaaaaacgaaatccttcaaatcatttcattcataggtgatgcaaaataaccgctcaactaggggcaaacatacaccttcagaggaacattaacacaaaattaaaatctctcggacaaacacactccaaactaatcctaatacaaaagcctctcgagcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctccacgttgcgcgccctcgtgcgatccgcgtgattccactccaagccaatcagcgtgcaccgatccgcgtcgtgctcctccaagccaacgcatccgcgccacgcgtcccagagagcgcgtgcctgctcctctcacgcctgcgcaccaccagtccgaagccgccacgtcgccgttcctcccaccgagccgcttctgcgcgcgctcgcgaaaaccatgttcccgcgcgcaccatgcgaaaaaccgcgtgggacccggtcgcttccttgacgaacagaaggccgccacgcctccaggtgccgtacgatctcccgcttccgcgcgcgcatgcacacacctgtgcatttgctgagccgagctgggccatcgtcatgtctagggcttgctcggcctagccttcaccatcttgagtcagcaacgtgcttaggccgggttggctcggccttcctgccaaccgaactgccagcccacaagcctagtggccagctcctgttggtctccttgccattcaatcatggcagcacacgtgcacatgatacatgctagctacagtaagccgaattactgtagcagcaatgcactcggtcttcatgtccttgcacagtcctcttctccttccaattttcttcgcgaatccgatgcttgcacacttgaccttgtgaagcccgttgcaaagacctcctcacacggtgtccgcccaccgtgtgcaaccttgtgtccaatcttgtcacccggcatccttgatcgttctggacctcaacttctccctgagtctagtcccgatccgccgttgactaagattgactctgatcacctgcacacacatgagccaaacaaccgttgtcttggcacagatatcgcaacctgaccaatggtagtctacgcacacacttcttgcacttccggtacttgtcaatttcccatcacaaaagaactataaccacacatggtttcacactggcgcagactcatcgccgacaacgagcaccgaaagaagctgccgcagacgctgtcgggcttcttctacgagagcatgaaccacgagcgctgcccgtacacggcgcgccatttcaccaacgtcaccgggaaaggcatgcctctcgtcagcccgaccttctccttcctgccccagtgccacgacgtcgacctcttggattgctgcaatggcctcctcctctgccgctgctacgtgtctcgtggcacttttcagttccactatgccgtgtgcaatcctgccaccaaggaatgggtgatgttgccggacgccaactgggctatcgaagagaaccacaccgcctgcttgtgtttcgatccagccatctcgtcgcatttccatgtgcttgagtatgtggaagaggatgaggattcatacgtcacactggtcacaggggtggagatctattcgtctgaaactgggttatggactctccatgaaaatggatggaatgatgaagttgtgattagcctttcggtcaatcgaagaagtgttttgctcaatggttttctgcactctgtcacgcctgctgatgagattgtggcggttgacatagaggggaagaaatggaggaagattcctatgccggatcctgatggtgatattgggataattcatcaaactcagggtcgcctgtgtgcttttaatgttgatccaaatgatatcttcaaactgtcaatttggtttcttcaagactatgatacagataattggatcttaaagcataccgttggctcaatgaagctgtttggaggaaagaaataccaattagattatgactaccaagtaattgcagttcatccagaatgcaatttgatcttctttgtttatggatggcacaatactttgatggcatatgaaatggatcgcaaggaagtccgtgtcatacgcaaactcggacatgagtcctgccagtcatatctaccatatgttccaatgttctctgagtcattacctaatgggcggtaactgctaacatgcagaggtgcggctccacttttgttattgcaaaaccgtctttgtaccctaatgagaatcgggcttagagtgggcagccaatctctaatatgaattatgaagttctgtttgtagtacttggatgatggctcctttgttatgaagaatgttgtgaaatcctagatggtacgtaagttggccttttggaaggtatgtccggttgttccgaaggttatgtcttgttttattccgctggtgtttaccgtaggctagttaaaatttatgtcctgtgttaacatgacaggccttttgactgtaccagcagagtcagtttatggaaccgtgactaatgtttggaagttggatcacatgtactttgttgatttttgccttcctttttcccttttcttcattctgaactatacttgtctatgttacatccatgcagcttaatgtctcctagatcatttccactcgttttgttaagtgatccacaatgatcattaattggaacattgcttctctgacccttactagttggagaagaagagagtgcaaacaagagcacatacaattgtgcaccaacaagaaactacacaacattttagacttcaaaggtaacaaagactggtatacaatagttatactattaccacactggcttcctccgatgggcaccgttctgaattttcccacttacctgcttcaagccatgataaaaactactgccactttgagctcctcaagttccgacatgtataaatcaactatggtatgaattttcttcttcttttcaattatctctgttctaaattactgccaaagtgaccaagcctccctaaaatcattgtggttttgagacctggtagttccatatagttctccactttctttcagtcctgttctgagaaagagcaatggaagttctcagaagaataagaagagaaagagcaatgaatattcttttggccccataagtccttgttcggttgcttgggaattaatccccaaaggaacctatccagggtccctcccatctcacttaaaccctgtgggggatgattccctttgcctctcctaatccctctcctaaaacctgtgttcggttttggccaggttttagtgctcgtcagacgtcaggcatacctcctgggatctggaaccttccaaaactgcagtacttgttcttgtacaccaaccagctcaccggcgacgtcgtcgtcaatggcaagattggagcagcaagcttaatttatctggacatatctgagaaccagcttactggaacgatcccagagagctttggaagtttgatgaacctaactaacttagtcctgatggcgaacaacttctccggcgagatacgagcaagccttgctcagcttccatcgctggtgataatgaagctgttcgagaacaatctctccggccagcttccggcggagctcggcaagcactcaccatttctgagagacatcgaggtcgacaacaacgacctcaccgagccgggggtctgcgacaacttcattatcacaggggagttgggaagagaggagggtgagaatgacatgtggggcccacgtgggtcctaccatttttaatctaattttttttgtgtaaactgacatgtgggtctacaatttttaatattttccaaatcgatttgacacgtaagcgccatgtcattgccacgtcatgtgaaggccgagtcaaaatagccacgtaggcatcacgtcagcgaaaaccgccgttcaaaccgctatgggacctatattgcatcggttttgacagttaagggaccgttgtatatggtttttcggttaaaggatgaaatcggattcgttgttaagggaccacagataaacttatttcccctgtaatttgagagttagtcaaaaacgagtaacccagcccatgtaactcccgtggttgagttttgtctgtcaaactaggaataagttcactttgggtccctcaatttgtcgcctagtctgattttgttgcttggtcgcaaaaccggatatgtgtaacgctccgcttctcgtgagacgttaaaaactaattcggcaaaatccgaattgcgaaaatttcgttctttgtgtgcgagtctaagtcgtgccgtggatctcagttttaatctccttgttccctctcgtcactgtcaaaaccctccacctcaagatttcaaatcccgatttaacttcctagatcaattccgaaattcaaatccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagaaaaagtctattttgcctcccttgtcgatgggttgattcctctctcccggcccatcccctcctctcggcccagctctctcgcgcgtgcgtcgcacgtgttcgggagcgagagacagcgccgtctcctttctctctctctctctctcggcgtcgcttcccgccgacgccgccccaaaattccggccgcgtcaccgttttccgcgcgctcgcgcatggccgaccggcaaggacgccgctcccaccgccttcgcctttcccgcgcgcgctcgcgtggaggccgaccacccggtcgtcgcctgcctcgcgtgaccgcctttccgcgactcgcctgcccgccgcccaaaacggaagggacgagttcccctttccaccgccctcttcgccttttttccccctcgggctcaaccgctcgctctctcgcccttgtccgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacaaaagcagcagcagcggaaaaaggcgatcctagcggggcttcagctccactccacaggcaaaactcaactggggtctgagccttggtcctctaacttcgtcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaacagttgagtaattaaagtaacattaaatctccactgatcaacgctacaccacgttgaacaggcccaaccaacccacctaaactacagtgtattaggtcgatttattgaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtagtcgcattttagttggataattacgaccatgaagcatggccaggtgtctcgagcacacagctcaatctgatactaaaaaggtctaatactgtaattaccccatcaactgagctagtagtaattaagcatggctaagcatatagttctagctaggtcacataagtaacatgagctagtcgatttattacccaaggttgacaaagaacagatatcaagtaaacatggcacaagcgagcagataggtaaaccctgatcccgtgtaattagcaaaacatgcatatttatttgcaaacggtaaaacatttgtaaattaggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgaattttgcaagttgaacagctcaattcggagttcgaatgaattagatatggattttagaagttttgagccattttaatgaatttctagaattaaactcgatttattgcgcaattattatttatttttacaaaggaaatggacctcgctgacgtcagcaaggggaaaccagcgccgacaggcgggccccgcacgtcagcggcacaaaggggcggcgcacggtggaccaagtccacacgtggcctcgggtgcgcgtccaccacgtggatggcccagatcggcccgaagccgatcggacggccacgaggcggcgcggctagggcacgggcacggcatgaaaccggctcggccgagcgatagcgcgcggcggcgtgcggccagacgaccgccggcgacagcggcgcgtcgcggcagcgggcacggggagcggcggaggaggaaaaaaaggagaagggacggtggggattctcaccgaggacggcgacggcgagacgaccacagggaggcggctggcggcggaaagagatggtgaacgcggcggcggcgttccaggggcagggaggggaaacggagtaggggccggggtgcggcgaggaacggcgatgccgatggcggtggtagcgcagcgcggcagcgacgggagcggtggtggcgcgcgactggaggtgacgaaaggcggctgtggctcggtgcacggtgggaatggtgctgcgggggtggaaggggaggacggagtggatgccggggtgcggcacgacgcggcgaagccgttggaggcaaaagcacggccgggcgaggcggcgctcgccggcggggagcggatggaggcggctaaaggcgaaggtggctcggggtggcggtggaagcggcgttgcggcggtggattggcgaagaggagcggtggacggggtgcgcacggcgactgcggtgccggggagggcgacggcgcagtgcggggcggacgggagcggcggcgcggcgctgctggagttcgccggagagcggcggtgcgtgggctcggcgcggggagagcgagggagggcgcggcggcttggggaaaatggggaaaatggatgaggggagcacggggatgcctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtggacggctatggcggttgggatcggccggcgagaggtaggaggaggagctgacgggtgggaccgccggtcccacctgtcggcgaagggagagaaggagggacgcaaaacagacttttgcgagcgggccaagagagaggggagccggcccgagagagggagaaggcgcgcgggccgcgggagaggaaagaagacttgggccgaaaatggcccaaagagaggaagggggaaattttatttgttttctttttattttatttgatgcaatgatctttgtgttattgaaactatttctcgagctccgaaaattcacggaaaattccggagagtacattagggcacaaagaatattacaaaatattcccggccaatgatttttaagggaaaaattttaattctcccattatttcacttgattaaattgctttaacttttatttaatttccagaaaatgtattattaaatgatttttaatcccgaacgaaaatcggggcgttacagtccgcttgcgctcgaaggcagagccgctgacggcagccgtcagctcgccgcccccaccttgacccagcgccagctcgccccgcgccagccggcgctgctcctcccgctcccgcggttcaatttccgccgcacgatccaccgccttcgccgcccaatgcatccacgtcgtcgccgctttcgcatcgcccacgaaaacgccgctgtcgccagccgagcgcctcttcgcctataaaatcccaaccccacgcccacaatcctttcccccttcgccccgtgctccttggaacgaagtactacccccgcctccttcgtcgccacggccaagaacgccgcaccgacaccaagccgttccaccccgtgtcccctccttcctcggagcgcccgcctcggcgtcgcgttcgccaccgtgcgccgccgctcggccaagcgccgccaacggagtccctcgcgcccctccttgctttcccggccgcgccatctccgcgccgtgccgcccagccgtcgcgtctgcctcgccgcgactccatccgccccgccgttcccgctcgtgggtgagctccccgcccaaatcctctcgtctatatcctctagcgactcctaaacagcactggggcatggtagtttgtgcgttcgtcctccaaatcgcgcccttgccgatgctttgcttccgccgccgcccgcgcgccgccggtcggtcccgcgccgaatcccctcgccgccacccaccttgagctccaatgaaccaccccaaaccgccaattccgccgccggcctcctcttttgctcccgcgccatgccacccatcccgccgtcgcacggcctccgtcgcgcctcctctcccacatccgagccggtggatggaacctccgtgaccccctctcgcttccggtgcccgccgcccactccggtttgccaccgttcgccggattccgccgcgcgccgtcagccgtccgatgcgccgccagcctcctctccctccccatccgacgtggcagccacatcggcttgaccaagtcaagctgaccggtcgcgcctgccccgtcagcgcccagtcagccaccccctcctctctctcccgtgcttgtgggcttggcccatcggccaccctcctcctcggcctgataagagaaaggaagtccattataactccctccccaaacacagtgaccaaaagtctatatctgctccctcccaattcacctctctctcgccatatgttggcccccacatgtcaatgagtgataaaagaatattcttgagaatgttcttttccagaaaattcaataaatcctttttcccttgttccctaaatcaattctttattctagaattgcaataaatcatttctcatattccggaaaatccaattaaacttcgaaaatccatatcttttgaaccgctcatccgatttacttcgttcaacttccagtaatttcgtaaaattgagatctattcaatggcactattatttagtctaaatagggtctttttcttggtcttttgtttaggtttttgtttgtttgcgtatagttgcggttaccagattttcgtcgatcgcgggttttctcgaagattcgtgaagctccgtgaagaccttgagcaaggcaagtctccctttgaccaattgctcctataattggaaaatcattattattttgtttgtaacttgcattattagaatcacacacttaatttgcttggcctcggtttgcgtgccaaaccgacggacctacctagtagttgcactaattcctgtaggttgtactatccagattccttgtcgctccacctttgcggtacttcagtatccatgctctctgagcgcgtataccaaatatcccacatacaccgttgattgtcgaaaaattgtgaatgggtttgagaagccttgaaaacccgacatgtggtgtcggtgtgtttaaaaataaaatgaattgtgaaaactcgcgatgcgggggttgtgcctgcgtggcactgttccgtattcacatataaggaccgattcctgtgggaaattcatcaagcataacaaagtgcaaccacaaggtggaatgggacaccctagctaagtaactagtcggttcagggaaacctcgcatgccaatagttggggaacgccgaggcggggtcggttggagccaacccgggttcctggtaaggcaagaacgcgaagcttgccagattaccgatcgaggtggttggagtttgatttgcgaaaactgaaatggcctatatttatgtgaaggattttatccttctatgtggcatgaggtaaccctgggtcggcttgggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttctcgttgcgtagatttgtttgcctgtgctttgtgaaaagttattgtggattgggaatcgtaaccagaatcagcctatgtggcagatggatgactcgagtggtcggaaacgaatctgtgtgattcgggatgtctacgggcatcatagactaggcctcccgagtggaagcggattgttgtgctgctaggcagctggactctgggagtctgagaaaatgaaaaaggctctgggagccgcttaatcaagtgaaatggttctgggagccgagaagtaatgatctgacctgggaggtcggtacattaccaattgagctgttgaaaagcatctcttaagttgaatcgagacgcaagtctctttttgacccaaacctaaaaagaaattaatcacctagcgatttcaaaatgatttcaaacaaaggatttgcaaaacaaccttgcctctcttccaagcttacattaaacacctaaattcccgtgacttgctgagtacggaagtactcacccttgctctatataaatatttatagttcctccgccttgaagagaagatgatgtgaagtgaagaatagggtttcgtcctggttcccagccgtcgcctgtggtgttgggtgttagtccgttggttccgctgctgctgctgttgttggtgtttcctcgtctgtgtcgtcggttgcatttctcaggctgttttgagctgcaacctaagttaaggtaaataagtcctctatttattttaaggattgcaatgattcatatttgtcaccgtgggtaccagtactatgtcctgggactggtactgtgatcgcggtttcgtaggaagcggttcgcgccgtttttcctacgacacgctcctgtcaggtgccgttgtacggcggtaccggattggggtgtgacaatacgacaggtcccccaacttacgaaaccgtttaaataaggtccctcggcagtattgtgtccggttttagctaaggtggcgcatacgtggctcattttgactaggtctttgtccgacgtgtcattaacatggcgcttacgtggcaattagattcgcaa

SEQ ID NO: 15519 - DNA, 19813 bp, Oryza sativa
tcacataatcgccacgtcaatgaaacgttggacaaagacctagtcaaaattagccacgtaggcaccacctcagccaaaactgggcacaatactgctgagggaccttatttaaacggcttcgtaagttggagaacctgtcgtacccggttttgcgatgaagggatgaaaattggattgggcgataaatagagggacccaaagtgaacttattccttcaaactaaggcccgaccgcccgattcaagtggaatttggagagtcttttacccctatgccattaagaaagttggaggttacgcgtgtgccacgaaaaagttttgagtcacctgtatgccatgacgcaaactttcgtttacccgcgtgccattccatccaccttctgttagagaatgagctctgacatgtgggacccacgtatgaaaatgactaaattgcccctgaagcattttcatctctactactcctctcccgtgccctagcctagccgccgtcgccggcacgccgccactgccacctcgcctcgccggcacgccgtccccgccgcctcgcctcgtctatccggcgacgcgcctcgtctatctgccgccgccgcctcgcctcgtttatccgtcgccgcctctctagtcgcctcgcctcgctggcacgccgccgccgccgccggtcgtcgccgtcgctgttggtcgtcgcctcgccggcacgccgcctcgcctcgtctatccggcggcgcgcctctagccgccgctgccggtcgtcgccgccgccggcacgccgtcgccggcatgccgccgccgccggtcgtcggcgccaataacgttgtctttcggcgctaatggcggcccttgccggcgtgccattaatgctgattccatccattagcaagggtaaaatagatctttgaaacctccgtttgtctccgttagtgctgattccatccaaagtggcgcataggcaaaagaaagtttgtctcatgccaggtaactcaaaagtttttttttggaacacacgtaatctccaactttcttaatggcgtagggtgactagaatttggaaccaatgtcccagcagacattgaattggggattttggggcatctaggggtctcggcgccgtcgccgccgccgccgcttctagctcttcttctccgtgacgggcgcacatcgcagcagggtagcgggcgcaatggttggccttaaccggcgagggcgctaggtttgccgtccaggtgtcccgtccgacgagctccacacaggtcagccgaggccgagcggcaagtcacgcgcgcggcagcatcgctcttccctgccttgatcggtaggttcctgatctcagattagttcgtttagtaggtggattaacgaacccatgatgtcgatttgtagccagatttttctttcttcaccattttgatgtcttgtttgatttaatccccatctgctcacctgcttgatctgctcttgccgcggtgaatccttttcccgcggttgcaggctgacgacttcctctcctccaccccacccccgatggaggagaacctccccagcaggcggccagcatcaccgacgagctcatcgtcgagatcctccgccgcctccccgtccgctccgtgtgccgcttcaagtgcgtcagcaagtcatggcgcaaactcatcgccgaccacgagcaccgcaagaagctgccgcagacgctatcgggcttcttctacaagagcatcgactacgagcgctgcccgcacatggcgcgccatttcaccaacgccactgggagaggcatgcctctcgtctgcccgaccttctccttcctgccccagtgccaccacgtcgtcatcttggatagctgcaatggcctcctcctctgccgctgccacgtgtctcgtgagactttgcagttccagtatgctgtgtgcaatcctgcgaccggggaatgtgtgatgttgccggacgccaactgggctattgacgagaaccgcaccgcctgcttgtgtttcgatccagccatctcgtcgcatttccatgtgctcgagtatgtggaggatgaagagtatgtggaggatgaagatgaatacgacgcactggtcacaggggtggtgatctattcgtctaaaactgggttatggagtctccatgtaaatggatgggatgatgaagttatggttagccttccggtcgatcggacaagggttttccttaatggttttctgcattctgtcacgacttgcgatattgtggctgttgacatggaggggaagaaatggaggaagattcccatgccggatcctgatggtgatattgggataattcatcaaactcagggtcgcttgtgtgcttttaatgttgatccaaatgatatcctcgaactgtcaatttggtttcttgaagactatgatacagataattggatcttaaagcacaccgttagctcaattaatctgtttggacgaaagaaataccaattagattttgactaccaagtaattgcagttcatccagaatgcaatttgatcttctttgtttatggatggcacaatactttgatggcgtatgaaatggatcgcaaggaagtccgtgtcatacgcaaactcggacatgagtcatgcctgccatacctaccatatgttccaatgttctctgagtcattacctgatgggtggtgctaacatgcagaggtgcggctccacttatgttattgcaaaaccatctttgtaccgtaatgagaatcaggcttagggtcagcagccaatctctaatatgaattatgaatttctgttttatcgtacttgtgtgatggctcatttgtgttgttttgaagaatgttgtgaaatcatagatggcacgtaacttggcctttcggaaggtatgtcctgttctgaaggttatgtcttgtttttcactggtgtttaccctatgccctatgctagttaaaatttatgtcctgtgttaacaagacataccttttgattgtaccagcagtcagcttatggaacagtgacaaatgctttggaagttggatcatatgtacttcttttatttctgccttcttttccccttttgttctttctgaactacttgtctgtgttgcggcaatgtgcccatgcagcttattgtctcctggatcatttccactcgtttttgtttggtcatctataatgctcattaatttgggcattgcttcccctgcccttacttgctggagaagaagagagtgcaaacaagagcacgtacaatggtgcaccaacaagaaactgcagaacattctagaaatgaaagataacaaagatgggtaaccaaaaagtgataaaatagttaaactattctgcactgtcttccttttatgatcacccttctgaaatttcccaattacctgctgcaaaccatgataaaaactagtattatgttcttcttaagttccaacaagtatcaatcacttcaattgtctccattctaaattacttccactttgaattcctctaagttacaacatgtttaaatcaacaatggcataaattttgttctaattctcttcaattatctctgttctaaattactgtcaaagtgaccaagcctcccaataattattgtggtgttgagagttgagacctggtagttacatccgattctccacttcctttcagacccgctgcgagaaagagcaatggataattggatattttcttttggccacatgaaagggcgtattaaaccatatttgggcatcccctgcaaagaaagctatgcaaatctagcattagttttcagttgtcaccgttttcccaaactatttctgtgttgtagagtagtcgcaaataaattgttctctgtaattgaatttagtatgatattttctccaaacttcccgtttgctgtcaatgtccaaactattatgactttgatcccttgcagtagaaaataagataacgatgttctcttttgaaaataaaactcccagcaacagcgatgttttgaagcctttcaagtttcaacacattatacatgtcatggtaaggtcaaagatcagctagtgtggtgtggtggggccaatagaacacgtcatcggacaattaacctaataatgcgacaccatcatctgcatccttcccagttcgcagtgctcgccggcattcacacttaggggttcagatggttggctggttgctcctccttcaaatttctatcgttccaacgacaaaaatgcagttgcaaaacctgcaattcattgcatttgcacttgcacaccgtgatgtttatctgcaatactcgtcacgatgatctgcagatgaggctgaggctcatcgaaggaggacaccggcggcgttgagcacttgatgatggctgatgccagctctaactgtttgcagataaccaggacgcatgtaacgtcatgctaggaacaacagaaaacttaattgcgtccaggaacattcgacgacatggtcatagtaaatactgttagtattcagtgcacaccatgtggtacagatgtatatcatgtagtactacctagttctgcagtaacatagaatcttccattgctgccaatctatgagtcaatatttagcacaacaattaggcttcagaaagaaagaacaaaaaaaacattttccagcaacagcgcagcagcctgatgatttgactaatacaacaaaacaaatcacggctacaattccatttgccaaccaccttcttaatttcaagccctttgacttgtgtgatcgcccaaagtacttaagcgagagatcgagagagcccataactacggagaaagctgagaaagaaacacgcactaatcaaacaatctcttcttcttcttcttcttcttctgttcacaagcaatcagaaaagaagaggacacgccatgtcccttctcgtcgtcttgttcttcttcttcctctcgccgccgctcgccgccgccgccgcctacacggagtactcgtgcaatggcacccggggcaacttcacggaggggagcgcgttcgggctcaacctggagctcctcgcggcggagctccccgccaacgcgtcgtcgtcgcggtcgctgttcgcgtcggcggccgtgggcgccgccgcggcgccggaggacagggtgttcggcctggcgctgtgccgcggcgacatgagggacgccgccgcgtgcgcggggtgcgtctccggcgcgttccagcgcctccgcgcgctctgcggccgggaccgcgacgcgacgtactaccacgacctgtgcgtggtgcgctactccggcgacgacttcctgtcgcggccggacgacaactcgccggtgatcaacgcgctggacgcgaacgcgtccacctactacgggtgggacgggcggaacgcgacgacgcggagcttcttcctgtcgctggtggggacgctgttcggggagatggccatgtacgggtcgtacaactcgtcggcgcggcggtacgcgagcgccgtgatgtatgtgaacccgcagctgccgacggtgtacgggctggcgcagtgcacgccggacctgtcgccggcgcagtgctggcactgcttccaggggctccaggagcagaaccggcagtggtacgacggccggcagggcggccggatcctcggcgtccggtgcaacttccggtacgagagctaccagttctacgccggcacgccggacgtcaggatcggcctgcaagacgtcgcaccctcaccaaccgcaaacaatggtaacaaccaacacatatgctacacacacgatcatttcttctcctccgaataaatttgctcaaaagctatagttggagcttaactactattgttgtacgttgttataaatgttaaacttttgaccatattgattgtgttttttttttggaattattggagcttagattgaaggaagggtccatatcaattaaaacttgctagtagtaattattaattttgaatttgggggttacgtttatatactattaataagagatttcatgattgtccagcttatatgcatggtattaattttaatgtcatctttttatttaactcaaattctgaatacaatctatggcatgataatataatccacctaatcaacaaccagatctttcattttaacatgagagatctcatagtgcttaattagtataaggtgtaaacagatagatttgttacataggggctgttcagattatatcattttcaatcataatatttttttcggtaaagttacttaaaaaatgcctatatttagttgttgccaaacattggtaaatatataaaaaatcctgctaaaattttagtaatattgtcaacttgccaaaaatatcaaattttggtaaaatttattttgactacgatctgaacgccccataaatttgtttgaattggcaaagacaaatcatattattattactattactgtcatgtttggttgtgagctcacaatggtcaaatacgtaaccacttaatggtggtgttttctgtcagtgcattatcttttctacaaataacattgaaacaatctctgtatgatcactactaattttcttctttatttatgcaggaaccaaccacaggaagaccttagttatcgttctatccgtgtcaatcacggtcttctgtttcatgctggtcggctgcctcctactgataaaaaaactacggaaaggagacggtaacaacacgatgccactaactccctctcataatgaacatcattttctccctccatttcagcatcacaaagttcttaattaatcaaccaaaccacaaatgtccaatccatcattgatcacagggaggaagtcgaatcggcagctggaagcacattccaggaacagctccaagacagaggaggcactgaagctgtggaggaccgaggagagcagcaccgatttcacgctctacgacttcggcgatcttgccgctgccacggacaacttctctgaagatcacaggctcggcacaggcggatttggacctgtctacagggcaagttatctgaaactcctataatttttgtttttacagtcgatttttgaccaaaatgtgtgaatggttgtcgctatatatgctaataatctgcggcatcatagttgctgtccctattgtttagcagtcaatgttgacgaaaatgcggatgacttggtgatgctaacatgcatgattattatttgctttgtctgttcgtgttttcagggtgagttgtctgatggagccgagattgcggtgaagaggctggcagcgcagtccgggcaggggctgaaggaattcaagaacgagatccagctcattgccaagctgcagcacaccaacctcgtcaggctcgttggctgctgtgttcaggaggaggagaagatgctggtctacgagtacatgcccaacagaagcctggacttcttcatcttcggtattattctctctttttgttcaatacaatcttcgtccaaaattatacttaacaatttacaatttagacatacagttgtgtagattcatatctataaatgcttatatttcggaacggatggagtagacaggggcggagctaaaattttctcaagcttaggactaaattagtgtaattttcatatgttcgtcgaatactaatatttgagatatgaaattgagtttttttatagattaaaaactttttatcattttcataactatgcgattaattaaaaacaataacacaaaagcaaatgccctgaatatataacaggtaaaaagggaaaagacaattacttttgtttgtagtccacttgatcaaacagcgtgtcaaactgctgttaaaaaaaatcaacgtgccaaaatttcaaaagactatgttaccgtcgacgttttactcatcttccgattttcctaatcctttctatctttttcaagtacggtttaggaaagaaaatgtatattgccaaatggtttccatatccaaatggtttccatatccaaatggtttcctaattaaacaagtaaaaaaaagtgaaatggattacttctgaacgactttgttaccgtcaacgttttactaatcttcgataatgttttcacgcatgtagaccaggagcaagggccattgctggactggaagaaacggctgcacataatcgagggcgtcgtgcaggggctcctctaccttcacaagcactcacgtgtacgcatcatccaccgcgatctcaaggccagcaacatactcctcgacaaggacctcaatcctaagatctccgacttcggcatggccaggatcttcggctccaacatgactgaagccaacaccaacagagtcgtcggcacctagtaagaaaaagaataatgatatatatcgtagcaatacttatcattttaattacactcctattttaaattacttagcattttaattttttttaagttcaaacattcgtaaatttaaccatcaattactaaaacattataaagtttagcatcataatatttatgtttttattcaccatgagatgtaatttttataatatataattgacatgttactaattaaactatataaacacttaaaatgactttaaataaactaaagtaacaagtaaattaaaacggagagagtactggtaatctggtattaagttttagcatgtcaactggctgggcaaattgattaatagccgtgatgttttccttcaggtgtttgtacctttatttttggaggataagatcaggtacctgcagtactgtacttactagctagtggtattgattgttgttttggtgttcacgtgtgcagtggatacatggctcctgagtacgcatcggagggcattttctcggtcaagtccgacgtgttcagcttcggcgtgctgctgctggagatcgtcagcggcaagaggaacagcggccaccagcactacggcgaattcgtcaacctcctcggatacgtacgtttttacgttgttttttctatcttaatttctttttctctctcgctgaaataatggcgtgttactattctagtacgacctttttgtgtgtgtgttcttaatcaaaaccgtacttgtcgtccgtggattaataaatgggcacgcggcttatcctgtacaattatcaattatgtcgaaacgttttcacgtctacactgtagctacgtttgacttacgctagctagcaacatgattagtcatcactaacgaggattaataaattggttgatcaacttggcatctttttcaataactttatcgtgctctctactgttacaattatattccgattatatatattatcatcagctgattcttctataatataatctgagctattaatttatgaattccaatactaataattaaaagatgtactataaataaatactactatctattagaatataaaagatttatatatttcaaacatagagtttttttaaaaaatatattattattttttgtcaggcgtggcagctgtggagagaagagagagggtgcgagctgatcgacccgacgctgggcgagtgcagcggcagcgaggcggcggccataatccggtgcgtgaaggtggcgttgctgtgcgtgcaggacaacgcgacggaccggccgacgatgacggacgtggcggcgatgctcggcagcgacggcgtccccctgccggacccgctgccgccgccgcactaccagctgagggtctccggcgacgactacgacgacggcggccgcgggtcgccggccggcggcggcttccggccgtcgcggtggcgcttcaccgactcgtgcagcaccaacgacgtcaccatcaccaccatcgaggaagggagataatagcggtcgatcgatctcaccggcatttcgatcattacgtttacgcgttcgctggctggccttcacatgtggccaacgcgtccttttcgtgagacatctgtgagtgagtgtactccacttgtggtcgatcgaagtcgaagataggcagggcgcaacagtggtggttggcatggttgcatcaccgtatggatgttacgtcgttgtacagagacaactcgtatatggggatgagtacctgagcggctgagccaacaaagagggtgttttttttttttcttttgtacaacttttgtgtgaagagtgtacgactaaagctggtacgtacagtgtttgttgatggatgaaaagaaagtacaaggatggttggatgcaaattggggtttggggtgtcgattgcatggttggtttccttttgccacgaacacccccatgttaggtgtggcgtgcggccgactattaattcaagccgtgttaatgcgaagcgaaacttgatgatggttgacgatttattcgcggggggagcacgtgtgagcttggtagttgtcgtcagcagaaaataatgcagtacagtacagactgatggaaatcgacggattttcccctttgtaaaaatgggacaatgtgtgtttccctttcaaaataatacacaaggtcatcccaccaccacctctcatctgcagcagcagcagtaataataataataataatttttttggcatggttaccaataaatatatgataacataacatggtcccagaaaattaggactacaaatttctttatattttaatccatactaatgctttctaatatatttaaagaccactcgttacatttttaaaaagttttgctcttcctactttactaagttggctaaaatgcgtttattttcttcagcttctttaaagtgttggatggtaatcatagccacctcaaagaactgtgctcgtgcccacaatgtgaacatgctcacgacacaattctatttagtgaaaaatatgagtctagctaagtctatttgtcacttcggtacgatccgtttatagacatcatctcaacagataagtcctttccacaaaatatgtcctaaacaaccatttgaaagatggtatgaatttcaacaattaaatctcaacctggcaatctagatttgttatttgcggtatataaactataagagtggtttcgtagtccttacaagggtacctatagttatcatattttctatatctaaaatttatttagtgtatctcggtaccttatttattaaaagctccaaaatttacatgaaattattttggtacaataaaattgctcaaagtggtctaaaccctaactctccttggttcttttgtctcgccctgctgctgctgccccctcacatttcttctccaatgcggacagtgggtggatcttgtacttgcctattgacaattctgcatcccaacagttccgtacttccgtagtctcggctttttagatcaaagatcgatcaccgaagtctcatagcaagtttgataatatagcccactactaactccaaatcatctatagccaatgtaatagctaattcttacagtacatagttgcttactatactattaatatctggtcctacttgtcatacacacattacgtcttataatccgtgctgcagctggctacagatctgtagtccgctgttcttctctctcttcctttatctttttaaaatatatttatagctggcttatagcctgctattatacctgctctcgatcagctaacaaattgtgttgcctcgggccaagagaattcgctggccacatggcccataggccatagtcatctgccgccatcggcttgcgcccttgcgtaagccttctgggccgaacatggccgatcacccaagctaactcgtatgggtcatcatttggaggtggcacacatcgcctccttttccctcatcaattgccgcgacgctccttctcccagccaaggtgaacggatcctcttcctcctcggccacctcgccggcgtccggcgagagacccaacaagatcgccgcctccgtctcgatcctgcgaccggtggcgtcccgatcgcaggagaggccctgccagtctgctctctgctgccataggtggtggagatgtggatcagtatatgtaagttcagttcaggtatgtatgtttcatctggtaattaatttggtttattcccaacaaatttgctaccaatttcactacaaatagtgtacaatatgtcgagttgtttacatcttatagacctgcatgtaacgtagacgaatcaggtctctcctttataacaaccagagatcactactccgtactgttttatcaacttggttagacgcttgttgactgatatgcgtattccaattgatatgatacagggcgttacacttgtgtgtttctaagtcgactgatcgctcacaaagaaagggcacattcttattgatgtatattttattttccatgggagatgtagccactttttccttctaagaagaatgtttaagggcctgtttagatccatttggaatggtaaatggcaaatggtaaaagttttggtggcaaaagttttgtcattgcaaaagtactagttggtgtttagatgcatgctaaagttttgccattctagcactaaagtgagagagagaaagagagagggagtggtcccaaagcactttttggcacaatttgctactatggactagcaaatgctaaatgccaaattgccaacttttgctactagtgtttagatccaaaatgacaaaaagtgctacaaaatggcaaaacttttgccattttggaggatctaaacagggcacatcttttcccatgtttgtcaggtggagatatataaattagagatcagacaatgaagggcctatttagatccatttggaatggcaaatggtaaatggcaaaagttttggtattgcaaaagtactagttggtgtttagatgcatcctaaacttttgccattctagtactaaagtgagagagagagaaagagagagggagtagtcctaaagcactttttggcacaatttgctactatggactagcaaatgctaaatgccaaattgctaagttttactactagtgtttaggtccaaaatgacaaaaagtgcttcaaaatggcaaaacttttgtcattttgaaggatctaaacagggccgaagtcacaacatacccctgatcgtggtcgcatgcattaaggcatccatgcatgtatgttatttcattatattgatatctctaatttcatcttttattgcattctagtgcatgaagtcgcgcatgcgtgtgactatcactatcttttctgattagtgtttaagaataatctattactgatattatgtcactgaagaatttgttgtgaaaatatataaaatatatgtttgttttaagatagaaatatatgtttttatcatttctctcaaccatacaaacattttttctttatttcttatgcgtctcttcgttgctctatatccctctcccacatatggagacatggaaagctctataacaccctcttttatccaatggctgaaatttattctcttgttttgtttgcttgttgatctaacggttattatttattagatgatatggctcattcttcttatgttttgggattctcttttcaagagttaagatatatgtgtccatccatccatctatctatctatacagacatatactaattagattagttacttctaagaagctactacttttattagaaagatctaaccattaatttgttagatcctattgtcgtgaacgtagatcatgtgtgtagagtccaaatgaaataaatcatgcaactagaaatagaatggtgattctatttaaaataacttattttataaatattatctgtcaaactaggatcttgatgactatatgaaaattcaaaaacactatattttaaaatagagagggtaagttgtaactgatgtgaactcttattttaatatgaacagccttgaaagtaaacaacacgtttaaaatactactaaaatattaatatctagcaatagcatgtgcaacccaaaggttacgaatctttgtctataggaatagtatatgtggagtatatatgcacatgttcatcattgcaaagatcaaaagtgatcgagttaataactaatataatgcattgtgaaagctctttagttggcagctgctgactagtcaatggacaatggaggtttgtagtcaacggtcaaagtcaacactaaccccgcttatctatgtatacctactgaactggagcagcctgtactactactccggctgaattatctcttctccggcgatgactctcgccgcgatcctcctcctcgtcctcgccctggtcgcgccgccgcttgccgccgccgccgtcctcgacgacggcggcggcggccaccgcccgccgttccacatgtgcgggatggtgcagggtcggttcgctcccaacagctcgtacgaggccaacctgcggcgtgtcgccgccacgctgccagccatggtggcgaacggatcctcctcctcctcctccggcgtcgatgtcctcgtcggcgagcggcccgaccagatctccacgtcggccttctgcggcgccaactcgtcggcggcgccggagtactccgactgcggcgcctgtgtcgaaacatgatttcggcaataataaaagggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccctgtgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctgaaaaataaagtcaggtgcatcgaatagatgcacctaataggtgtagccccccgacaatgtggttaattgaacaaaccaagcatatagtcaaggaataaataatccaaccaaccaagtggttttgataatcgtaatcaaccaagtgacttgatatcaatatatagtatatgcggtgtgaatcctccaaataacatgatccgagtgatataccaaaatagctataaaaaagctcgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaaatgaccataatatataatcagcctaagccataatattggtcaataaaaatgcacacttacgtggcaaaaagcaatgatattatatccaatcaattgcttgataaacccaaacagcaccttgactatataaaaaagtcagcggggcagctatgtaaagctttactgtttgacacattttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagatcaagcgtagctcatatgaatagcttctgatctaaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtttattggcaatagctgacgcagtcggcatggagatgaaatgaccaacatgaagacgaaattgctcatcaaaagtaacggaagatgtcattggtagtaaaaaacagtgacaccaatcaaagataatgaagttgcacagccgtggaggcgaagaaaccaatcggcagcagacaagtcagccaacagtgaagatgaaggcatccagcaacatcgacaaaattgagcggccatggtggcgaaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatcatgaaaatgaagaaaatagtcgacgacgacaaaggcaaccgtcagtagcaacagagatgatcgactatgatgacgaaattgctcatcaaacagtagtagagtgggcaatgttgaagaggcttgacagtatgttgatgaagatgacgatgttggtgatccagccaatagcagtgtagcaaccaatgataatgacaaagacgctcatcagcatttgcatagtaggtcaaccatgaaggtgaaataataagtcggcgaaaacataatcatccattagcaacagcggagatgtcagggccgatgaagcagaggtgctggtgatgatgtcagtgacaataatccatcaaattaatgttatagctgttgtagatgcttcacttggaggagagttggtgttgttgtccaactcgtccaaaccgaaatatttgaagttgttgaagtagaatgtctgctccgaagcaaagatgaagataatgactcctggagttgactcgttggttgatgaattgatttcttcagcttgacataaaatttgtcaaattttgagccttatatttgtgtagcccctgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcacaagtcggcggcggcataatcagtcggcgacggaagatgatgatgtccatcagtagtggtagctgtataaaccagacgtagaggtaagggcactaatcagcaacagacgagacgaccggcgattaagatgtagatgcccaacaacggcggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtcggtgaagacgtagacgcccatcaacggtggcataataggccagccgtgcaggcggaaacaccagtcggcggcggacgaggcggccggtcggtgaagatgtagacgcccaacaacggcggcataataggccagccgtgcaggcggaaacaccagtcggcggcggcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgatggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataata

SEQ ID NO: 15520 - DNA, 54166 bp, Oryza sativa
  unsure (1)..(54166): unsure at all n locations
ggcggtgaagtcgtagacgcccaacagcggcggcataataggccagccgtgtaggcggaggcatggacgcccatgaacggtggtgtgaccaaccacccgtataggcgaggacaccagtcgccggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtctatgaccagcatcaatcgcctcaatagtgccgcgtaattatatgcgaacaacaacaaaaaatagcaagagattaatctgggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcgaaacatgatttcggcaataataaaaggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccctgtgggtatggggtacccataatatccacagcctgcgtcgccaaggcgctccggtacgcgcggcggctgtgcgggtatagcaggcgcgccatggtcgacctcggcgcctgccgcgtcagctaccacgacgtcggacgcgtggagctggagatacaagcttcattagccgttcgcatcttcgacgagcgtgagtgatctgctactgctagctcgatagatataattatactgtgattttgttcgccttaattcagtactgattccagaatttcagatagactttgcttcatccgaatcaacattttagtcgttttcttttccagatacttcatcttggtggagaattgttttgacccatgatttccctatgatggtggtgttccaagtgatcggagtcgcctgggttctgttcatgttcctccaggaatggcgagacggtagaaggagaagagcccaggccaatcggctgccataggtgggaggttcagttcaggtatgtttcatctggttttgtttattcccaacaagaattcgaaaagttcgttataatatcatagaatgtttcaacttggttgaaatgcaaatataatgtagacaagttaaccagagttctttgagatcttggtcggattcttgactgatatccatattccatttgatacagggtttcaacttctgtttgtaattcgaccgatcggctgatcctgaacaagcaaatccatttgcggcaaaagaaaagggcccatatatttccatacaagattgtacattcagaaattgatagggactgtttccttgttcctccgatttatcaaatggaaaaggcgatatactgatactccgtataatgttggagactggagagtgcggactgataaatatgcagatacagaaatcaatgtagggctgtaggcatcacttgcgatgtcaccttgttattgtttattatagaaaaagtccaatatgactccctcaactgtaggttggatctgatctttattcctcaaccgtaaaaccaggtataacgactccttcaattgcttagactgtgttcgaaccctcactccctggcacagaaaacggatgagcgattagcacgtgattaattaactatttgcttttttaaaaaaaatggattaatatgattttttgaagcaactttcgtatagaatttttttttgcaaaaaacgcaccgtttagtagtttgaaaaccatgcgtgcggaaaatgagggaggaaagttgggaaccggaggtaaagaacgcagccttaaaccagaataatttaactcccagggtagtttgagagcgattttggctaaggtggctcattgaccctggtcaactggctgactcagcatgtggggttcatatgccaacgcatcatcttcctctctatctctccccacccactcaagctcgtcggcgtctgacgcaaataggcgaggctttcccatgccgctacccgatctcaccgtcgccctgcgtggtggagggcaaagggcggggatcccctttcgcctacctccgcttcgatggcatgttgctcaggcaagagcgcgagtatgacgacgccgtcgaacaagtagactctgccatgccgatgacgtagcagcggaggaatgagctcgagatggaatagtttggcgcaggagactagaggtctatgacagtttagggcttgacatcagttgaaggagctctgatacccaactagcctcctagagcagatccaacacaaaattctccacgtacgccggtgtctactccttgtcacaatgttgtcattggcctcacttgatccccctcatgatcaagcagatatggaaggcggcttggaaaaagaatatggatagagagaggtagtccacactgttgcgtcccaagcgaaggactacaccgaccatgggtcctgccattcattcaacttcctgtcacaacgcctccctcaccttgcatggccacaatcactatgttgacctcaccaaatgctacagggcatggaggacgccatcaaccaaggtgccacccctattgtcacaccccaatccggcaccgccgtacaatgccgcctgacaggagcgtgtcgtaggaataacggcgcgaaccgcttcctacgaaaccgcgatctcagtaccagtaccaggacatagtgctggtacccacggtgacaaatatgaatcattgcaaatccttaaaataaatagaggacttatttaccttaacttaggttgcagctcaggacagcctgagaatacaaccgaagacacagacgaggaaacaccagcaacagcagcagcagcggaaccaatggtctaacacccaacaccacaggcgacggctaggaaccaggacgaaaccctattcttcaattcacttcatcttcagcttcaggacggaggaactatatatatttatatagagcaagggtgagtactttcgtactcagcaagtcacgggaacttaggtgtttaatgcaagcttggaagagaggcaaggttgttttgcaaatcctttgtttaaaatcatttttgaaatcactaagtgatttatttctttttaagtttgggtcgaaaaggagacttgcgtctcgattcgacttaagagatgcttttcaacaactcaaatggtaatgtaccgaccccccgagtcagatcattacttatcggctcccagagccatttcacttgattaatcagctcccagagcctttttcattttctcggactcccagagtctagctgcccagcagcacaacaatccgcttccactcaggaagcctagtctatgatgcccgcagacatcccgaatcacacagattcgtttccgaccactcaggtcatccatctgccattcaggctgattctggtaacgattcccacaccacaacaacttttcacaaagcacaggcaatcaaatctacgcaacgggaaccacctcacatccgcccatgaccgtgggcacggctgttcgaacagttagttaacctctgcagaggggtacgctttacccacaagacacgaacttactccagacactggccggtgtcagaggctcgcgacaaagcctttcccaagccgacccagggttacctcatgccacatagaaggatcaaatcctcacgtaagtataggccattttaagcattcacaaatcaattccaaccaccttgatcggtaagtgagcaagcttctcatccttgccttaccaggaacccggtttgtccgaccccgccccggcgttcccaactattggcatgcgaggtttccctgaaccgactagttacttagccagggtgtcccattccaccttgtggttgcactttgattatgctcgatgagtttcccacaggaatcggtctttatatgcgaatacgggacagcgccacgtaggcacggctcccgcatcgcgagttttcgcaattcattttattttcaaacacaccgacaccacatgtcgggttttcaaggcttcacaaacccatttcccaagttttcgacaatcaacggtgtatgtgggatatttggtatgcgcgctcagagagcacggataccgaagtaccacaagggtggagcaacaaggaatcagggtagtacaacctacaggaattagtgcgactactgggtaggtccgtcggtttggcatgcaaaccgaggccaagcaagttaaacgtgagtgattctaatgaagcaagttgcaaacaaaataataatgactttccaattataggagcaattgatcaaagggtgacttgccttgctcaaagtcttcacgaagcttcacgaatcttcgagaaaacccgcggttgacggaaatccggtaaccacaactatacgcaaacaattgaaaacctagacaaaagaccaagaaaaagaccctatttagactaaataatagtgccattaaatagatctcaattttacggaattactggaagtggaacggggtcaatcggatgagcggttgggaatatatggattttcgaagtttattggatttactaatcaaaggaaaaaggacttaataatttattaaaccctttttggaaagaaattgaaggagggatgtgatttagactccctcgggcggcttgggcgcggcccgagaggagaggcgcggctcggccgaactaatgggccggccggcccggagaggcggcccaaggggcgcggggagagtgagggagagagagggccggtgggccgagtccaccttgtggggtcccgagtggggcccgcttgtcggtggcgcggctcaccgtgggagcggtgcatgcggcgcgcgctagtgttcggataggagtggcgcgcagtttggtgcaccgggtggaccgaagggtggcgggcccacgcgcagccgttaggctctccatgcaccgagcgcacgcgagcggggacgaggctggcgggttgacttggtctagccgacgtggcgcctacgtggcggtcgcgtcggatggcgagaggaggaagacgaaggccggccgagatggacggcggacggcggcgcgcgtcggcggggcggtgcgaggcacggcgggaggagggaataccaccggagcgacgagcggatcgaggaggagtgagcctacgggacggattagaaggggaagggccgacgacgacgaatcacggcagaggtcaccgccggtgagggaaagaggaaaactcgccgggagaggagagggatcgattcacggtggtgagagcatatccggggttcaaggaatccttttctggcaccggatgggacggaggagcaccgaggagagccggcgacgagcggcggcctccgggagcggacggcaatggcggcgaggccatgccgggcggcggcggggctcggggcagcgtccacgcgcgtttgggaaggtctaggctagcaaatgcgcaagctaggggggagaggaagagtagggagggagaacgggggctaccgcgtcgggagatcgccgggaagagcgtccgacagcacaggcgggatcacctcggtctcgggccggggaaggggagggagagagggcgaccagagtcctctttggctccgcgcgcacgccgtcttcccggcacacgcgacggcggaggaaggcgaggatggcggcagcaaggcggcgatggcactgcagcggtggagactgaagcgggagggattgagaggagggactcggctttatagtggaggcgaggtcggttcgcgcgggaggtcggttcaaaccgaccttggggcggtcaaggcgacaactggcggtcgtgctcggagctagcggccaatcggcggcagaggcggtcacgggcgtgacgctggctaaggaaaaaggtgaaaagaggagggaaacgagctttgctctcttgctattttgggaggaaggaggatgtgagaatgagagagaggagcacgagctctgtctcctggttttggaaggatgcggcatgggggcatcggagccaggcgatgacagtggcgacgtcggcaaaaggcgagcggggccgggcggctgcgcggcgcaggcgcggcagggctgacggcggcagcgaccggccggtcggccacgcgcgcgcgcgcgggaaagagcgaaggcggtggcgggtttgaacgacaaagaagcagcgcggagcgcgggcgagagagagcgagagaaaacgagagagagagatcgggggagagagaggcactttctctcaggcagggcacgtgcaacgcacgtgaggaggggagcgggctgaaaggagatgggccggggaagaagagtcggcccaccgagccagagggaggtaaaatagactttcatagagaaggctgatttggagagaattggagtttggatttggattcaaattcgatattcaaactcgagggttcagggaggaatcaaggaaggctcaagatagagtttggcatttttgggaattgggagcgagcgtttagcgaggattcaaaggatgcgactgaatttcggaatttgatttggagacttgaatcggaagaggaatttgaggtggaggattttgatttcgatgagagggaacaacgggatttgaaatgagatcttggcacgacatagactcgcacaaaaagaacgaaaattttcgcaattaggattttgccgaattagtttttaacgtctcacgaaaagcggagcgttacacctatggccctcttcactgttacctgggtgacgaccccctcctcgcgctacctgtaggtgtagcaggtgttgcctcgaggggagaaagggggagagaggagagagtgaatgaggaaggagatgagtgtagccatttacatgtgggtatcatatttcttaattttttgatgactgggttatacgtggacatcatgtcagctgaaaccatcctcacaatagttgagggagtcattttacacaatttaaatagttgaagagatcaatatacccgcttttacggttaaaagatataaatcagatccgacctatatttgagggactcaaatggactttttccagtaatctttgtggtcgtctattgtaggcggagttctatcctagcaatctgggcccagaacagcccatcagagcatatactcgtagcatatgggccgttatttcttatttggttgtggaaaagtatatctgagatctctcatcttgtcactgaattacaaaatcgtccctgacatcacatgttgggggaagagagggagatggagagggagaggggaaagggtataaagaagctaaggtttcactgacatgtgggccctacgtgggtcctacactaactcagttgccacgtcggacaaaaccagggtcaaccagagttaatattgtctaaggactcagagtgatccggttttataagttaagggatgccatatactccctccatccataaaagttacacatattacttttgacactaagaccaaggagaaattaagtcaccttagatgttacaaaatcaatgagtgaatgcaagcatgcaaccaatgagtatttagatgactccttaggttctaataaaatatttaatttatctcttcatttaagtcttgaatgtataaagactataaatagaaacaacttatttggaaaaacttaaatgtgaaataggtgtaacttttgtggatggagggagtatcttgtttttgggtttagggacaattttgtaattcggtgacaagatgagagacctcagatatacattttcccttgcttgtggaatgggttgaaagtgtcaattaggcctagagggggggtgaataggctaatttaaaaatcaattaaaaacggaagcagtaatttttggatatttccgaaattttcggatatatccgaaaatttttcggagtcagcacaaatagcaaagtaaatcctagatctagttgcctacaacaagaatatgctagcacatacagcaactagacctatagcggctcaaacaagcaaagctagtggagagggaggaagtaaagtcaccaaagttgaagctcataaggttgttcccgaagttcgaatccttgaggggattctactctccgttgaggagctcactaagagccgggtcttagctaaccctttcctcaaaaggttgcactaagcactcctccttccactaagggtatctcttccctttcggaggtaagatccgaccttcacaaacttctcccggccaaccacaagtagatcggtggctcgggagcgacacctagccgcctaggagtcctcaacctccaagagtaacaaatgaagcaaagaactcccggagatgatgcaagtgctcacaaatcttcacgaagtcaacaacaagcactcacaaaactcgaatccataactctcacacacacacctaatccaaatcgaacacgggtgagaggggaaacaagaaagcaaggctcaaaagggctagagagagagagcaagccaagggcacaaatgattgaaatggaaccagcagccctcacaagtgaggggagggggatatttatagccacagcccaaattctgcccgttatgcacaataattgagattttcggatattccgaaagattttcggacatgttcgaaaattccagctcagcaccgacagcaaagtcaacgaagtatttttcggacattccgaaaacttttcggacaagtccgaaaacaacaacatcgttctggatgttctcggaaaagtccgaaaatcactttcggacaagttcgaaaatatacagaagcgaaattgactctactgatgattttcagaaaatccaaaaatcagtttcggacaagtccgaaaatatacagaaccacttttgccttcgcagtcattttcggaaagtccgaaaatcacttttggacatatccgaaaatttccagaagcgaaaatttggttctgtgtgttttcggaaagtccgaaaatgagttttggaaaactccgaaaaaatccagaacacaccaaactgaggagaaacacttttaaaaatagattttgagcactttgatcactcctcatatgtcaatgcatcatccctcttaatagtgcgactttcctattgactcaaatgaaaagaaaagttacaatatactatttgtcctttgccacatcacatctcatcaacgtatttggcgggatatgcattatgctaattcattgaggacataacaaccctcacatttgcttaaataaaaatgttagttctctctaatcacattgtaattaatcatcaaaattattaggggcctagatgcactttcagttaacatttttcgtacttgggagacttggttggtcctgctaaaatgggggaaagctagaaggcgcgtgcacgcctctagtgcacacttccggcgtaactaactccgttagttaacgctaatgacagtaattagaaaagattgtgaagatttttttcaggagatttttttactaacagattgaaaaatttttaagttagatttgataactttcgacttaagatttaaattttagagtcaaatttttaaaactttcaactcagatttgaaaactttcaactcgaaatttgaaaactttcaactcagattcaaaaactttcaagtctagatttgaaaattttgaaaactttcaacttgagatttgaaaattttcaactcgagattcgaaaactttcaagtccaaatttgaaaattttgaaaactttcaacttgagattttaaaatttttaacttgatatttgaaaactttcaactcgagattcgaaaactttcaagtctagatttgaaaactttcaacttgagatttgaaaatttttaactcgagattaaaaactttcaactcgagattcgaaaactttcaagtccaaatttgaaaattttaagttaagatttaaaaattactagtaaaaataggaaactaatcattagtaaactaattacgattttttctcctacccgtgcggcagcgaactgcgaaaaaagaaaaaaaaaagaaatagcggtagcttgcgttaaaaaaaaaagaaaagaaacgcgcgtgtgtgggccgtgtgggccggaagtgtgcgtcggcaacgcgcgtgcgtgaattagcattctcggttaaaatgtgcgcacctatcatgccttttcaagtagctgggcctatgcgccgtggctaccggcccagccaatccaagaacggtgaaggcaaaccgagtaggaagagttctagtgagaattagcttgtgcgcttgcaggggatcgaactcaggaccttgctccctatcgcaagtttctgaaaggttatagtactagacgagttacatattagttacatagttacacccgagttattaaaatgtttgttacactgtaattacatttgaaagattttttagaaaaattctttagacatttttataggtagccatgtcttttagaataaccggatagtaatatgtaaaactgcaaccaagtattccatccattccattaaaaaccaaatctttttttattgggacggtgcgagtagtttcgttcagaaatgatgggtcctgcgtatagcctagttgctagtattttttttttaaacccgagttgggtattgtaatctgtaaaatatgttaactgcatatatgcacgttgatcatcatgaggaagatgaaaagaagatcccatcaactagttgctagtatttttcttttctttaaacccgagttgctagtattgtactaatcggtaaaatatgttaactgcatatacgcacgttgatcatcatcaggaagatgaaaagaagatcccatcaacaactagttgaaacccgatgagttgctagtattatactctctccgtattttaatgtataacgctgttgatttatttaaaataaattataattacataaatttttttaagtaagataaatggtcaaacgttgataaaaaaattcaacagtattatacattaaaatatcgagagagtaatatgtaaagtaagtatgttaactatatatacgtacgttgatcatcatcaggaagatgaaaagaagatcccatcaacacaactaacataatgtaatccattgttgatctttctggactaatcaatggtcgtaggtagtcaacggtcaatgtcaacaactagctcaaacaatccaccatggaaacgtggatataaatgtgctacaagactggagcagatcctgtacgtaccagtccaccgccaccacctcccttcagctgatcaatcacctcttcctccggcgatgcctcgcgccaccatcctcctcctcgtgctcgccctcgtcgcgccgcagctgtcagccgccgacgccgatgccctcgtcgacgacggccacaccccgccgccgttccacatgtgcgggatcctgccggggccgtacgctgccaacagcacctacgaagccaacctgcggtacctcgccgccacgctcccagccaaggtgatgaacggatcctcctcctcctccgtcgacgtcctcgccggcgagcggccgaacctgatcgccgcgtcggcctcctgcaactcgtcgtcgtcggagtaccacgactgcggcgcctgcgtcgccgaggccttccggtgcgcgcggcggctgtgcccgtacagccggcacgccgtggtccacctcggcggcggcgcgtgcagcgtcaggtactacgacgtcgagcgcacggagcatgcggaggtgctcatggtgtggtgtcctccggaggcatcaccaaggagcgtgagtgatctctactcgctctacaaaacttgtcttttggattatgaatatggccatgtttagttccattctacatcaaacatttgaacatctgcatgaagtattaaatttaggctaaaaataactaattgcatagattgcaactaatttgcgagacgaatcttttaagcctaattgctctatgatttgacaatgtggtgctacagtaaatatttgttaatgatggattaattaggcttaataaatttgtctcgctatttattgacagattctataattaatttttttattagtgcctgaacactccatacgacactatatatataatatccgatttgatacgtcgaaactttacaaccctatatataaacacctcctatatgatgcgttttatgctttgatttttggttcgcctttattttagttttcgtagattcgacttcatccgaatttcatgtccacttcttcagatacgtcattctggtggaactttaggttgcataattggtataaaaggattgcgtttcaagtaagtctccaagtgatcggagtcgcctgtgttctgttcatgttcctccgagaatggcgagacagaaaaagaggcactgccaagctgctgccgtaggtgctgctgtatgcctgtatgatgtatctgttcagttcaggtctgtttcatctggtttttattcatttcctacagaattattacgctagtagttagcataaaccatttcaacctggttaaatgcaaatgtaacgcagacaaagggaaaagtccattctacaccctcgaactcttgtgcttgtctaaaatacacccccgaactacaaaaccggatataatacaccctcgaactgtcaataccggacacttaaccccccgggctatttttaccgtggtttttgccacgtcggatgccacatcggatgccacgtcagccctagccacatcagcgcaaaacattaacatgggccaagcccatattctctccccctctctctccctccccctcccctgttcattatcttctctcacggccgttggcggcggcggcggaggcggcgcagagctgcgagggcggtggcggcgcggagctgcgaaatcgatggctacggcggcggcggctgcgtggagctgtaagggcggcggctacggcggcggcgtggagctgcgagggcagtggcggcggggagctggtgcgagggcggcagctgcggcatcggcggcgcggagctgcgaaatcgacagctacggcggcggcgtagagctgcgagggcggctgcggttgcgtggagctgcgagggtggcggctgcggtggcagcgtggagccgcgagggcggtggcgtcggcgtcggcgtggagccgcgagggcggtggcggcggggagctggtgtgagggcggcgacgctgcgaatcacgagcttgctgcctcgctcagaagtggccgacctcgccggagccatacgcgcggggaggagtcatccctatgcgctcgcgccgccaccgcttggtcgaggacgaggtcgagctcaagctctacatccgccgccgcctcgttgagcttgagttcctcatccccaagcagctcgagttccaccggcgagctcgaacatggagaagatggagttatggagctcctggagccggcaggagaggtagacctttgagctcgtgctcgccggcggtcggcacggaagggaaggctggggatgtgcttgagctccgtcgccgcaacgagtcccctgctccatggccaccgatctcctgctcagctccaccgctgctctctgtctgggaggaagaaggatagagaaagaaagggaagaggagatgggggaagaagtggccactaacgtgtggctctaatttttatttttagttttatttgctgagtagacttccacatcattgccacgtagatgaaaaccagctgaaaaactacctgagggtgtaaagtgaacggtattgaaagttggagggggtgaaatatctggttttaaagttttgggtgtattttagacaacataaatagttggagggtgtaaaatggacttatccccgcagacaaacgtcacaaaccatcgtaccgtttatcaactttgacggactcttgactgatgtgcatattccgtttgatacagggtatcaacttctgtttgtaagccgattgatcgctgaccagaacaaacaaattcagtttgacgcaaaagagaagggcacatttcgtacaataatatgtagatccagttttttgttgctaataagaatgtacatcaaaagaattaataggcgcattttccttcttccagtaaccagtttaccaaattactgctgattatcctcctcaagtgaaaattaaacataccatgattccgatttgccaatcatagttgacaggagattttttttcgcaaacgcacaaaaaccttgcacgttaatatattagaagaaaaacaacgtacatcggtaacacgcctaaacgattacaggggtaggcggtacagtatgaccatgtctgcaatctccgattcatggcacacctcgaagattgaccggagatttgtgatgttgactaacactcgaagtttgatgagcagaagaaaatcgcgaacttgtaataaatgttagtcgatatagcggaatgacgactaaccttctcgatcgattcagttattgatcatccaagacacacaagataacgacacatgaacacacgatatttgttaacgaggttcagccgaaacctacatccccgaggctctgattatgggcgcccatccccaaccaatataactcctagccgctacgagtccatgacctcgccgctatcccctccttacgtgtctacgttacattgtggtcgctatagttatattgtggtgcccccctctctatttaagagagatgtcgggtttcagagtccgactctaacttcaccccctaccacctattacaactccaagtccaattataatcaaataggactagtatattcgacacctattatatcagaactagtgattcaagaggagagaagaggaaggctgaagtaatggaggggtaccaagaggtggtaataggcctaatattttagcatacaaaatgtgagggttgggcaaaaagaattaggctgagatttaatagattttttatctaaaaatatttaagggctgaggtgggttgcaaaagggccaatgagcactggcccattaccacctgaggtacctgggtgagatggggaccatgagatgacatcggtgtgagaaggagacggcgttgccctacccgaggtcatatatatgaaccagactaagtgggccagcgacagaacctactctccttaccctagttatgtggtcgtccatcgagctcatcccacttgttcgcccggacacccgtggccctgcctcgacgtgagggtgaggaggcttgacggtgaggaagaccaatcgccagggacagtcaggtggcggcgcaacggagactgaacagtggcaagtcgacgatgacctatgtgatggatctgagcgagcgtgggaaggatgcaaggggtcttgtcaccaattggcgaggtgttgcggagcgagcggggataggaagggcacaattttgataaatggaggcgcaatgatgacctggctgtgggggactggtgacgcataacggcgatctgcatgtcgaagttcggcggcgaagagtggatataggagattaggttttggggaagagcgatgggggtgtgatgggtgagggagcatgggttttggaggagggaaccgcaaaacgatgcagcgaggtgcgggttgcgaggtatggacgagagattcagagcattggatatcaagatgaacggtcgagaatcggcgtgtgccaggattggagtcaccgccaccactaaggtttctataagtaatatctcatccatcctaaaatatactctctctgttctagttcagtagtcgttctatcaaagaaattacaaaatatggtgttgtaaaaatgactaatgtgcccctatgttaatcatttcaatgcttaaaaattgacactaaactaatactgcgtctgccattctgatatgtctgcaacaagcataaggaagaaaattaatagaagtactcatgctagctagtggctaacctgctagctgccccgggcctaaacgacatcctttctgggacaatgactctagctaccccgcagggacaactaaactgggatggagggagtaaggcacaaccattttttctctatgtttcataatataaggcgtgcatgcatgtacacattaactgtcaactcttctttctctaaattcctttattttaaatgagtaaatttcagaaaactataaccactacactggccaaggtcacctgtgacgggcccaaaccctcatctttgacggcttcgcgcatggtcaatgatcagtggtcactggtgagtccagtcacctttgacgggtggccggccgtcacaggtgacacccacctctgacgggcaagttactagaagtccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggctccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaaggagaaaacagatgaatagtacaacataaatcgtagttgatcaaatgtgatgacaatttagtaaagtaccataaatattgcacatatgaaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttcaagccagctctacctttctgtttaataaataagaggttaattagcacgttttgaatagcaatgtagatattgaaatgagcttattcgccattagcaacaacctcagggtcgaaatctttcacctctcttacaagtgttgacatgttgtggcacacgtggaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatgtacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctagagttatatatacaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaaatgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagccggaccaggtgtcctttactgtatcgatggacaccttggcatacccagctagcaggtctgcgccgtggaccttgtctgtaacagagggcttgaaagccatgccctcagcgacttcaggagcgaaagttgggtggactctcgctagtaggacacattgtgctgcgccctgcataaggtgaaagtttgaatttaatattggaatgtgtacatgtcttttattacatatggatcggataacaacaattacctcgatgtggtccactgcagctagtggtgcgatagggagaccaggggccggcacctctgtggatgcacaactactcctatgctgtgacggactcgcgtcgtgttgtacacgaggagttggttgcacagcaggtgttgtgactcggggtatattcatgtcggcgaggaccttgttaaccctttcttccacccttgcatccatgctagcttctagttcttgaatgacctcaaccttaagttcggccttcaaacgagcgtccctctcttccttggagactttccgtttcctgtattgggatctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggtttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactgttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattatgtgaccgcggatttctactagacctacttgcacttgtcccgcccgacatcgacgtatgttgttcatgcggcaattctgcagcacaaacagaaggcaatatttgctaaggggtgctagctaaaatttatgtggtcatgtggtgaaaatttatcctataaattaccatgaatttcgtgttgttggaccgccgttgtcgcgggatgaccttctgcaactgcctctgtggctgggtttgcttcttcctggaccctcgcaggtgttggggagggtgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggagaaaaaagcaacccaaagaaaatagaacaagtgtaggtaatctgttcttatccataaagaaaagagcaagtgcaggaaattagagcagtagcaacagcatggccatataatagcagcaataagagcagtagcagggccatataacatcagtacgggtatatatgccacaggggcagcaacagcagggggagattcacataaacagcaacagcagagggaaattcacatagacagcaagggtatataaatcaacaagtgtagataatctgttcttatccataaagaaaataacaggtatagatagaatgttattaagcaattcatccttggccatttaacaagaagtacaggggcaacaacagcagtggtatataaatcatgcatatattattgtagataaaaaaatgaacaagtgcagaaaatatgttcttatgcataaaaaaagagcaagtgcacaaaatctgttcttattgagcaattcatcactggccatttaataaggaacacattgggcagcagcagcaagggtatataaatcatcaaagaatgacagaaaacaaaatgacaggcaaccataggcagcagcatgggcaaacatagacagcaaggcatcaaaaaaaattatataaatcatgtatataaaaagcaattcatgcaattcacctattcatagacagcaagggtatataaatcatgtatataaacaacaattcatgcaattcacctattcatagacaacaagggtatataaatcaacaagtgtaggtaatctgtggccaatctatcaacaagggtatataaatttcaaaccctaaacctaataaagttccttcattatcaaagaatgacagaaaacaaaatgcatggagaattttggtgtctaggtcggttccgtccatggactacactgaccaatccaccaaaattccccatgcattttgtattctgtgatggtttgataacctcggattccccaaagttcatcattcgttcatccattccattgcatcattcattcatgcattaactgcaccattccattcatcggcatcagagagagaggggtacttggagaggagacgacgagcagaggaggcggcgcacggtgacgacgagtcccggccggcgcacggcgcacggcttctcggcacggcggcgcggcggcggcttcttggcacgacggcgctgaggaggagaagagggggttaatcggcgaccaatagtaaacgaggggaggcgggggccgtgggctcaccgtggaggtcccggtggcggcgatgacggtcctggcgtggcgactaagaggaggtcccggcggcggtcgagagagtgagtgaggcggcagcagtgcagagggcggtgtagagggtggagagggcggcggagatggcggcggagaggtcgaggcggcggtggagaggagggcggcggagaggtcgaggcgacggtggagatggcggtggagatggactgcggcggtggtggtgcaggccggcgtcgggaaggtcgacggagagggtgagcggcagagaggtcggcggatttggcggcggcgagggcggcggtggagaggtcgaggcggcggtggagaggagggcgtagagggtagcggagaggtcgataggggcgaggcggcggtcgagagatgagagtggagtgagagtgggtgccggatctggatcgatgtccaaccctaggtcaagcctagtcaaactcacctgtgacgggcgccaactatgtggccgtcacaggtggcctcacctgtgacgggcgccaaccgtgaggtcacctgtgacggccctacagatagagcccgtcacaggtgagtttgcctagagcaattttatttcactttcgttcgcaagtgccggatcggagcttgacttttgggttgggaacatgtagtactgtagaccactgtagcagtgtcagggcgtcagagacactggaaaatattgaaagcggcagcctggacgccgtctatggccgacactttccgtcgccgtgccgtgcgatgccgggcaggggctggcagtggaggtactgtagcatgcgaattaatgggtgtttgctacgcgggtgaaagagatatttgctacgcggcaccaattgtgaaagaaatatttgatatgcacacacatgtgatttctttaataataattttcataatatgtgaagattcggacataaataaatggtaaaccatacaatcctgaaaattgaagtactgaacatacgacaagcattatggataacatcacctacctaatggtagttattgtacgcatcatcagcaatacagtcacgcaacatgcacatagcggcctcgctatttgttgcgtaatacatatggtcgaatgaatcgttcagcagcggcactggattgccgttgtagagagcattagtgaaccgataggtcggatctttactatccaacctaaagttgtgtagagcgaaagctgcatgaatgatgcgtgcagggatgtcgtcatctcggtaataagggatttctttcaatattttccacatcttttttgcgatgccaaattgtctttccacgatccctcgcaacgtggagtgtcgatggttgaaagtctcttcccgtcctacgggtggcggggctccctcgaccgcaagttgatccctgtggtaccgtacatgtgggtacggtgcaaggaagcccatcctggtaggaaatccggagtcgacaagtaggtacctgcctggttaacggcgcataattaaatattagtgcacatgtatagaattaaataaaatcaagacatttggcaataaaaaaaagtgtattgaccgatacaactcacctaacggtacccgtgggaaatcgtaggggtaagcctgcactgcctcattgagaatcctttggtcgtgaactgatccaggccagccagcatcacagaaaataattctcccatcatgatcacatattactagaacatttctggttgttatgtggtgacggttcctgtgttgcatagcgctagctgcattaggcagaactggaatatgtgtgccatcgacagctcccactgattggtagaaaggcttgaaaggattctcttgcagaatctgagggttgtaatctaagaagttgggatcaaccggtttcaatattttcccagcgagatcattcatagcctgcaaaacatggtggaagtgaaccgacactgtcgagttggagcggacccaccgattgttcgcgtctctgattggacgatttccacccatcgtgtacaagaaaataccaagcttttccatggaacagacccctgctgttcctacaagaccaaaagaagtgaccaatagatcatgcaaattgtgtatctcctctgcagtaagcctgaacattgccctgcattggcttcgatttgccatcgtgtccatcatccaactgataccggtttgcaccggtattctccttggtgccctctcattgaaatcaagggtagcagccatgtactcaatgatggcatcttcttcttcgctgcttgtgtgaccgcctccattccaactcgatccacccgcgccgtaactcatcgccgatttcctttaacatatgagaaccgaagaatatgcaatgtttgtcataatcaaaaggatagaaattaataatggcagtgatctatgcaatcgaagaattatttggatataaaagcaatgcaatggaatacgtagttgctcgaattggatataaagccacaaatgtttacggactcacagaatgtaaaaattgttagcacactgagttctaaacataaataatggtttatttgaaaaacatcgcccatcacaactcaaagtaaagtacagtgcacaaactaccaggtgccaccagatgactgtccagtaccaccagtgcgtataaattccaagcgcctagcggcgtccttgattcgaacaaagcatttgcaggtgaatgggtcacggaatagcgcacaagcagcataccacacacttcctccaatttcatggccatcattttccaccaactccatgcacgcatcaaggcccatagacttctctgcttccatctgagcaacacgactctggtagctctgctctcggatgtccgcaatcctcnnnnnnnnnnnnnnnnnnnnnnnnnnncgtgacttcttggaagaactccctgaggcagtagtgtttgctgctggcctctttcccttgccccggtctgctgccgttgggggtggagttggaggtggtggtctataagcagcagcgagctgcgccatgtcgatggtctgccactgaactgctccttgcggtgcctatggggctgcccctgcgacggcggagtggtttctgacaactgtgtgcccactgaataccgcgtggtgaaggtcaatgtgcttcagaggatcattcctgaagcttaagacacctttattttgctgcaacataagtagacagtaaaaataagttagtacaaggcaagtgcattaggcttgtgcaaacattgaacataatgaatatgtgcagtccaatgtgcattactactaaaatgctggcagtaaatgtgcacattggtaccaagttatcaaatataatcaggagtacatgttacaatgggccacacatctgacagaatgaaagaaagatagtttgaacattgtaaacataagataaactgcatatattatattctttgtagatgagcacatttttgttcattctctctatatacatcacaaagaaggtgtgtacagctagttgaatatgtattaacatgttcctaaatgacttgtacaagatctttcctaatttactgatacactacatatacactacatatagatctttcctaaacatcattttgttaacttaaatacaagggaatggcacacattactaaaaacgacatgacagtaacaactatgaaacatatgtgatcacaatccttccattttactgcagctagtcatttgttggcacacacaatttgaacaaaaaaattattacacctcacaaaactgtattcataattgcatgcatgtactaaatttcagataataccaattgtaggcaaaattgttggttcaaaatatttatggtcaagtgtacgtaccgcattcttgctttcccaccactcatcatcggcaacaatggctgatgtatggggatcacgacccagcccgcttgcatgcgattctagccacacccacctgttgtaccgcttcttacactgcccccaaatgtactccaattgagccttgttcaccttcttcttgcacttggtgtacatcttgtgtattaggttctgccatgcctgcggcttgggggagttggaggtgatggtgaacgctgccatctcctccaagcagctctcaagaaacacacgaacctccatatcggtccaccggctacggccatcgcccatctactccgtgcaagtcaaataaaattgaatcggaaatgaacaaattaatacaaaccaataccttacatgactcttcctcgcggacgacgtcccaatcaatcgaacggccgacggtggcagggctcactcttcgaacaaagtcgatgacggctctaggagacttggcgcaaactttgcagagggcatgcgcgatatgaagcacgtcgtcgggagcagccttggcgctgccagcgtcggaggtgacagagtcggaggagtcctcgccggactccagatcggcgccgcggacagagatctcccctgtttgaggggattgaacaatcgtcccctcctcttggatcgacaatagatcccgctctcgcttccgcttcttcgctgtcgtctccatcggaccacgcacacgctcggcctgaaatagagactcctcaactccgccagcttggatgccttgatgagactcttcaggccagcactgtctgacccgagaggcagagaggacgagcacacaggcagccagactgcttgctgcttcacagcgagcacgccggccagcttttactcccctcgaggacgacgcagacagctcgacaggcgtggagctcttccacttccccccgattttgagcaccttgaaccgaccgctgccgcaagacgacgcgcggacgagaatcgattggggggggcacgggcctgcaagccacagtcgaaaggggaggacgggagcctgcagcggaggggaagaaagagggattctccgccaggcctgcgtcgcatcgacgaccgcggaagcaacagcgagaggaggaagaaagagggatcgagagcattggatgccctgactctgacggaaaagccgaggcgcaacggcaacttctcacatccgttaacgccgttaacgtcgcctcacaagccgtccttctggtactgtgtgcgggaccacgcttccagtgcacggaacatgaaccggaccaggactcgcacaacggaacatgaacctgtgacgggcgccaactatgtggccgtcacaggtgccctcacctgtgacgggcgccaaccgtggagccgtcacaggtaataccacctgtgacgggcccaacactctgggccgtcacaggtgaggtcacctgtgacggccctacagatagagcccgtcacaggtgagtttgcctagagcaattttatttcacttagttcttttattttccttaacatattttcacatacactacatatttttttatacttaattattttatttcactaacagttgtaattgcacttcattactatactactttaattattttagttccaatgcttatacttgcttaattattttaattcacttctagtgggtgctttacttaattattttatttgactatttcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggattttgaacttcaagtaatctagctccaatatttgctcaactttaccatagtattgatcacgacgaccaccgtcactagtagcctcgatgcgtaacccactgttctgcactgtgcatttgctgtcttgctttaccgtgtgaaaggtgtatccatttatgtcatatccttgccaggtggtggcactccattcaggaccctgtgacaagcactgaagtgtttcactagacaagttctgcaacctggcaattcggttcttcagccactcgttgaaagaagacatgtgcttattcctgacccaactctctgatcggcctgggttctcatgtcggataactgcaaggtgttcgtcaacgtacggcaccacctcagtcatatgctgtagtaccgtgaaatgagctttatcgtacaccttccgatccaacctaatagtctttcttcctacagtaccaacaccgtcaagcctcccttcgtgatgagatcgtggtaatccaattgaagatgtttctgacatgtagtccacacaaaattcgatggcctcttcggtggtgtaactctcgatgatactcccctcagggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcggggtcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacaagcctactgattcttgatgagtaaccagatggaacctttataccactcaaacatgttagcaaatcaatcttctcttctttcgagagagtgtagcaggctggaggaaggtaaaccctgccgaattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccaggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtctaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaaatcgccccccttgccctcccaaccgatgtgtgagcagtacaatggtcgggatggaaagcagttggcagtttgggggtatttatagagccaacacacctcaaacgggttagataaaaaaagcccgtcaaaggtattgctcatacctttgacgggcttgtattcaacggcccgtcactggtatcatctcacctgtgacgggccagaaattaaagccgtcacaggtggcggcccatcacctctgacggcttctaatgtattggcccgtcacaggtgaggggataccagtgacgggttggattaaaaactcgtcactggtatacctctgacgggttttcctttcggcccgtcacaggtgaggggatacttgtgacgggccgcggccagatgcctcaccggtgactgcatcccgtataacccgtcaaaggtaatggtcactactgaccaattcgtttgcccgtcacaggtatcccgtcagaggtgtgaggatctggcgtagtgaactttagtgacaaaactatcagtttgctgccacattagcgacatgtttcaatttgttgcaacaatagcgtgagaaattatcacaaaactacaacttttacgttatatgctgctacaatacatatatgccgcactgttgcagcatataacgtaaaagttatagtcttgtgataattttgcacgctattgttgcagcaaactgaaatatgtcgctaatgttgtaacaaattgatagtttttccactaaagttacaattttctaaaatttactcattttaaattctttaccatcaaaattcaaaccgctcaatcatattatttgcatgcatcgagacgatacagccgaagagatgattatttttgttatctttgcgttagtggtgatttttccttatatttttgcttgagggagtatagatatattcattgttactgctctttatggaggttagtactcaacggtcaaagttaacaactaacccaagtaatctaccgtggattaatcatagtaaaccataaccactgaactggagcagcctgtaccactaccactgctaccactgaactactccgcttgctgccgccgccgcggccaccgacgccctcgacgacgacgacggcggccaccgtccgccgatccaccagtgcggcggggctgtgcaggggcggttcgctcgcaacagctcgtacgaaggcacgaagccaacctgcggcatgtcgccgccgcgctgccagccatggtggcgaacggatcctccacctcaaatcgctccagctgcgtcggcatcctcgctggcgtgcggccggaccagatctccgcgtcggccttctgctgcgactcgtcggagccggcgtactccgactgcggcgcctgcgtcgccatggcgttccggtacgcgcggtggctgtgcgggtacagcaggcgcgccatggtcgacctcggcgcctgccgcgtcggctaccacgacgtcgaacgcatggagcgggagatgcgcgccgtgtcagccgttcgccgtgagtgatctatttgttactccctccatcctaaaatataaatttttagcatagtaaaaagtcaaatatttttagctttaattattaatagtaaaaaaataaaaaagatcaattatgtaaaattaatgttactagatttgtcattggacaactatcataatatgtaactctttttatttaaaacatattatttttatagatattgctggtcttttttttcgaacagtcaggctgttgacgacgttttatataaaaagaaggtgtctggtttttaggagaaaacgagaccaaaccttacaatgcgcagttaattaggggtagatattgcaagtcaaagtatcatcttggagaccgtgttagagaaaaaaatacttatattttggacggagggaatagctcgataaatttttgtcttttgattatactgtgattttgttcgccttcctttattgattcagaatttcaggtagactctgcatcatccgaatcagcatttttcttcttcttttatttttttcagatacttcaccttggtggaaaattgtttcgatctatgatttccctgtgatggtggtgttcgaagtgatcggaatagcctgtgttctgttcattttcctccaggaatggggagacggtagaaggagaagaacccaggccaatcggctgccataggtggaggttcagttcaggtatatttcatctggttttgttaattcgaaaagttgttacaaatatcatagaatactccaacttggttaaatgcaaatataatgtagacaaaccagagttcttggagatcttggtcggactcttcactggtattcaaattccatttggtacagggttgtcaacttctgtctgtagccgcggttgatcgtagaccacagaacaagcaaaatccagttgcccaaaagaaaagggcacatttctacacaagatgtagatgcagttttcgtgtctaagactgttcattcagaaattaatagggatattttctcttgctcttctgattgatcaaatggaaaggatgatactgatgtaatattggagagtgcgaactgataaatgtgcatatactgagataaaagttttcaggaaaaagtgcgcactacgaacaaacgtggaactaaatagcagtacccgaaattgtgtctgcctgtcttgctacctagtactatggtttacttttgaagctttattcctatataatactgccctccatttcacattatatgtcattttatcttttttctaaatcaaatttaatacagtttgaccaaatttataaaaaatatattagcattttcaacataagacaaatatatcatcataatatatcaaatgtttaattcaatgaaactaatctggtattttagatattgctaaatttttcactaaacttagccaaatttaataaaacttaggaagaaaatctaaacgacttataatatgaaataaaatggatgaagtatttgattccacaaagaataaaaccctgtttagatcccactctaaaatttttcacgctgtcacatcgaacatttgaatacctacatgaagtattaaatataggtaaaaaaataaataattgcacagattgcgactaatttgcgagacgaatcttttaagcctaattgctccatgatttgataatgtggtgctacaggaaatatttgctaataatggattaattaggtttaataaattcatctcgcgatttactgacggattctgtaattagtttttttattagtgcccaaataccccatacgacactttatataatacccgatatgacacgcaagtactttacacctctatatctgaacaccctaactaatacacccgtgagggtttctgcctattttgagaccttcccaacacttgggaggaaaagataatggtcgatactgtggcccctaaagttaaattaaatatatatatatatatatatatatattgtatctttatttggggccatgcattatcgtggggcttgtacctgacgtcctgacctgagaagtgagaagtctcatcgcatacacactatcgtgacatcgacagacgcaaatcgaatgatccagactagcgatcgtagtgttcatctggatttttcacaattgggtcattttgaaaaatttattttataaatagactctaaaataatttattctaaaaataatttttttaggcgccagagtcgctagcgctgtcgtccaacgggcagggacgaagctatgttgtcccgagggggttcctaggaacccggctaggaaagtaaaattagtgattaataccccctaatgaccatgtgggcaccccccttgcctcacgtatgtgtacccccagactgaaagttaagccacagaggcgtaaagcccagcgcgtgcactgcagatcaccaggccgaacaggtgctactaggaaggtttcaaattttcaatgcactaatgtgttcatagcaaggcttctgatggattagatcatactacctaaaatagtaaaattaaggactatttatcaatgttgtataggtgatttttttgggatttttttttataaaagaagtggacgatagaacaagccaacagtgaaggaatatatataatatatctaggcttgccttactgtttaacaaacattaaaaaaattaaatattgagtcataaatagtagaaggtaatgtatgatgtatctatttgacatgattagttcataagcttttttagttgagagctaacatggaggttggggcaatgtattttagttttgctggtataatgcattcactcatattggtcagtacagtatttttatcattgcactcctcttttgatacaattggcatcacatattgatttcattttttaatatttgatgggaggcgcaattatttagtataatatatcacttgaaaattctatatggttcgatgggtatgaacacatgattgagtggtgcacccccccttcaattctctctagctccgccactgccaacgggtcggcgctgaggtggtagggagaacgcgcctatgtggctgccccccaggcattttttcctctctagtgtagaggagaaatatatgcatcctttattattattattattattattattattattattattattattataatatatttttttcacacttaggagcgcacaagaatcaaccgtagaaacattaaacttaaatggacgaaatatgcgacttgtagaatttttcaaagctatatcgaaaagccccttcctgctcttcgttgttttagtttttcataaagtcaaaaaaatagattagatttcgaacaatcttagctttttcttacatgaaaaaaagttagggtttgtgttttatttgttacatttgggtatcattttttaaaacatgcataattttctcatacggactcggaatcaggcaaataatacatccactgacatctatagaaaaagttacatccgattctccccgattcgtcgggttaggcaaaattagaacctccaaattccacttgcaatattatgttttcgagacgagaagcttttcggtagagctttggaaaattctacatgtcacatatttcatctatttgagtttaatttttctatgattggttctcatgtgctatatcaaaagaaaaataaaaaaaaattggggggaggacgccagctacattggcgctctccccctgctaccctagcgccgacccgctacggtggcaggaggctggcgccctcccgttggacgacagtgccaatgactctggcgcccaaaaaagactatttccggggataagttgtttcttagatctatttacgaaataagtttttcaaaagaatgaaatcgtaaaaaatccaatagcgttcatcatacgatcgatcgctgcatttaccgagtccggcaatggacaacgttccaattggagcctgtcacatcacttgactattattgtgtggagattatgggtaccccatacccacacggcatggttatccgactagttatatgggataacttatatctatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgcccccatcctatataaggtgggcaggaggccctttagggggcatgagatacaactagatcgtcaaatcaatacacacccggcggattcaaatccccaaacaggagtagggtattacctctcattgagagggcctgaacctgtctaaatcctttgtctccgcatccatccacttttagggctcgtgcgctaccccttttattattgccgaattcatgtttcgacagttggcgcgccaggtaggggtgcgtcgagtttctatcgacaagtgcgatggaatcaactttatcggtcgccggcttcgtcttcgttttgggagttttcgcttcctcgtcgtcgacaatttcgacaagctcttactctttgactcggattcaaaccagtcaagacagtttcaatctactatggctgccaccaccttcacttccgtcttccccaggatcttcttggacttcatcactgctgccgaaaatccgacatgctccaattagtcggctaagagatcactcgccaattaaagcaatcaagcaagatacaagactggacagccatggagttttttcttttctctagatcagccgtggagatatacaatcaaaaggatgactaggtcattacatgcaaagctgacaccatgcaagccatatgccaggagatacattgatccgtcgccgtcaacacaatcttctgatcaaatcaatctaaagatttcctgcatgttttgttatcggctacgacttccgagtcctccattggctgaactcgcagcgccagagggccctcgtttccttgtcaagatgtatatgcctgcctgttaattactatcatgtcagatcggaataggagctgaccgagcagcatgagtgcatcgcatctcgtatcaggcgtgcatgagtagattcaaattcagactcgctgattaatggatgttttaatccactcggactcagcatcaattcttccaatttaataaagacatatggttatgggcacacagcaagctatatcagcactcggcaaacataggctccaagtcctttttccaagacgcgggatacataataggttggtcaactgcattaatattgctaggcgtcatcttcttcgcccacggccgtgccgactggttttttaaccatcacggctggtggactccgccaccgttgatgggcctcatcgtcttcaccgaccaggcaccttcgccacctttgattggtgttttcgcctatacggttggcggactccgccgtcgttgatgggcctcgtcatctataccaccggcttgcttttgccgccgccgacaggtgttttcatcgctattgagatggactgcttcgttcccacatcggctacttctgctgtcaccaagggaatacgataaagctaagtcatcatttattttattctttatatgatatttttccttttcctctgcctcactacaccaattggccttccattgagtagtgagtcgggggctacagatgttatatcatatttttcataacatttatcttgattgcttgcgacataatctgagtacaaaagtacctatcgggttatggagttctatcttcctatgctttccgtttggtttgccaatggatgattgactttgggccgattcctagcacccgggagcttgttggatggaccgagtaacgcaaggtgctaagtattattcggaataaatcaaaagcatagagatgagataattttttttttgctcttaataattgcaaaagtacccgagtagtaaattctgatccgtgaaactttgttccattaatgacgaactcatgtcactcatatgcatgtttgggaagtgcctaggccgactcccgatgcttggggactatgattagtcgggcagagtgtttaaacgtaaggagtcatctgctcggggaaatcaaaattgacaagaggagaaatacatatttataaatattttaaaatacttgcatttttctcgagtattatatttacatcagatactactcatcctatatgtttgttctgcaggatccaaatccagatatgcataaaagggattcatggctttaagcttatctcttacactgcaggaatggatcagtcagaacatcaccaccggcttgccgtcgccgccgtcgactggtgtctccgcctgcacggctggcctattatgccaccgttgttgggcgtctacgtcttcaccgatcggccgcctcgtccgccgccgactggtgtttccgcctgcacggctggcctattatgccgccgttgttaggcgtctacgtcttcaccgaccggcttgccttcgccgtcgtcgactggtgtctccgcctgcacggctggcctattatgccaccgttgttgggcgtctacgtcttcactgaccggccgcctcgtccgccgccgactggtgtttccgcctgcacggttggcctattatgccgccgttgttgggcgtctatgtcttcaccgaccggcttgccctcgtccgccgccgactggtgtttccgcctgcacggctggcctgttatgacaccaactgatgctatcttcttcacggccggctacgtcgccgtcaccactaataggcgtcatcatattcaaacgcaagctgtctacgtctgctgccgactagtttattcacttccatggctgcatgattctgccagtgttgattggccttatcttcttcaccgccggtcatctcgtctgctgttgactagtgccctcgtctctacgtctggtttataccactaccactactgatggacatcatcgtcttccgtcgccgactggttatgccgccgccgactggtgcttttatcttcacaactgcgcgtcttcactaccggtttgcttctgttgacgccgactcgtgttcacttcatcacggcaatgcaactttgtcatcatggtagagcgacttcatctttattatcttcggcaccggcaaactctattgctgctacttcgcaagtttcgctacttcaccaaccacgacgtctttgtgaatctcgacatctcggcatgcgatgccgtgttattttactacaacaagtggctctccaatattcaggatttctacttggacatcttcaacacatatcttcaatcaagcaataactattcgacgacaagaagctacagttctcgactctatgttcagttgtttcccaactaatcaaagagtcgggggctatacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcaactctcctccaagtaaagcatctacaacagctataacattaatttgatagattattgtcactgacatcatcaccagcacctctgcttcatcgaccctgacatctccgctgttgctaatggatgattatgttttcgccgacttattatttcaccttcacggttgacctactatgcaaacgctgatgagcgtctttgtcattatcattggttgctacactgctattgactggatcatcgacatcgtcatcttcatcatgtcggttgcgtttgtcatcgtcaactattttcttcatcttcatgattggtggatttcgtcatcgcatttgatctgcctcgtctgtcaccgactgattatttcgctgccatggctacacaactttatcgctgggcgccttcatcttcattgttagttgatctgtttgccgccgactggtttcttcgcctccatggctatgcgacttcagtacttttgattggtatcactatcttcactaccaccaatatttttgccacctctggtgggcaatattatctctatattggtcgtcttgtctctatgccaactgcgtcagctaccatcgatggacaattgtgactacaaagaaggacaagctatatgctcagaggcttactagttcaaacacaagtatcataccttcaatttggacttgttccggttacatgcaacatgaattcatgatcatgggtctattttctatgctcaaagactggactatttattattctccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgcgtcatcctttaaagggtgtcgagggcatatgttttggcctaggcctaatatgtctgcagcccatattttcaggtgtggcctgtcacgttcttttagggacttaggcatctttttgcttaggcaaaagtgcgcgtgattatgtgcccaataccttaaaatccttttataccgcagttactcaactttttaggagttggtacaatgcattttaaaaggtgccaaacagtaatgctttatatagctgcccgctgacttttttatataagtcaaggtgctgtttgggttcataaagcaattgattggatacaatatcattgttttttgccacgtaagtgtacacttttattgaccaatattatggcttgggctgattatatattttggtcattttctaggcggttggtaaatcctttatgagtttatttactcggattttacaccacatatgccatatattttcaggtgtggtgaaaccatgtgtctttagggacttaagcacatctgttaaagcagtgtgcgcatggcgtatgcccaatactttggaaatttctttattcacaacatacaagcttctttatagctgttttgctatgtgaattttcaataatgtagtcgactttaagttacacgcatcatattttacaaagcagtcggtatatcacttggatcatattattcagggattcacacatcatatgctattatcgaaaccactcggttggttagattatttattccttgactatatgtttggtttgttcaattaaccacatagtcgggggctacacctattaggtgcatctagtcgatgcacctgactttatttttcagccctccacagtcttcagatttggtaaaagtactcgggaagtcatggcaaagatgattgaagcactcggctttggagtaatctagttcgagagaagattatcttttcgactgtgaaggtctcaggggctactgtggagattatgggtaccccatacccacacggcatggttatccgactagttatatgggataacttatatctatgaaatatgtaacagatcatgacttgggtattacgtttccctgtatattatggaacggcctaaagtcctggcttgataagattgtaaagtagatttaggaaaccgataccgtgttggttaaggtttctatcttgtaatcctgccccccatcctatataaggtgggcaggaggccctctagggggcatgagacacaactagatcgtcagatcaatacacacccggcggattcaaatccccaaacaggagtagggtattacctctcattgagagggcctgaacctgtctaaatcatttgtctccgcatccatccacttttagggctcgtgcgctacccccttttattattgccgaattcatgtttcggcacattgtttgccgtgatggaagcgcactggatattattgctgaggataatggtataatgatgtatcccattcgaaatacttatatgtatcatgcgattcctaggtatcgacgtataatatcttttaagatattatcccgtctaaacatgatagtgttgtataggtgctaatgatattagtattaaggacctattttatttacaaataggacttcaatgccaataacatggcactgagagctatatgtaaatatttttatattacaagtaaatccttttttaattaaaaatattcctttcacgaataggctctcgacactacttattgctgtctagcctatctatttataaaataagtttttgtaaataaaaatctaaaatataaaaaatccccattgtttgccctcacgccggccatgcaatggtcgtcacggcagcttgacgtgggcccaccagcatttatgcctgggtcccatgatgtcaggatcgacgacagcgcaacatagacgagtcaagcaagctccactcgagtcaaccaagggcccaccgctcatctatcatctcttctccatttatccctctttgctcgccgaccacctccaccctcgcgccatggccacgccacgtggccatctccccgcctgcgtcgccgccgtcgcggcggcggcggcgctcctaacctccctcctaccgccgcccgtcgcgggccagcccctcggcaacttctgcggcgacagcggcaactacacggcgaacagcacctaccagggcaacatccggagcatctccgccaccctccccaagaacgcctcctcgtcccgcacgctcttcgccaccgccaccctcggcgccgtcccggacatcgtctacgcgctcgcgctctgccgcggcgacaccgccaacgccaccgcctgcgccggctgcgtcgccgccgcgttccaggacgcgcagcagctctgcccctacaacaaggacgccaccgtcttctacgacgcctgcgcgctccgcttctccaaccagaacttcctcgcctccaccaacggcgacaacaagttcctcatcctcatgaacacgcagaacgtgtccgcgccggccaaggtgttcgacgccgccgtgggcgtcctcatcaacgccaccgccgactacgcggcggcgaactcgtccaggcggttcggcacgggggaggaagggttcaacggcagcaagatttacgggctggcgcagtgcacgccggacatggcgacggccacctgccggagctgcctggggggaatcgtcgggatgatgcccaagtatttcagcgggaagcagggcggcagggttctcggactgcggtgcaactacaggtacgagatatatcctttcttcgacggggtctcgctgctgcagctcccggcggcatcactgggagcgccgccggcgccatctccggcggccgtaaacgtcacgccgccggccaccaccaccggtaccagacgacgaggtgagttgggtgaaactgatatacgaagtagatctcatttcaacaatgcgatatgctaaactcaaaaggggggaaaacagtatcctgatatcctaaatggcctgaattttgtgttggtcacggacagaggatcagtccatgcatgtgtgcagcaattttagttcgatgggtttgaatagaagtggtgtttgatttcaccgtaggaatttgaaacgatatttgattcggtacctaagtatgctatcagcaatctaattatcgattggtccacagttccacaacactgttattggctttgagtcggtccacatgaagaaactgaatcgtccaaatacagaaaaaaaatttatttttttggcaaaatttgtccaaattctacctgtttttgtcgataaccgttccattgtcgtggctattgaaaaaacctctagggacctgtttttggtgaaaatggcatttgtaaacctcgagttgtccatcgtgactgattcctagccatagaagttgttgtagaggcagggccagtcctatgattttgagggccctaggcaaactcatcacgatggaccctctaaggtatatataaaattttatgatatatatatatatatatgctaattttacttgcaaaacaaaaacaaaaacatccatatattaaatttaacatgtatggtaattatcaagaaataaaatcgatcaaaataacaatatatttgtaacttggaactaatatcattattcattaacttaatgaagaatagaaccccatcatatccattgcttcccatgaaaagatacttctttgggcatttcttgatgcaaaatcatcaagaacggtattaagatcaatagtgttcaagatatccttctcgattgagcgcatagccaagccatttaacctttcttgtgacatagttgatctcaaatagttcttcaacaacttcaatttttgagaaacttctttcagctgaaactacagtcacaggtacagttaaaagaattcgataggcagctgaaacatttgtatagcaatctgcatccataacaaactttaaaatctcaggcgcggagacatcgaagaatctggtaaactcacttgcaacacctttaattctgaataaaaatcattgatctcaacatcggatgaggtactcgactactagaattagatgcccccccctactactagaattagatgccccccccccctaacatggccccccaccatcatgggcccccggcggtcgcttcggctgcatagggctagggccggccctgtgtagaggttacgaactcgtctttctttttgaagttagattagtctttcatgatttgttttttagtacgaacaacttaatttggaagaaaatattttctttgtcattttgtggactggtctgatgttcacatctttaatcgcatgaatctatgagtttccttttagactagtcatataccagatgtttccatgatcaattttgctaatgatcaattttgctaaacgtttgtcgcgtgatttctcgtctgaaatttgacgtttttctggccgtcggattgtgcgtctagattggtggtggatttagcgctatgaggccacgtggggagccacgtgggccggtctggtccgaattttctggccattttctagctgttacggcgtatttctcactctctctctctctcccgccttccttctcgctctctctttcatgcgctttcttttctcattctctctctccctttctttcgattttctatgtaaaaattgatttctttaaccattgaaaaaataagacaactaaaaataaaaaaataaaaataaaattacagtcctatataactaaaattacaattgtaaatttagttgatataacacgtaagtgcactgtaattttgataaaaatatcgtgtaagtaaatatgcattttttattttctttaaaatataaaattacactcctacataactaaaattacatttgtaaatttaattgatatggcatgtaagtgcattgtaattctgattaaaaatactgtgtaagtgaatatgtatttgttatttttttaaaaacatataaaattacagtcctatataactaaaattacatttgtaaattcagttaatatgacatgtaagtgcactgtatttttataacaatattgtgtaagtaaatatgcatttgttattttctttaaaatataaaattatagatctatgtaactaaaattacatttgtaaattcagttgatatgatatgtaagtgcactgtaattttgataaaaataatgtgtaagtaaatatgtatttgtcattttcttttgtagtccatgcagtttcttttttaagaagatcaattctatgatccttgaggaggtaccatgaagtacaaaaaatttagtgtaaaatttggtacgtactgtgaggtaccaaatttacaataaaaaattgatacctcctaaaggatcgtaaaattgctcctttaagaatggttagtgtaagttttcaaaaaaaaaaagatggttagtgtatactggttaatgatgtcaaaattatttatacttgtgtttctgtcttatgtcttacattaattgatgcattccgtttacgggatgaacagggaacaccactggtagggttttagccattgcattgcctatagtcgctgcaatactggctgctgtagtaatttgcttttatatctggaagaggaagacggaacgagcaagaaagccatcaatagcaggtaagttcctgtagttcattcaaattccattaatttccagtacgtgttctcaatacacttgaaatggcaaaattaagtttttgtctatgcagtgacttcattctcatacaaaagcaagaattccattaatgcattacaccattattgttgtattttttttctgaaacaatagatccaacagacccagcggacatagaaagtattgattcacttattcttagtatatcaactttacgagtggcaacaaacaactttgatgacagcaataaacttggcgaaggaggttttggtgcggtttataaggtgctaattataccattccattttagtttttatattcaatactttacagtttcagccagtaaaaattctctatctgtacagggagtcctccctagtgatcaagaaatagcagtgaaaaggctatcgcaaagttctcgacaagggatagaggagttgaaaaatgagcttgttttggttgctaagcttcaacacaagaatttggttagactccttggtgtttgcttggaagaacatgaaaaattacttgtgtatgaatacatgcctaacaaaagcctcgacacaattctgtttggtgggtactcttcagccttttcaacagtgaatcaataactgaaacttttttatgtataattttgaagttttttcttctatgtgacagatcctgatagaagcaatgtgctggattggtggaaaagattaaagatagtcaatgcgatcgctcgaggcttacaatatcttcacgaagattctcagctgaagataattcaccgggacctaaaagcaagtaatgttctgttagattccgattttaatcctaagatttcagattttggcttagcaaggctatttgggaatgatcaatcacaagacgtcacgaaccgtgttgtcggaacatagtaagttctgatgatattattggctactaatatattcggtagtacacattagtccttgacataacagaatttctcactgcagtggatacatggcccctgagtacgctatgcgcgggcattactccatcaaatcagatgttttcagctttggcgttctgattttagaaatcgtcacgggaaggaaaaacaatgtctcctacgactccgagcaatcggttgatctcttaactttagtgagtacctcatgagagatcagctatatattacaaactctacacccaagtaatgttttgtattaatatcagagcatttacattacctatcaaaatatgcaggtgtgggagcactggttggcaggaacagttgtggagcttgcggattcatccatggcggggcattgtcctggagaccagatcttgaagtgcgtccacatcggactcctgtgtgttcaagaagaccccacggagaggccaatgatgtcgatggtgaatgtgatgcttagcagcagcaccgtgtctttacaagctccatctaggccggcattttgcatccaaaagagtagtgtcaactcagattcgtactcggagccattccgtggagctaatcagtccacagtatagttggccataaggcccgaggcccgaaggcccggcccacggcacgcctttttggcccggcccaagcacggcacggcccgacttgggtcgggcccgtgctggcccggcccgactgtcgggccgtgcctgggcctccccaccggcacgctgggctggcccggcacggtcgggccggcccggcacgatgggccggtaggccaggcccggtacataaagtacagggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgatggcccatcgtgccttcgggccggcccggcacggcccgaggcgtgttgggccgtgcctgggccgtgagtgcggcacgtgggctggcacggcacggcccggtgcgtcggtcgggccgtgccggcccgacaagtctcggcccaggcacggccgggcctgggccgtgccgtgccgggcggcccacatggccaactatagtccacagatagatcgcctatgtcaccaaatgaggtttcgatcactgagcttgagccaagataaatccaatgtgatgctgaattcatattgtaccctttttgttttgcaaaaaaaaaaaaaaaatgctgatgtagggaaagacctacttcggctgtgtttggaactccaagttcccaacccctctccctcgttttccgcgcgcacgcttttcaaactgctaaacggtgtattttttgtaaaaagtttctatacgaaagttgcttaaaaaaattcaaattaatccattttttaaaaagaaattagctgattcttaattaatcacgtgctaatggaccgctccgttttccgtgaggggagattgggttcccatccctgctatccgaacacagccgatcatatgtattattacaccatcagacttcaaagaaatattagctatgatccacatatagtagggcacggtaatataatatgtatactagcaaaatgatagtataagcagataattgtaagttgtaaccctctgtatgttacttcacatacgcatactcattcctgaagggttatttacatacttcctccgtcatatattataagacgttttggtatcttcatatctcatctaagtatgaatttagacacatatataaagcacaaattcattgtagctctttgtaacgctccgcttttcgtgagtcgttaaaaactaattcggcaaaatcctaattgcgaaaattttcgttctttgtgtgcgagtctaagttgtgccaaggatctcaatttaatcccgttgttccctctcatcgaaaccaaaatcctccacctccaaattccttttccgattcgagtctctgaaatcaaattctgaaattcaaatccttcctttgaatcctcgccaaatacttctacgaatccagaattattcaaatcccgcctcgaatcctttccttgactccaccctatgttcccgagaacaaatacccaagtattccttttgaatcctttccatgacttctccttgaatcccccttgatatatccccaaaccctcgagttcgaatatcaaatttgaattcgagtccaaaccctaaaatctctccaattctatccaaatcagttttctctgtaaaagtctactttacctccctgtattttggatggaccgatttcctctccctcagcccacctccctccctcagccgccttcccccttcccacgtgcgccgcacatgagccgctcgggagagagagctctctctccttctctctcggttttctctctatctctctccctctcgttctctctgtttctctctctctccctctccccggcgtcgatttcccgccgccgccgtttgaatccgaccacgccctcacgtccgcgcgcgcgctcgcgcgtggccgaccgcccggtcgccgccgcgtcggccctgccgcgcctgcgccgcgcagccgcccggccccgctcgcctttagccgtcatcgccgctgtcatcgctcggccccgatgcccccatgccgcatccttccaaaaccaagagacagagctcgtgctcctctccctcgttctctctttctccttcctcccaaagtggcaagggagccaagctcttttccctcccctttttgcctttttccccgaccacagccgctgtcaccacctgccgctccttgaccgcaagcgccgcgccagccgaagaagcttgaccaccaatgtcggtttccctcctccaaaccgacctctcctcctcgcctataaagcccgcgccctcccctctcgtttcgtcttcgcctcgctcgaaccacccgcgccattgttgccagccgctagctgctcgccccgcgactgcctcctcgctgccgcgctgtgccaatggccgcgtgagcctcggcgtcggcctcgtcaagctcggtgccgcactgccgtggccaagagcgtgtgcatgcacacatcatcctttcggcctcgttgcctccctccttgcccggccgcgccctctcggtgccgcgcctccccgccgtcgcgaccgcctcgtcacgactccctctgcgtcgccaacgccgctcctccctcgccggtgagctcccccaccgtattcctcctcctgccgcacaatgcgccgcgcgcctcgccgttgctctgtttcagccgccgcgcgcagtcgcgcgccgtcgtcgggccccagctcatcgaccaccctcaccgacaccgtccttgagctccctagggtctccccaaaccgttccctagcaatgccgtcacccgccataggcttgtcaccatcgccgctcgctcccggaggccgccgctcgtcgccagatctccacggcgtcgctctgccccatccgacgccggagatgaactccttgaaccccggagatactcccaccaccttgaatttaatccttgtcgcccctccgccgtttcccctttttctcgccgccagcgtgcgtcgccgcaatccgccgcctctggcctctttccggcgaatccgatccggtggctcacttcctctcgtccgtcccatcgttccggtgtactccctctctctcgaatcgtcgcgatgagctccggtgaactcggccgccgtccgccgtccatctcggccgccccttcttcctcctcccgccggcccgcgtggctgccacgtaggcgccacgtcggcgccacctcggctttgaccgagccgagccggtcagccgcctccttccttccccccctcccgtgcgcgcggtccacggtgcgccaaccggctgcatgtgggcccgctgccatccgatccacccggcgcaccgcccgcacaccgcacccaccaaaccctagcaacacacccgcgtgcgctctccccaccgtgaaccttgccgccgacatgtgggccccacccgggaccccgcgaggtgcacccggtccaccggaccgctccctcccccttccgcgcgccctaatgggccgcctttcccgcgaccgcgccggcccaaatggcttggccgagcctccttcgacccttgggccgcgtccttgccgcccgaaaaagtctaatatacatccctccatccttttctttttcagtgatttaataaatcctttttcctttgtcccataaatcaattccttgttccaaaattccataaaccatttcctttggtcccacatgacagtgactgtcaataatattcttgggaatattatttctacaaatcccataaaccatttctcgtattctagaaaattccgataaatcatttccttgaccagaaaatccaaatcaaacttccaaaattcatatcttcccaaccgctcttccgattgactccgttccacttccagtaattccgtaaaattgagatctatttaatggcactattaattaggctaaataggatctttcttttgggtcttgtgtaggttttcaattgtttgcgtatagctgcggttatcggattttcgtcgatcgcgggttttctcgaagattcgtgaagcttcgtgaagaccttgagcaaggcaagtcaccctttgaccaattgctcctataattggaaaatcattattattttgttggtaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgcttgtcaaaaacttgggaaatgggtttgtgaagccttcgaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtagctagtcggttcagggaaacctcgcatgccaatagttgggaacgccggggcggggtcggttggagccaaaccgggttcctggtaaggcaagaacgcgaagcttgccagattaccgatcgaggtggttggagtttgatttgtgtatgcctaaaatggcctatatttatgtgaggatttgatccttctatgtggcatgaggtatccctgggtcggcttgggaaaggctttgtcgcgaacctctgacaccggccagtgtctagagtaagttcgtgtcttgtgggtaaagtgtacccctctgcagaggttaacaaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcaggatgtctgtgggcatcatagactaggcttcccgagtggaagcggattgttgtgctgctgggcagctggactctgggagtccgagaaaatgaaaaaggctctgggagccgattaaccaagtgaaatggctctgggagccgagaagtaatgatccgacccgggaggtcggtacattaccaattgagttgttgaaaagcatctcttaaagtcgaatcgagacgcaagtctcttttcgcccaaacatagaaagaaataaatcacttagtgatttcaaaatgatttcaaacaaaagatttgcaaaacaaccttgcctctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15521 - DNA, 909 bp, Oryza sativa
agatgcccaacaacggcggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtcggtgaagacgtagacgcccatcaacggtggcataataggccagccgtgcaggcggaaacaccagtcggcggcggacgaggcggccggtcggtgaagatgtagacgcccaacaacggcggcataataggccagccgtgcaggcggaaacaccagtcggcggcggtcgaggcggccggtcggtgaagacgtagacggtcaacaacggcggcataataagccagccgtgcaggcggtgacaccagtcggcggcggacgaggcggccggtcggtgaagacgtagacgcccaacaacggtggcataataggccagccgtgcaggcggaaacaccagtcggcggcggcgaaggcaagccggtcggtaaagacgtagacgcccaacaacggtggcataataggccagccgtgcaggcggaaacaccagtcggcggcggcgaaggcaagccggtcggtgaagacgtagacgtccaacaacggcggcataataggccagctgtgcaggcggaaacaccagtcggcggcggctgaaggcaagccggtcggtgaagacgtagacgcccaacaac

SEQ ID NO: 15522 - DNA, 692 bp, Oryza sativa
cggtgaagtcgtagacgcccaacagcgacggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataataggccagcgtgtaggcggagg

SEQ ID NO: 15523 - DNA, 973 bp, Oryza sativa
gtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttttcgcctgcacggttggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccgtcgccgccgccgactggtgtttccgcctgcacggctggcctattatgccaccgttgttgggcgtctacgtctttaccgaccg

SEQ ID NO: 15524 - DNA, 466 bp, Oryza sativa
ttgctgactcaagatggtgaaggccaggccgagcaggccctagacatgacgacggcccagctcggctcggcaaatgcacaggtgtgtgcatgcgcgcgcggaagcgggagatcgtacggcacctggaggcgtggcggccttctgttcgtcaaggaagcgaccgggtcccacgcggtttttcgcatggcgcgcgcgggaacatggttttcgcgagcgcgcgcagaagcggctcggtgggaggaacggcgacgtgacgtgtagcgcccgttccgtcgtggcacctagcgggaaaattatctcttaaaaaccctaattgcgaaatttgtttctttgcttgttgtctagtgtccgtgccatctcggatctcaatccccaatctatcgtcgagtccatttccgaatccaaatccttccaaatcaaatccctccgcaaaagtctattttgcctcccccggggtcgatgggcc

SEQ ID NO: 15525 - DNA, 8724 bp, Oryza sativa
  unsure (1)..(8724): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaaaatcattgtaatttgacatttcattctcctggccgcctaaagagcataattaaccatgtgaacatcccctgcaatgaaaccatgcaaatttagcatttaccttcagcagcagttttggaagctatttatgtgttatagtccacaattgtcgtgcaattgaattttgtagtgtgatctaaccaaatattccatttccaaattattgtgttttccatcccttgcactacaaaagatggtgataatgttctcctttaaaatactcccagcaacaagaatgcttcaaaatctttcagcaagtgaaacaaattattcgtgagattattgtcacggttatatattttattataaagatatattaaatatttttagaaatgcacttagcaaactccataaaaaaacctagtattggacaagacataatctaataaaatggtatatcacatctaatactatattatttttttaatggaggtgagtagcttagggggtgtttagatcaaagggtgaaaatattttgccgtgtcacattggatatacggacacacatttgaagtaacaaaacaaattacatgatccgtttgtaaactggagacgaatttattaagcctaattaatccgtaattagcaaatatttaatgtagcatcacattgagaaatcatggagcatttaggcttaaaagttccgtctcgcaatttacatgcaatctatataattaattttttttctatatttaatactttatgcatgtgtccaaacattcgatgtgacagggtgaaaaaacttgctaggggatctaaacatggccttaaaaaacattgtacgcaatgcaacaaaaagtattttcaggaaatgtattttgaagacgtggagtgcacagtccaagatagtaatggcttaaagggtcgagatatcaagtgttgtggtttagggatacgaatcagatttggccagtagctaagggaatcaaatgaacttaggccctgtttagtttccgaagaaaaatttttggcgtgtcatattggatatacatacacacatttgaaatattaaacatagtctagtaacaaaataaattacaaattccgcttggaaactacgagacgaaaagtctaattaatccgtcattagcaaatatttactgtagcacaacattgtcaaattatggcgtaattagacctaaaagatttatctcataatttacacgcaatctgtataattggtttttttctacatttaatactccatacatttataaatattcgatgtgacggccctgaactaaacagacccttatttttcaatttggaaccaatgtcctagcagacactgaattgggggcatctaggggtttcgtcgccttcccagcagacccttacttttctgtgtggtgatttttaatgatcttaataattggaatattgctttccttaccttttctagtttgagagagagagagagagaaagtttgtgtatgttcaaacaagagcacgtacaagggtacatcgaggatagcatagattggtaaaccaaaaagttctacaatagttcaactatgcatgctggcttcctctcatgtttacccttatcaattttcccaattacctgctacaaaccgtgataaaaattatcaaaacttcaactattatgttccttctctaagttcgaatgtgtataaaccagaaattcagaatgacataaaaaaaagttatacacttctttcaattatgtccttactaagttattactgtcaaatcgcaaatgcatctaaaaaaaagttactaccacatggctaagcttccttaaaatcgttgtaatttgacatttcattctcctggccgcctaaagggcataattaaccatgtgaacatccctgcaatgaaaccatgcaaatttagcatttaccttcagcagcagttttggaagctatttatgtgctatagtccacaattgtcgtgcaattgaattttgtagtgtgatctaaccaaatattccatttccaaattattgtgttttccatcccttgcactacaaaagatggtgataatgttctcctttaaaatactcccagcaacaagaatgcttcaaaatctttcagcaagtgaaacagattattcgtgagattattgtcacggttatatattttattataaagatatattaaatatttttagaaatgcacttagcaaactccataaaaaacctattattggacaagacataatctaataaaatggcatgtcacatctaatgctatattatttttttaatagagggagtagcttaggaggtgcttagatcatgggtgaaaatattatgccgtgtcacatctaatatacggacacacatttgaagtaacaaaacaaattgcatgatccgtctgtaaactggagacgaatttattaagcctaattaatctgtaattagcaaatatttaatgtagcatcacattgacaaatcatagagcatttaggcttaaaatattcatctcgcaatttacacgtaatctgtgtaattagttttttttctatatttaatactttatgtatgtgtccaaatattcgatgtgatagggtgaaaaaatttgccagagaatctaaacatggccttaaaaaacattgtacgcaatgcaacaaaaagtattttcaggaaatgtgttttgaagacgtggagtgcacagtccaagatagtaatggcttaaggggtcgcgatatcatatattatggttaggatacgaatcagatttggccagtagctaagggagtcaaaagaacttaggccatgtttagttcgcgaacgaaaatttttggtgtgaaacatgggatatacggacacgcatttgaagtattaaacatagtctaataacaaaacaaattacagattccacttgaaactacgagacgaatttattaagcctaattaatccatcattagcaaatgtttacttagcacaatgttatcaaattatggcgtaattagacttaaaagatttagtaattagacttaaaaagatttatctcataatttacacgcaatatgtataattggtttttttctacatttagtgcctgtttagtttcaaatttttttttcccaaaaacatcacatcgaatctttagacacatgcatgaagtattaaatatcgataaaaataaaaactaattgcacatttaagggggaatttacgagatgaatcttttgagcctaattagtccatgattagtcataagtgctatagtaacccacatgtgctaatgacggattaattaggctcaaaagattcgtctcgtggtttccaggcgagttatgaaattagttttttcattcatatccgaaaaacccttctgacatccggtcaaacgtctgatgtgatacccaaaaatttttatttcgcgaactaaacggagccttaatactccatgcatgtatcaaatatttgatgtgacagccgtgaactaaacggacccttattttccaatttggaaccaatatcccggcagacactgaattggaggcatctaggggtttcgtcgccttcgccttcgccgccgccgccgccgcttctatctcttcttctccgtgaccggcgcacatcgcagcaggatagccggcgcaatggttggccttaaccggtgagggtgctaggtttgccgtcctggtgtcccgtccgacgagctccacgggtcagccgaggccgagcggcaagtcacgcgcgcggcggcatcgcttccctgccttgatcggtaggttcctgatctacacatttagtcctcagattagttcgtttcgtaggtggattaacgaacccaatgatgccgatttgttaccagatttttctttcttcgccatttcgatgttttgctcaatttaatccccatctgctcacctgctcgatctgctcttgccgcggtcaatccctcttcacgcggttgcaggctgacgacttcctctcctccacccacccccgatggaggagaaccttcccaacaagcggcgcaacccggcggccagtctcaccgacgagctcatcgtcgaggtcctccgccgcctccccgtccgctccgtgtgccagttcaagtgcgtgagcaagtcctggctgaaagaccaagaacagctatagagggggtgtgaatatagcaattcaaatcttacccccgaaaatactcatcaagccggatttctcaaaaatccttactagaaccgcggctattagagaagccggatctagaaaagaagagagaaagaaattcccgaaactagaagagaaagagaaaaggaatttcccaaactagaagagaggtgaggaggagataacaaaactcatcatcgcaaagtttaaattgcaagtagaatttaaattgcggaatttaaatgaacaaggcaaaaacgaaatccttcaaatcatttcattcaaaggtgatgcaaaataaccgctcaactaagagcaaacatattccttcagaggaacattaacacaaacttaaaatctctcggacaaacacactccaaactaatcctaatacaaaagcctctcgggcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctccacgttgcgcgccctcgtgcgatccgcgtgattccacttcaagccaatcagcgtgcaccgatccgcgtcgtgctcctccaagccaacgcatccgcgccacgcgtcccagagagcgcgtgcctgctcctctcacgcctgcgcgccaccagtccgaagccgtcatgtcacgccccgaactaatcccgaccggaactagcccgtgacgctccaaattaacctgttggtcgataccagtcctaggaaacagtgctggtatcacagggagacagaatatcacagcaacagcggtcactttattatagagtagagatacagtcatgttgggctacggacagatcccgagctcacaactgcattacaaaagggaaacggaagccaggactaggaccaaccaacacaggcgcgacttgggaactagaccgaaaccctaaaactcatcgtagccggcttgctcctgaaagaactcctcatcagcaggatccgcttcttcttcttcagcaactggggggggattatttatatagagcaagggtgagtacgggagtactcagcaagccaagggaaataagtgtttaatgtaggcttcaaggaaaggctgttgtttttgctgttgattttatttgaactcttttctaaaaacagctaagtgagtgtttctcaaacgacacggttgagacagtgcgtctcgtccggtcggagtatgtgcaatgtatcagtctttaaaattgaaaacaaggttggcacccggccaacagcttttcaaacggccacccgggccaacaactttcaaacggccacccgggcctagctgatcccatcagctgcagatttttcaaacagcgaacccctttctacaacaacaatttcacaagcagtagtcaaacaaaactacgctaggaatcacctcacatccgcccatgacggtgggcacggctgttcgaacagtttgttaacctctgcagatggggtacactttacccacacgacattactaacccggatcacccagcccgtggggatcagccacgtcgggagacctccaagctttcatgacaaggcatttccaaagccgacacaggtttaccatataccgacgagaggggtcccagactaacaacaggttaggtcccagaccatactgtgccaggaagcccaggggtcctccccgacaccaccccggcgaatccacatgtctctcggcatcaaggctcccctgataagctagttactcagccaggggtgtcccattccacccatatggtcgtacttatcttatgtttggatgaaattccaaggaaacggtccttaagtgcaagagcgggaaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactggatggttacaaggggacatggtatagcaattaacaatggaaggatcaaatgcaacaagttaggtatgcccaccgatctgccttgcagacggggcaacatattaagtgcaatcctatcaatgcataatattttgcaagcaatatgattaaatttcaaatataggctcaagatgttcaaaggtggcttgccttgctcgagatctggagcttgatcctcgaaagcctcgcgctgcggatcttcgggctccgaaactacacgcgaaacgggacaactcaacaaacggcgaaaataaagccctattaatgacctctaagcgtgccattagatagatctcaagatttgaggaattttggaagttgaacggagtcaaacggatttacggttgggaagatattgaatttctaagattattggatttttggtctaaaggaaaaggatttaattaaatcctttttgaaaaagaaaagaaaagaaaaaaaaggggagggaaaatagacttttcctcgggcggctagggcgcggcccgagagagatgggcggtccggccgagctaaatgggccggccggcccaagaaggcggcccagagcggcccaaggcgtgcgcgcggaagggaggagagagtgagccggtagaccgggctcaccacacgcggtcccgggtgggacccgcttgtcagcggctcggctcaccgtgcggagggagcacgcggcgcggcgctagggtgggggagggatgcggtgcacgcgcgcggttcgcggtggacgcggatgcggcgggcccacgcgcagcctctcggctcgcggtggaccgcgcgcacggggaggggctgaccgggattggcccgatccgatctcggccgagctggcgccgacatggcgcctacgtggctgccacgcgggccggcgggaggtagacgacgacgccggccgaaacggacggcggacgacaacggcgagcggcggagcgaaccacggcgatataggcggaagcgagtacaccgggtggttgaacaggacaaggggagacgagccaacggctcggattcaccggagggagtccgtcggcggcggattgcggcggcggcaaccggcggagagaaaaggggaaaacggcgacgaggtcacgaggggccaattcccggtggcaagagcatctacgcggccacgggaatccgatgctagcgtcggattgggcggagctacgccgagcgaggccggcgacgagcggcgcttccgagctcgggcggcgacggcggcgagcacccggcgagcggcggcaacggccggggcggcgccggctagctacggggaggctactcgtgctactaccgaaaactaagggggagaggtggagcgaggaggaagaacggagggaggcactaccgagatgaggaggggcgctgtgacgagaggccgacggcgcgggagtaatctctccggcctcgggccgaggaagaggaagaaaagggcgcgcccggagtccccttccgcgtccttgctcgtgccggctcctccgacacgcgcaacgacgaacggcgacggcgaacagagcacgggaggcggcggcaatggcgtggaggcgaatgggagaggaagggaaaggggggagctgggttttaagggcggcaatgtcggtttgggaaccgacttagggcggtcaaggcgcgagctggcgctccggctagcagccaaaacggcgacagaggtgacgccggcgagagggaaaaaggaggaaaatggggaagagaaagggggcttgccccttgcttctttgggaaaaggaggaggggagcgggggcgacgcggcagagggaggagggctctgcctccgtctcttggcggcttgcgcgcggagaggcggggccgaggcgatgacgacggcgatgacggcggggcggtgtggagcggagcggcgacacgagcgacaggcgcggcaggcgctgacgacggcggcgaccaggcggtcagccaccacggcacgcgcgcgcgggaagcaacgggcggcgtggcggtttgagcggcgtggctcgggcacgcgcgctggctagcggggccgggcggctgcgcggcagggcagcggggccaggcggcacagacggcgcaggcgcggcaagggcggcgaccacgcgggcgtgcgcacgcgaacacggcgcgcgggaagcggcagcgagggagcggagagggaggactcggctcggcgcgggcggctcacgcgcacgcgcgcgggcagagcggagggggagggagcgctcggcgcggctctcgcgcacgcgcgtgcggcgcgcgggcggagcgggggaagggagagagagagagagagagcgcaggggaagggagggggag

SEQ ID NO: 15526 - DNA, 2947 bp, Oryza sativa
attagagaagccggatctagaaaagaagagagaaagaaattcccgaaactagaagagaaagagaaaaggaatttcccaaactagaagagaggtgaggaggagataacaaaactcatcatcgcaaagtttaaattgcaagtagaatttaaattgcggaatttaaatgaacaaggcaaaaacgaaatccttcaaatcatttcattcaaaggtgatgcaaaataaccgctcaactaagagcaaacatattccttcagaggaacattaacacaaacttaaaatctctcggacaaacacactccaaactaatcctaatacaaaagcctctcgggcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctcacgttgcgcgccctcgtgcgatccgcgtgattccactccaagccaatcagcgtgcaccgatccgcgtcgtgctcctccaagccaacgcatccgcgccacgcgtcccagagagcgcgtgcctgctcctctcacgcctgcgcaccaccagtccgaagccgccacgtcgccgttcctcccaccgagccgcttctgcgcgcgctcgcgaaaaccatgttcccgcgcgcgccatgcgaaaaaccgcgtgggacccggtcgcttccttgacgaacagaaggccgccacgcctccaggtgccgtacgatctcccgcttccgcgcgcgcatgcacacacctgtgcatttgccgagccgagctgggccgtcgtcatgtctagggcctgctcggcctggccttcaccatcttgagtcagcaacgtgcttaggccgggttggttcggccttccctgccaaccgaactgccagcccacaagcctagtggccagctcctgttggtctccttgccattcaatcatggcagcacacgtgcacatgatacatgctagctacagtaagccgaattactgtagcagcaatgcactcggtcttcatgtccttgcacagtcctcttctccttccaattttcttcgcgaatccgatgcttgcacacttgaccttgtgaagcccgttgtaaagacctcctcacacggtgtccgcccaccgtgtgcaaccttgcgtccaatcttgtcacccagcattcttgatcgttctggacctcaactcctccctgagtctagtcccgatccgccgttgactaagattgactgcgatcacctgcacacacatgagccaaacaaccgttgtcttggcatagatgtcacaacctaaccaatgttagtctacgcacacacttcttgcacttccggtacttgtcaatttcccatcacaaaagaactataatcacacatggtttcacaatctcccccttgatgggaacattgacaatctcaagcaaaattttgaaaatttgatttttgacacaaagcaaaccattttgcaaaagtcgaactttggtcattttgaaatcgcgaaaaatcaagaccaagtgacaagaagaaaagggatgcaaatgcaaatgcaagaatgctccccctatgtgccaaactccccctttcaccaagatctaaagcaagttttaattttcaataagtgcaaaattctctccccctttgtcaatgatgccatcaagaccaaaaagagacaaaaatgcaaaatgaaaatgattgaaacttgcaaattccagagttctgagagctttgagagttatctaaaggcatcaaaaagtagacatggatcacacagatacaagcatgtgctcaagcctagctaagcatgtgcaaaagaagtatgaaacaagttatgaatatcaggatagtatcgccagcaagcaaacagctttcaagtggattagtgatttagtgtgcatagctatttctagaagaagcttaaaaggaagcaaaccagctcataatcatgcaagatttacataatcaaagcaatgaacccatgctaatgtgctaatgcccagttcataaagagtatcaacatggtaacaaagcatagaacatgagcttttaatcttttctcatgacttttctttttatgattttttttttaaattctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacacactcagtagcccggacaaaaacagagataaagcttgtaaagcaagattgatacaaagtatggacgcataagcatgagcattcatgagcatgtactgacagttattgcaaaaagaatgaaaacatagcatgagtatgagatggatacttcaacttaaacaaacttctagagcaagcattgcacattgattaagttcaaatgaatagtcaatttaagcaggtttcaacaagcttgaacagcataacatgatcacacaagctacttaagcaaatgaaagctagacaaaagatcaaactagcataagagtaatacatgcatagcatagtgatgaccaagagataacaagcaaagctcaattgaagagtgtataatacaatgcataaagtaaacatgatgcaatatgttacaaatgcatgtaaaagaaaaacaactccccctcaaatcaagccataggggtggatcacccctaactcactccgcaagaactcaaaatgagagcgatcaagtggttttgtaaaaatgtctgccaattgattttcagattcaacaaactctagcacaatg

SEQ ID NO: 15527 - DNA, 1863 bp, Oryza sativa
atctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgctagaagtacttttgcgatcaatcttacacccagcaaaatcagcatctgaaaaagctcgaactgaaagggcagaagagcaggggtaccaaataccgtactcaagtgtagacttgatgtagcggaagatgcacttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcgccgtcctcatcaggaccaagcgatgaagtagttgccatgggggtggcgattggcttgcagtcggccatgtcgaacttcttcaggagctctttggagtacttggtctgatgtacaaagattccttcctttgtttgcttgatttgaagtccaaggaagaaagtcaactctcctatcatgctcatttcgaattccctgctcatcacatcagaaaactgggcaacaagtgcatgagaggagccaccaaatatgatatcatcaacatatatctggacaagaagaaaatcaatgccactatgaagagtaaagagagttttatcaactccccccatttcaaaaccattttgaagcaaaaaggttttcaatctttcataccaggctctgggagcttgttttaaaccataaagagttttatcaagtttgaacacatgatttggaaattttggattttcaaaacgaggaggttgtttgacatagacctcttcctcaataacaccattcagaaaagcacttttcacatccatttgaaaaagcttgaaaccttttgaagcagcaaaagccaaaagaattcgaatagcttctaatctagcaactggtgcaaaagtttcttcaaaatccaagccctcaacttgggtgaaaccctgtgcaactagtctggctttgtttcgaacaattgaaccgtcttcacttagtttgtttttgaaaacccattttgttccaatcacattaaaacccaaggaaggttctaccaaagaccaaactttgtttctttcaaaattttctaactcttcatgcatggcattaacccaattctcatcagataaagcatgacaaacatttttgggctcaaaagaggcaacaaatgctgaattgacaagttcataagaccgatttttagttaccctttcacccaggcctccgatcatcgagtcaggcggatgtcggttctggatgtgtcggggagctgttggtcctgatgtgccaccatcaatctcctcagctgctgaagatgatgtagttggtgcatctcctgaaggcgatgtagtcgatggagaaccggtttcttgtactggtggtgtactgtctagaggtggagaaatggaatcatcgtcatcatcatctgaatcctcatccacaaggatgctttcatctggaacacctgaaatttctggtctagctcctgggctagcctcatcaaaagtgacttcacaagtctccacaattttgttagttgaaagaacataaactcgataagcccgagaatgagtagcatagccaagaaaaatgccatccacagatcgagattcaaacttgtccaaatttccaggtttaagaacaaagcacttgcaactgaagaccctgagatgtgaaacttttggtcgacgaccaaatctgagctcatatggcgtcttgtgcaagatagttctcaaaaacacacgattgga

SEQ ID NO: 15528 - DNA, 1254 bp, Oryza sativa
aacgtggaaattagctcatggacactgcacccattataatatttattttgatcgaataccctcgagcccatattgtcaggtctatcatctctctatctcgctcgcacatgaatagttaaatgggggaggagtaacacggtgaagccacgctcgctgcaagacttgcacacccacttggaggaggccgctgaggtgggtttccatgtcgatgggcgccatagcacacacctttgtcacgaagcaacaggaataggtgtcatttgccgtaacggccatggcaccggtggtggtgtgggagtcggagtcactgacgcactcaacggcttggacgggtgtggcatggaggataatgtggttgaggatggcgtagagccccgtcgcaacaacctcgttgctccatgcaaacccaccacacgcttggttcttgggttgtcgcttgctggtactactcctctagctcggttgcatggcgccgagtgggctctagctcaacctcctcctcccgtcgccaccgatgatgtcttgtgcactcgcacctagcgctactgcttccacgcaactctaacctgcgtgcatccacttgcacttcgtccgcaccaccttgtcgatctccatgcactccgctcctactcgacgtcatccactgtggcctgcctggcactgccatgctccagcgcattctctcacctcttgctcctctttgccatgacttccagagagagaggggcaaagatagggggacttgacatgtggatctagccgccaagagatatttcatagcattcacgtggtttctctcttctattcaattagaaatgaatattttaatatacatggtgtccatgagctaatttccatatttacaaagtgtacgtcttcttataaaagttacttcgtgtggtagcatatagctaaaaccgtaaagtcacgatgtcctattttatctttcttcccttgtttttctcaggacatttaacttaatcccactcttagatttagcgtttaatcatttactatctatgtgtcacatgtagatcttatatgtgcatgacatgtgtggatctaggtaataaatgattaattgctacatctaacagtagtaaataattgatgggataattgtatttttgcccctactttcagaagcaattgtaattttaccccttgtttctagagtttgtgattttgctcttactttttttaaatgaagctattatttacgctcagatcgtttggtggacctgggaataaaag

SEQ ID NO: 15529 - DNA, 679 bp, Oryza sativa
ggccactagcgatgatagtagattagagaaataagtattgtccatcaactttacattgagtttgattgacatccctatatatactaatactaaatattataaatcttcaccccctaaacggatggcagatgtccaaacccacctatcagcatgctgagtcatcaatgccattgttaaacggagttaatgacgtgcacgtgtaaactctctctccccgttattgcttagaaaagactggctcgtcatcttcgggtagtttgccacgccgctgttgccctccttccacccacaccactgttgcttatgggagagttggcaccggagaagtgcatgtggatagggcggtcacccgagttgttgtttcgatggctgttgggaccaattgttgttgctgcaaatcgacaatgttaatagccgttgggagctgcgcgccggtgaaattgacgagctggtactactatataatcgatttttccggataagaccccttctaagttgcaggtaactaccctcacctgcaaaaattgcacccgataggacagtttaaggagtcgcatatgaaaatgcattatggcttgtggccccttatgaggcctgtctgcgataatagacgtattgtataccgcaggcgggcctcttaagggaccgcatgcgataatgcattttcacatgtgatccc

SEQ ID NO: 15530 - DNA, 902 bp, Oryza sativa
atagataaccaagtcatgagattaggttgagatggttagtgcattgccgacaattataatcttataagaataaaaatgcatgtggaaaaaaaatgctgcgtaaagacattttataaaatatctcatcattaactatgacaactcattatgaagcattgttagctagaatgcaatattaaaataatgttttttacaatattcataaaacgtctccccagtatgtttttttgttgtagtgcgtacggattctcattattatcgggatgctatctttttcatcgcgattgtcacacggttgttgtatggtttgcatcacgaaactagccaggcattggccctcgccaccaccctccactcaagtgtcccagcagggccgtccctaagggcgcgcggccggagcgaccgaatagggttcccattttccaggggcccccctattggatgtgggtgtagggatggtgcacgaatgtagacagatgtgagatttgtgactgcttccagcactgctttgaaatatctatgtattgtatctggactatgctgaaaccaatcttgaagtgtttcattggttgcattttttgccactgtatataagaatatagcaatctgctcttctactgaaacatatattgtgtcagttaggtactctttctcacgtaacttattgactagtgcatgaaaaatgtcgacctccatacggaagtttcttttgcataatctttcatgtcctgttaaaatctcatgtacacggcaaccccctgtaagttttgacgtgtgcattggtctcctaatacaagatgattgtgatgaatctactaaagtaggcagaacaaaatgaatgaactcatcatcactttctgatatacgtcggtagcttggattcatggggtgcagatgctacc

SEQ ID NO: 15531 - DNA, 501 bp, Oryza sativa
  unsure (1)..(501): unsure at all n locations
agcttggtgatgtggcagacggtgcggttgttgaaggagcagtcgcacttgatgccggggttgacgacggggctgtcgtcgatgttggtgtcgtcgacggcggtgccggtgcaggggtcgccgccggtgatgttccaagtcttgggcggattcgttccccatctccccaggatcgcgttcagcgccgccactgcattggcgttccacacaaacaccaatccatttctttatatgcaaggtctaaaccaatatagaaaaagaaaagaaaagaaaaaacagagaggaagaagcagcggcgaatagtgcaaaaaaaaaagtttttaaaatgtacgacgcagttcacttctcgaccaacattcgaccattcgttttattcaattttttacaaatataaaaaatatttatatcatacttaaagaatatttgatgatgaattaagtcannnnnnnnnnnnnnnnnnnnnnnnnnnnnnnnnnnnnnnnnnnnnnnnnnnnnnnnnnn

SEQ ID NO: 15532 - DNA, 664 bp, Oryza sativa
ttagctatctacgagtaacgtgggggtttctaaaaaagggtcctggagtatagtgtaaagaaagccaaagtttcactttccagttcttgctatcttttgcttgaactctgaaatttgtcattccaagctctttgatatgcagagcatacttcttatgacaatttatttagcatattcctaccttttcttaaagtgtaaacttgtaggaggttccaaggaaattcttttcaatgcccgattccagcatgtttgtctaattcgtccaacttgacaagcttgtaagtacttctttcttaggtgacattttccccctgatggttggcaaggccaagcttgtcatgataatttgtgttctaaatacacatatgcagacgaattggtgatattgtaaacgggagctcttcgctggcctttatcagtaacctgacgtctttgaatatcctgtatgtgacatgttttaaagttttattaaacatcttacagctttatacattgaaaacttgaatctaagtggggatcttttgttctttcagaatattgaggaactgcaagatatccgatcatctcagaacagtaaatttctcttagcttggaagaataaccttggtgtaagtttttcttgacataaacccacgtctattgctatggcctattattctcgtag

SEQ ID NO: 15533 - DNA, 714 bp, Oryza sativa
gtggcgtgctatcttggcatgaggtgggtcgggtaaagatcaagcggtccacgaccgagaaagcgtgcgtggttgtgacatgttcctgtacaggccaccttgcctacggcccaacgagaacttgatggagctcctcatcatgatcgacggacggcccccgcgcatcttgcggtttggcggcaagcagcagcactagtatggctatcgatctcgccagccatggcggagctcgccattgaagagggacttcaaaatccacacggaattaagccgatttgagtgggatttgtggggggaattgatgaggaggatgagaggaaccgatttttacattcaatttggggcgagagcaaccgaggagggagatcaagagagggcattgttgcatgagttcaccggaagagagaaggatggtggcgggcggaggtggaagacgctcctggcgagcgggccccacggtggaaggatcttggtcggtgcgtggagtggctgaagcaagggcatttgggtcaaaccaaataagcaaaacaatggaaaatatttgcaaataactgaaattggctaaaatgccagtgtggcaagatggggacgtttgaagatggcattataacgaaaccacattcgaagatggcattctggcgaaaccccaacccgaggatggctaaatgtcaattttctcctctagcatagtgccatgccactgttccagaaatg

SEQ ID NO: 15534 - DNA, 643 bp, Oryza sativa
  unsure (1)..(643): unsure at all n locations
nnnnnnnnnnnnnnnnnnnnnnnnnnnnnnnnnnnnnnnnagctaggagagaggaagaaaaatttatctggaactggaagaacaaaggaagtgaggtggtggaggggagcctgatcccctgatggcctgatttagggttggcgtaggctgcttgagtggtttcgtgcttgactgcttcaatcggtgtgtttgccaccttccattgatggcaaggatgaaggatgggagggagagcaagagcagcaaaggagggggaagaacgtggagcagcagaggaggagagggaagaacgtagcggcacggtggaagatcgatgggcgcggcaacggagtcgtcgctcgtggcggtgtgaaaaaggggtaggcagggattgcgctctctctccaggctctcaaataaggcaacctaaatccccttctataccgagtcagtcccacgtggtgcttctaaattttatcatgcccaaattttgatttctatcacctagtcgccacctagacgcactgtcccgttgtctaattgcgcccaggcaccgtcctgtccaggccgtccaggctgcctaggaccgactaggaccatctaggcggtaaatcgactaattcactgnnnnnnnnnnnnnnnnnnnnnnnnnnnnnnnnnnnnn

SEQ ID NO: 15535 - DNA, 677 bp, Oryza sativa
  unsure (1)..(677): unsure at all n locations
nnnnnnnnnnnnnnnnnnnnnnnnnnnnnnnnnnnnnnnttcgatcactgctttagttttattttctcttagcattcatcagttgttactttctgtttctctaatcagtaatcgcataatgttgaaaaaaaaattactagggcggtgtccctcaatccgttatctggacctcttccgaaggagatcgggaatcttaaaaatcttctatcattgtaagagatatcttagttaaatttcttcagagttgaagtttacattacagactattttttctactcggagttgaagtttatactacggactatctgaagtaaattagttacacaggagacacaaatgtgtaactgtaacttattaagaattttataaaaatttatcatttctacatgagtttcttatgcttgcatcagatccaaacagtaataaatagttcttatctgctatccaaaataacaaaattgtagattcttaagcagtggtttgtaacatgcttaattcttacagaggccaatttatgctattttctgtctgtacataaacaaaatcgtagccaacatgtttctttgggattttaggggcattatttcaaacaattttactggtgaactccctgcagaactgggcaatttggaaaaacttcagcaaatgtaatcccttgtccattttgggctttcaaa

SEQ ID NO: 15536 - DNA, 773 bp, Oryza sativa
  unsure (1)..(773): unsure at all n locations
nnnnnnnnnnnnnnnnnnnnnnnnnnnnnnnnnnnnnnntcaggaatacatcaagtatagggacttccagcaagtacacttccacggttcatagttcacagcttgtttggccctcgtccacgatgatgacggcatgatccatggcggcggcctcaacggagatgggatcaatggcgacgacaggatcaacggcgctcgcccgctggtcctgcacagggtctgtcgcgttggaattcgaaacgtcgcgcgtgccggactccaaggcggcagcggcacgttctacaccgtgacctcacaacgggagggtttgcgacatggcggcggtggcgcggcgaaggggcgccggcgagtcgctggaaggcggcggggactcaggcaggcggcggcggcgaatcgtgtgtgctatagaaatgaaacgacgcggggagggcggacggacggagctgtgattaggggggatttgcataaaaaacaaattagtagagatgagtgagggcggttaagtgcaaaagtaacccacctctgtccctagagctgggacttgggccgtgccgggctagcacggcacggcccagcgtgcttcgtgccaaattgggccgttccggcccagcacggcccacttgtcgtgccgtgccgtgtcagcacggcctcttcaggacgcgggccaagcacggcccaatggcccgacgggcctattcgtgccaggccggcacaagcacgacccaaaagacgggagcaggcccgctgcgctaagaagaaactctggcggcgac

SEQ ID NO: 15537 - DNA, 13500 bp, Oryza sativa
  unsure (1)..(13500): unsure at all n locations
caagggacacaaatgtgagcttggaaggacatggctgcttcctgaagccggtatcagcgatggcgaccaaaagcggggtcaacgatctgaacactatgaaggtatccacattggcatgcttcaggagatgggtgttggtgaagatggcaagggggaacacaagtgcagccggcgcaaacttctttgcggtctggaggttgaagggatcatggtagaggagtccgagctttccgagggtccagacaccagccactgatgtcaagtactgcagggcagtgaggaggccagggtagctgaacttggtgatggcatacttgttgatgatcgcgagcaagctcgagcagagtgcatatcctatcacgaggctgctcgtcgcgtaggcctgcttcgccatgactagaaacaagattgtattcacctgaccagatggaattgccacgttagtaaaaaaaaagaaggacattagcttatacaaagatgcaatactcaatatatatatacatcaaaaggaaaaaaattataacccaaaaagaaaagaaagggatcatgcatgatatccagcacattgctaaacgctaacgctgattttcaagaacagccgtcagacgaaacaaaacgtgctcctgcactgcaagaacggatacaagctgacgattcgcgcaaaaaggattgaacggtctacattgaactatccttatgtgttgctacttgcttcagcaaattaagcagcgggcgaaacaatcaacagccacattaaccatcagcgaggagcgagcaccgagaccgaaaatgacaaaagaaaaagaaacgaagcatctggacagcgcccgaacgagggttttggacaaagaaccccccacatgtcgccaccgacagaggcgggcggccgaaccacggagccctagcagctacaaacgcctcaccaatcggccgagatagatcccgcgggagagattattcggatcccaatcgcatcccggggaaaaaaaagaagacgggggaaatgcagaggaatcaccgctccgacgaaggggggcttaccaagaaagctcgaaagagtatccggaggggggagagctccgccgctggcggccgacgaggctggcggcgagtgggggtttgttggaattgggctaagaagagggccgggccgctgctgatccaaatcggcccaactgggtcgcgaatcgagccagggaagaagcgtcagccgggccggagatgaatgcgtgcgccgatctagccgccgaggacggatgcgacgagggtctagggtttcggcggtggtacggggtagaggaaggcgcggcgacgggcgacgggcgagggagcgcgattgggatttgggggaggagcgatccgcggatcggtgcgaggcggcctcaaagtcaaccgccgctagcccttcgagctcctcttcttttgctgttgccttgcttgctagcgccatcaagtgagcttagcttagctaattactctatcgatcagatacattaggaaaggacagactaaacgaaatacgtagaaagtaatcccgggatgtgatgtatagaaaatacatttactactttttgagtaaagtgcactggtggttctctaatcttatagggttgtgtcatatagttccctaaactctcaaaatgcatattcaggtcctagaacttatcaaagtgtatcatctaggtcccgaatcgacacatcccctctaggatcctatgtggcgctgatatagcatgccacgtggacatgacgtgtcattttcttcttttatttttatttttcttttctgttttcttctcattcttctttcctttcttctgctcaggtcatagagaaaggagaataaaggggggaaaagaaaaaagaaaaaatttaaatgggtcctatttgtcagtcaaaataataccacgtcatgttcgcgtggcaagccacatcaatgccacgtaggatcctgatggggttgtggcgatttgggacctaaatgacacactatgacaagttctgggacttggatatacattttaagagtttagggacctagatgacacacccctacaagtttaaggaccgcccgtatactttactcctaatttttatatggggcaattgcgtttttatcttttttttaagactaactactaatttggccatactttttcgagttttctcatttgaccctcttttttataaacgaatatgagacttgaccctattccgtgaaggcaatatgacggtattaactcaagacggaagttccatctatacccttttgaatttaacccggtatctcaaagttttttattcaatgcagttgtgtgcacttattagcatatattaaattgccacaaacacaaatatatggcacaaatttatggctaccaaaaacaaaaagaaaaaagaaaaaaacatgtcaagcagcagaacacccgtgccgccgacggcgaactcccaaacccatctgtgcaaagcagccgccgccaccactcctccctctactcaccggctccgttgctccgacccttcgcgagcaatcgtcgtctcaccgtgcaccgccgtcgctggtgctcctccctccccgcagaacctcaccaccgccgcaccgccttcgccgacccgccggagccaaatccatcgcacacacttttcgacgccgccagatgcgccgcgtgcgtgcctcggcaacaccagatccatcgcctcgtcgccgagccttcgccagatccaccctgccgtcgtcgcccccctcctcctcgtcgtcgagccgccaccgccgctcctcttcctcgtcgagccaccgccattcctcccactcccccgcatcatcgagccgccactactcctcctcctcgttgagccaccgccgccgctcctccgccttgtcgagctgctgccgctcctccgcctcgtcgagccaccgccatcactaacagtgtgatgaaaccagggtcagatggcaactctaattttgaaaaatgagcaaactttaaaaagtagagtcaaattagtagttatgctttagaacaggatcaaatgagcaattatccctttttatctctactattataaaaattaatgatgtttttaaacaaactatcgtacgtcatctttaataccgattgcagggttagaacccttgctattgattggcccacgtggcatcacgcatagctcaccgaccagattctcggctggagaacatgccacgcattcgaaccgtcccatagccgtccgattacatacgaacggtgagaaaaggcctagcggacctaaatataaattgcaagtttaagaagggtttttaacaaaatgcacaatcttatctagaacagtccggagtatatgaaaaaaaaaaaacgtaatcagaaaaaaaaatccggcaagaacaatatattcccctttcctagtcaccatgccgtcgcgttgatggcaaaaacggggacgatgagctcgagctcgattgacctggagctccttggccccgccctgccttgatccgacgacggagttgtagacgacactggagggagccggctgagatagagagcgccataggggatacctccgcgctggtcctggagctcgacggcccgcccgcgcggggccttgatatagacgagtagggacggcggcggaggtccacgccgtcgctacatccgcggggatcagctcggtcggctcaacgccgctctgcttgtcgccggcctcctttacgtaccgcctctgcgatcaaccgctcgcgtcgtctcctcgatagcctcctttgccgcttccgccaccacggccggtcgcaccgccccctagccccttccgccaccaccgcgacctctccgctcgtcgccggagatcggaggcggagacaacggagctggtggtggcaggacggccggcggtcagcccgatggctcctcttaacccgctgccgttcgaccacgtacgccacctccgctgcctccgtgatgcatgcagagctggccagcttgaagaagccttgaacccagtgaccaaagaagccagttacctcttgcatttgcaagcggcctcatccatcagttctttctcagcccaaatccatgctggaaagcacaagccacaacaatagtagcgcagtaggtgcagtacgagagaataagagtgaactgggattgaaagcagaggtgggctctcaaaaaaaaaagcataggtggaacgacggggcatttgcatgcatggaggatggagcacgtcactgctcccaattcccaatggccacctgctaacttacccgtgccatcaactcctaaaaaaatttccatttcacccctaatagtattttttatcctatactttactaaatactccctccatcatctacttttgatagtcatatttcatcttggcacacagaccaaggataaataattatacttatcatccatttaaacatactactagttattcctcgtaaacaaacgattcattaatatttacatttctcgatgcctatgtagccaatcttatgtagaagaatggagagtcacacattaaatttgagaaagtcattaagatgataggttgtggattgaaatatgcctatcaaaaatagattttaagatttggaaatatgtctatcaaaagtagatggagggagtacaaaatatttaaaaaaaatacccctaggttagtactcatgtacttaaaaaaagataaaccttggatttctgtgtccaatgttggaccgtccgtcttatttaaaaaataatgaaaaaattgaaaagataagtcacgcataaagtattaatcatgttttatcatctaacaataataaaaatactaattataaaaaaatttcatataagatggatagtcaaacgttggatacggaaacctaaggtttttttaaggacggagggagtatttatgtttaggaccttagaagttttgacttttcaagacttgtttggtctgatgtacaaagagtaacatattattatgactctatattgagtggatgataggagttatttatttaaaaaatatgcaatctaaattttgtaattttcacgtaatttgataaattttgtaaatcctactaatttaaaagaaatatcttccaaagtagtatttgttaaaggcatacagatacacttaaagtagttaactatccgttacaaatcttttttaaaaagttgaaatataattattcaccagacaaatacagttaactaaatacgacacataagaattagccatgcataaactaaccatatttactctaattgttgacaatggccctgtttggatccgaagggctattaaatagtcctccggaatcttgctatttagaagtattaaacgtacattactgacaaaacccattccataacctgtagactattttgcgagacgaatctaacgaggtatattaatctatgatgatttgttatagtgatgctacagtaatcatccgttaaccatagattaacatacctatgatccagacagggccaatattgctctaattgtattctattttacctatgattagctaatcagcctgacaatctctatattgtgagataaatatagatggagggaatatcatatactgaccatagaggtaagtatgtggcactaatagattaattagcacaagaaaaggtttgaaagtaaatagacaagtattacaaataaaagaaaataaagtttttttaattttgttttccgtagtaatgctttaacaaagcttaaaatctttacatgaatatggttactacaggttaattgttcctcaaccttttcaaaagtcattaaatagtttcttctaaatgaacaagtgtatatattttttcaaaaaaaaatattgcattcgaaactcttaacagcaacaacaataactattttaaataagtaaatatgtactagctataagttggttttccaacaggcacgctgattttcttgaataggaaagtagggaattggaaaagactatggaaggatgatttggggaatgtttaagtttgttgccactttcaatcttaccgaattttagcattgccaaattttggtagtaaacacacttcaactattacaatgttactcaattttggcagttccagaagttctctcttaaaggcatcaaaatgtagtaaaggcatcaaaccaaacaaagccaatgttaccaaaattcgataataccaaaatatgtcaaaattcgacattactaaaatttgatatggtcaatttttcaaagtgtacaacccatttatatctatttctgattctaatttttagggtgttcaatgaaaaatgttggactacttataatcgaaaccattcctaagccactatgcattattgggtaagttgaatgtaaaattttgtgattatgtagccctttgttttggatatacagatttagttatgatcaattcgtatttacctagcttcataattaacagtgtactgggttcatccaattgagctggcctatatatactaacgcgcggcaaagcagcggttattttctagtattatcctattccgctttagcgtagcgccccgcttcgcgttcgcttgcacgcgctaatttttagccgaaaccattgtttcgctcggtttggctctaaaacgtgtgcgtccacgtgggaggaagagaggaatcggaaaggaagacgatgggatttccgacgcgcgcacgtctgcgtggtcggggcttgcctcgtgagtcatgaccccctaatgagttttgatcgaggaaatttatcgtgctgccacatcacaaattcgtgattagttcgatcaagcacgtatatgtccgtgtaaatacaggactcaacaaatgaaccatactgtttacacccaaatttagtatctaggattaaaataaaaaagattgccaaaatttagaaatctaccggtttcctccgagtgggccggtctgaccgccatgtgttgggcggtcagaccgccggttgagggccggtcagaccggcggtatgtggccggtctgaccagcaggtccgagtccgaccctgtttcgtcgggtttcgaggtttccttgttccggaaggcatgtttcgggtttcctttggtttctaccccgagttggacgtggaggagggcctgtagagggcaagaccaacccctatataaggggacaaggccggttcattgtaaaaaccatcctacaatcaatcaatcgaatcgttcttttcatattgcttttagttttctcttagtttgtccatctttgtcggtttgcgctgtaaaccgtccgccgccgctgcgagagtgcgacatctctttgtaggtttgtcctgaaaaccttccatttgcccacgagacgggtagctatctagaaatcggctccgctagccggtttagttatcaaaacccatctaggtttagctctttgctagatcgaggtggttggcgactctaggatcaccgcaaagcttaaggtgctacgatcgtgcttgtcaacttgttaaaaaagttgccaacacgatttttggcgactccgctggggaagagatccgtttatcgtcaactcgacttcgacttcgccatgacgaagccatcatccaagacggaggtagagccatctaatgtgatgccggtcatattggatgacttcgaaggagaggatcgtaaagctgtggaggagtacatcaacgagctcacacgggaggcgttgatgagattaactactaggactcgtcaaggcgtgatcatcaagcccgggccacgtcccaagctcgctcgcgacgtggtaagtaatgacgaggtatcgcaatctatcaaccaacaaattgcatctacaatagatttatctatggctaattttaaagatacattagatgtaatgtttaaggaaaaggttgattggtttttaaggagtaggctaggtgcttttatggatgattatacattaaaagataaagcctataccactgttgatcaatctcctatagatccaatggggtctaaaaccagcggaatggtgttcacgaccggtccgaccgggcctgatggccggtcagaccgtgatacagccgtcggtccgactggccagatggccggtcagaccgggtattatcccaccggtcagaccggctctcaggccggtccgaccgcgcaacatgacgcccgtcagaccgggccttgggccggtcagaccggcgcaattgtcccaatacagggtatacatccaatgactaatgctagttatttgtaccactttagaacatttgatcctcctgtatctactgctaccactaatcctcaagttcccccacatattcctaacatttataatgatgtttctaggggatatcttcccgatactaggcaaggccaatataatcatattgcgccacaaacccaacctattagaccaccaaacctaccaccaaatccacaagggcctaataacatggaagatatgattagcgatattatgaggaatggattcgggatcgaaactagaaatcgtgctagagcttacaaaaagccatatctcgattattatgataatgtgccgtttcctagaaattatagagttcccgaatttgccaaatttagtggtgaggatggtaagaccacatgggagcatgtaggtcaatttttagcgcaatgtggtgaggctaatagtgatacttttaaattgcgcttgttttctttatctttatctggtaatgcttttacatggtttacttctttaccggcaaattctattcatacttgggctcaattagaagaacaatttcatgattatttctatactggggaaactgagcttaggttatgtgatttaacatcggttaagcaaaagtataatgaatctgttgttgattatattaagagatttagagatgttagaaaccgatgttatactttgaatataactgatagagatttagccggtcttgcttttaatggtttagttgctcctcttagagaaaaactagatggccaacaatttcttgatgttagttaactcatgcaaagggctctggctcaagaaagccgggttaaggataataaaaaatttgctagaccattcgataaaagcctaatgttaatgtaattgattaccctgaggctagtgatagtgagaaggagggtgatcatgatatttatgttgccgaatggtcatggactaacaaaaataagccttttgtttgttctaacctgatgccgactcctcgcaaagatcggcaaagtgaagttaaatatagttttgaggtggccaagtataagatttttgattatcttttgcaagagaaacaaattagattacctaaaggccatgtcataccatcacaagaagagttgaaacgtcgagcatattgtaagtggcatgattctcattctcactctactaatgattgcaatttgtttcgacgacaggttcaatcggccatagatgaaggacgattgaaattcaccgatggctccaagatgaagcttgatcatgatccttttccggtgaatacaattaatttcaatgataaaaaggtgttgattcggccggagcaagccgaatctactaagggaaaggaagtggtcattggtgagccaaggcctaagatgatggtgccaaagaagccggaggttggcgtttggaaggagaataagggtggagcttcaacgtctaaggctcttaggaagaccaaagtaacctttgatatggttttggagaagtgtgagaagcaaggtggtgagagggatcacaacaaagggaaaagaccaagatcacctcctagggagcgatttggtcattcaccaagacgatcgcgttcacctccatattttcatccacaagatatgtcatggggttcttatccaatgccgccgccgggttatccttatccttacttcatgccgtggggggcaacgccgccaatgtacaatcatatgcctccaatgcaattcaaccaaggatggggaggaccacggaggccaattcatgagcgtttgtcttcgccaaacaaaagccgattttatggtaaaaatcgggttaatgaagagaagagggaaggaaagcgcaccaaggtggaagaaaggacttcggaggtgattactatcaaaatagggtcccatgatgtgcctataccttctggagatggagttggaaagtccccaagcaaaaaatccgaagccggtaccagctcctcgcagtcggccggtctgaccaggccctctggccggtctgaccgcgaccatattgccggtctgaccgggccatcaggccggtctgaccgccgacctgacgacagtctgaccgacgcctcaggccggtctaaccgtgtgccacacgtcggtctgaccgacgcgtctggccggtctgaccggtggtctacagccggtctgaccgagctccagcgccggtttgatgagagggctgcaaagggcgatgtgagggcttcatcgtctccaagcaaggttaatagaggacattatttacctcctagacagagccgaatcctaggtagatgcctaaggatttgacggctactcaaaagagaaggttgcaacgtcttcgagcccaagaactaagggagaaaaggaccgaagagcaaagagataaaaggttcaatgagttgcgaccaccaccggtatggaggcctaaatccatagagaaggcaaaaccgattgtagagaagaaaatagaacaatcggttgataaaagtgaatcatctccaaaagaagacatggatatcaacatggtatgtatgttgcctatggagttttgtgctatggatgaagccgaggttgctcaattctcattaggtcctaaagacgcggtttttgagaagcccgatgaatcaaaccgtcacatgaagcctctctacctcaaaggccatgttgatgggaagccggtctctaggatgctagtggatggaggtgccgtactcgttgttcaagaagttggggcgcgaggatgatgagttgaagaagactaacatgattctcaatggcttcaacggtgaaccaacggaagcaaggggtatcttttcggcggagctcacagtgggaaacaagacgctaccaaccgctttcttcatcgtcgatgtgcaaggtaactacaatgttattttgggtcgttgttggattcatgccaattgttgtgtgccttctaccttgcatcaatgtttaatccaatgggacggcgatgatgttgaaattgtgcaagcggatacatcggctgaggttgcaatggccgatgctacttttgagtggcgtcatgggaatatccaatgtttatcggggagggatctttctagctatgattttattagtatctccgatggcagatttgtacctatctctgtaaagccggctagtgtagcacggctaagccatataaatttgtataatgagtaaagaggctagttttgagtggttacaaaagagggtgcaagaatatcagtctacgaagaacgatattggtgaaactgttgaagattttgatgaagtggagaagcttggacaagggtttgcatcggccgatccattggaggaagtagacataggtgatggaactaaaccaaggccaacttttgtaaacaaaaaaatgaaagccgattataaggttaagataatcgagctacttaaggagtatgttaatagctttgcatgggagtaccatgagatgccgggtcttagccgtgagcttgttgagcatcggattccaattaaaccgggttttatgccttataagcaaccacctcgtcgttttaatcctttattatatgaccgagtcaaagaggagattgatcggttattaaaggcggggtttattaggccatgtcgttatgcggagtgggtttctagcatagtcctggtggagaagaaggggagtggtaagattagagtttgcataaattttagagatttaaataaagccactcctaaagatgagtatcctatgcctatagccgacatgatgattaatgatgcctcgggtcataaggtgattagctttttagatggtaatgccggctacaatcaaatctttatggcggaggaggatatgtacaagacggcttttaggtgtccgggatttgtaggcttatttgagtgggttgttatgacttttgggttgaagaataccggtgcaacgtatcaaagggcaatgaatttgatcttccatgatttgctaggtattatcttagagatctatattgatgatattgttgtcaaatcagatggtatggaaggacatatagccgatttgagattagcttttgagaggatgcgccggtatagtttgaagatgaatccacttaaatgtgcttttggtgtgtcggcggcgaagttcttaggattcatggtgcatgagagaggagttgagattgatcataagaagatagaaaaaattcgtgatttcaaagcaccgacatgtaagaaagaagttcaaaagttgctaggtaaggtgaattatttgaggaggtttatttctaacctagagggtaaaatcgatgcttttgttcctatacttcgcttgaagaaagaagccgattttacttggggggcaaaacaacaagaagcgtttgaagagttgaagaggtatttatctactccaacgttgtgcgagcgcctaaagccggaaagccttttcgcttatatattgcctcagaggacaaagtcattggtgcctttttgatgcaagaggaagatggcaaggaatatatcattacatatttgagccgccgtcttttggatgccgaaacgaggtatgtttttatagagagactattgtctatgcttatactacgcttgtatcaaattgaggcattatttgttatctagtacatgcatagttacttgtcaagccgatgttattaaacacatgttgcaaaggccaattctaagtgggagaaattggcaagtgggcatatgctttgatagaatatgatttggcttatggaccattgaaaactataaaaggccaattgtatgtgattttatagtagaccatcatatagatgttgcttatgagggagaggtttgattagttgaagttataccttggaagatttattttgatggttcttcttgcaaagaaggtcaaggcataggggtagttttgttttcacctaatggcatgtgttatgaagcatcggttcgtttagaatattattgcacaaataatcaagccgaatacaatgctttattgttcggcttacaagttatggagatggttggagctaaatatgtggaggcctttggtgattcggaattggtggtgcaacaagtcgccggagtctacaaatgcttggacggatcactaaataggtacctcgattcatgtttagatattattgccaattttgataattttgctattagacatattgctaggcgtgataattctagggcaaatgacttggcacaacaagcatctggttataatgtgaaaaagggattatttctgatattagaagagccggtgnnnnnnnnnnnnnnnnnnnnnnnnnnnnnnnnnnnnnnnnnnnnnnnnnnnnnnnnnnn

SEQ ID NO: 15538 - DNA, 681 bp, Oryza sativa
ttttttttgaaaaaatatatacacttgttcatttagaagaaactatttaatgacttttgaaaaggttgaggaacaattaacctgtagtaaccatattcatgtaaagattttaagctttgttaaagcattactacggaaaacaaaattaaaaaaactttattttcttttatttgtaatacttgtctatttactttcaaaccttttcttgtgctaattaatctattagtgccacatacttacctctatggtcagtatatgatattccctccatctatatttatctcacaatatagagattgtcaggctgattagctaatcataggtaaaatagaatacaattagagcaatattggccctgtctggatcataggtatgttaatctatggttaacggatgattactgtagcatcactataacaaatcatcatagattaatatacctcgttagattcgtctcgcaaaatagtctacaggttatggaatgggttttgtcagtaatgtacgtttaatacttctaaatagcaagattccggaggactatttaatagcccttcggatccaaacagggccattgtcaacaattagagtaaatatggttagtttatgcatggctaattcttatgtgtcgtatttagtaactgtatttgtctggtgaataattatatttcaactttttaaaaa

SEQ ID NO: 15539 - DNA, 1418 bp, Oryza sativa
  unsure (1)..(1418): unsure at all n locations
gtcgaccgcaaaggaatattctgcaattgagatggttataatagtactaaggtcatatcaactaccaatgtgagtgaagagttgtaaaccttggaattatacattctgaagaaccacggaatcaaggagtatcttgctgaagacagtttagccctaaaggtaaaatgctgcacaaataattgaatcaccaatctcagatcgcgcacaaatgttttcatctgtacaatttaatgtgacacatacctattgttggtgctatcaagaatgaagtcattagccaccaaattcctatagaacgcaaaatggttatcttgctaggaaacatgtaagcgcaacctagagtatgtatattttcccctctgcctgcattcaaaagtttataagaaatttcagaacataaaacttacagttgcaaattgttcccagtaacccatggaggaaagcttccagagagatggttatatgaaaaatctctgcaaaggttccatcagaagttcaaaaaaaccaagtacaaaatattcaaaaatataggagtaacatgtggccatgtgctacacttaaatgttaatttgctacacatacaaattgttcagtgaagggcttttgtcatatggcaagcttccagaaaggctgttgttcccaagaaacctggtttatgtacaggtcagtatggcccccaaaagattaccttccgaagccattgtatgacaggaacaggaatattcagaaagaattttttaatttcttacaagaagctaagcttgtccagattcagtatggattgaggaacatgacctgtgatattgttaaagctcaagtccctgtgccaatagggaagcagcaacatcgtcgatacagatgccttatatcaaactgaccaaaagtaaagagcaggaaaagaaatacttacagtaaggttaaccctgcaagcttagaaaagttaactgttccaagattatcagatatcttgcagttcctcagtattctgtaataaaagtatctaacttagtaacttgccactttgtgaagactaagcaattatgaactctatagcaaaagcttttcaccgtacaagacattcaaagatgtcagattagagataaacgacagcggggagctcccatttagaatatcaccgatccgcctgaagcacggacacttagagaataaagtacttatattgatctccatggaggaaacaggcagtgtaatgtaaaaatacttacaaacttgttaatctggttagatttgatagacttgctggaattggaccttgaaaagaatttccttggaaccttctacaggttaatgttttgattagatcataaatatatgatgtcaaaagggaaaattatacaaatttatcactcangccatgtgttgcactctctgtaggactagggctgagaatatgatat

SEQ ID NO: 15540 - DNA, 747 bp, Oryza sativa
  unsure (1)..(747): unsure at all n locations
nnnnnnnnnnnnnnnnnnnnnnnnnnnnnnnnnnnnnnnttggatagcagataagaactatttattactgtttggatctgatgcaagcataagaaactcatgtagaaatgataaatttttataaaattcttaataagttacagttacacatttgtgtctcctgtgtaactaatttacttcagatagtccgtagtataaacttcaactccgagtagaaaaaatagtctgtaatgtaaacttcaactctgaagaaatttaactaagatatctcttacaatgatagaagatttctaagattcccgatctccttcggaagaggtccagataacggattgagggacaccgccctagtaatttttttttcaacattatgcgattactgattagagaaacagaaagtaacaactgatgaatgctaagagaaaataaaactaaagcagtgatcgaaatcagattcttacaagtactgcatggcagaaaagtttccaataaaggatggcaggggacccgtcaagtaatttcgccgaagatcccttcagtaatatcaaaaccatcaagctaaacataaacacttcataatcaggctcctgtaccctgattattcttgctagtttttctagatgaggaagatgatagttcttcgctagttattaggatttttttactgaacgcttgagtaacacaatggagaacagggtatggtgataggtattctgcaagctttattttcaaacttctcaaaatatt

SEQ ID NO: 15541 - DNA, 754 bp, Oryza sativa
  unsure (1)..(754): unsure at all n locations
nnnnnnnnnnnnnnnnnnnnnnnnnnnnnnnnnnnnnnnnnnnnnnnnnnnnnnnnnnnnnnnnnnttaaggaagtatttcgacacgaatggcttatatattacgttaactgcagttaaagattttccaccaactgcttaccttatatcaaaattcttttctttcagaacaccctatgcaaatgtaagtgaacattttcatataaagaaaaaaaattaggtgaccaaattaatgcgcattgtgatatgtatctacctgcacatatatgtcaaaaattcgccttcctgtgctctcccaagtctttgaatctggataagcaaactctgcaaattgaagcttgacactataatttccattctcaagtcctagaccatagtatcttatggatgatggtgacatcctcgcggattggaataattctgaatccaatgtgtttcgaaactgttgggaactatatattacatagttgcgacttgaggcattattgaatattccaacattgctgacaccccattgtgtatttctggtaacatactatgatgcgactacgagatttgcagcatctacttcatatgtagtattatctgagcctttcctagattgattactgccacagtctaccgcaaaagacaagtctgcactatacatgtacaaatttatggtcattactgatattcccgaatgcttgcaactgatacagatgagtaagtattcaataacgtacatactggagaacctatctaacatggagtgt

SEQ ID NO: 15542 - DNA, 855 bp, Oryza sativa
  unsure (1)..(855): unsure at all n locations
aaaagcccttcactgaacaattntgtatgtgtagcaattaacatttaagtgtagcacatggccacatgttactcctatatttttgaatattttgtacttggtttttttgaacttctgatggaacctttgcagagatttttcatataaccatctctctggaagctttcctccatgggttactgggaacaatttgcaactgtaagttttatgttctgaaatttcttataaacttttgaatgcaggcagaggggaaaatatacatactctaggttgtgcttacatgtttcctagcaagttaaccattttgcgttctataggaatttggtggctaatgacttcattcttgatagcaccaacaataggtatgtgtcacattaaattgtacagatgaaaacatttgtgcgcgatctgagattggtgattcaattatttgtgcagcattttaccttcagggctaaactgtctccagcaagatactccttgtttccgtggttctccagaatgtataattccaagtttccaactcttcactcacattggtagttgatatgacctcagtactattataaccatctcaattgcagattattcctttgcggtcgactgtggcagtaataaatctacaaggggatcagataatactttgtatgaaactgatgctcaaaacattggagccgcatcttattatgttagtgacaatgcgagatggggtgtaagcagtgtaggtaaattcaatgaggcttccaatggaagttatgcaatatatagcccccagcagtttcagagtgcacttaactcagaattattccaaactgcaagaatgtcaccatcatcacttagatactatggtattgg

SEQ ID NO: 15543 - DNA, 738 bp, Oryza sativa
  unsure (1)..(738): unsure at all n locations
ttttttctgccaggtgtggggcccgggcccaagttgctccacacctggctccgcccctgactacaaggaatttatttggtgatcttttttatggtgaatgtgattaatacttttggaagatttttttttttgcacccgttgcaagtttgtgaaaatcctgtcaaaaatctatcagtgtttcgttaaatttaataaaatatacaaatcttgttagaaaagtatgggcaagtgttaaagcttgtatatgtgtttttataaccgagttgacaccgtcaaagctgtgttcggaagggcaatattccaacaaagtacgtggttatagtgagattaattaattattagcctaaaaatgatagtcagattagttacctattagcctaaaaacttgaaaatagattaatataattttttcaacctgctttcacatagaggtcttttcaaaaatacactgttttacagtttgaatagcgtgtgcgtaaataacgaggaaagcgagtgtggtaaagagggtaaaagaacacaggtaagtcatcttggcagagtaggggtaaaccggtgttgaaatacagtagaattcctattgtagaagagagatgtgctcgcatgtgcataggtatctacaggttagaatataattgcccccatgatgaatatggccctgtcactccggtggacagcaatnnnnnnnnnnnnnnnnnnnnnnnnnnnnnnnnnnnnnnnnnnnnnnnnnnnnnnnnn

SEQ ID NO: 15544 - DNA, 1537 bp, Oryza sativa
  unsure (1)..(1537): unsure at all n locations
aaagagatnctatccaagtactgaattttgatacatccacttatatatatggtacatcttgatacatttttaaaaagtataccagataattttataataatgatatgttgaaatgaaatgaaattatccttagttggtcctttatggcaaaaaaaaaaatagcattggtgataaccatcatttaattgacttataggttatcagccgtagccaaaacttaattttaatttttaatagtttatttttagaattatcttttaaatcactaagaacatgtaataaaagttttacgttgctttaatttgttcattttttacgacttattgactgacagaacatgtaataaaaggtttacaacaaattaaagcaacataaaacttttgttacatgttcttattgatttaaaagataattttgacgtattctaatactagtactattcttggagcatgtctttactctatttgtcccattaaaaaatctaatataagatttgacgtattctaatactacgaatctaaactgtatatcccctaggtttatttttatcaaacggaggaagtagtcttttgagaacaataattcatacctttgcagtgcagtcatgggtcataacacgtcatagtgagtgaattacatcattttgtaggaaaaataatcagaaaagtggcaacttgatcttttgacatgacatccaaagaatcaactgtgaaaacagcatgtgcaggaaatatgaatcagcacttgctcttacactgtgtcgacaccataaccttctggaaagaaaatatttatttttggaggcatggaacctttagtgctaaattacctgctttgcaggacggcctctctgcaaccattgttaattgttgccgcaatacatagtgcatttgcaactaaacagttaaagtatgagtttatttccctgctgtcaagcatgtcaattttcctattggccgatgcttttgtccaaaagatttgctaaaactgtactacaacttatgatattaaccttgtaagcgttaaaacaaaattttggccgggacaaattaatcatacataccacatgcgagatagggtctttgctatccatgcattacttaggcctaaacaagttggggaaaatttttgggttttgttgccatattggatatacgaacatacatttgaaatattaaatgtagtctaataataaaacaaattacagattccgctaggaaactacgagacgaatttattaagcctaattaatctatcattagtaaatatttattgtagcaccacattgtcaaatcatagcgcaattagacttaaaagattcgtctcgtaatttatacgcaatctgtgtaattgttttttttcctacatttaataatccatgcatgtgtccaaacattcaatatgactgcgtgaaattttttattttgggaactaaataagccttaattagtcgccaacctcgtaaatcaaacgagctattatcataatnnnnnnnnnnnnnnnnnnnnnnnnnnnnnnnnnnnnnnnnnnnnnnnnn

SEQ ID NO: 15545 - DNA, 6004 bp, Oryza sativa
  unsure (1)..(6004): unsure at all n locations
nnnnnnnnnnnnnnnnnnnnnnnnnnnnnnnnnnnnnnnnnnnnnnnnnnnnnnncgaatttcgatgactgcctgtcggcacctattgttaactgtagccctagggcatagcgcatttgcaattaacctactaattattaattttggatttcagaattaaaaaataatctactaaattgagagctcaaatgggtggaatttcatatatacaagttgtaggatagcgaaatccaaagagtccatacagtagtaaaaattaaaaatctattaaacattgtgtttaatataaattcttaatacgatatagggttctaataatttgagccaactaactaatggccatatctttttattgatgtgagagctttctcggagtgtccaattaatataaatatatatgactattggtttatcaactgctgataaaatgtaaatttaaaacttaacctagagttgatttgagggttttcatcatgatctattttccagctttagcttttaaatagctatgacatgtatataaaatttttactcgtaagttattattagatgcttcatttattttctacgacttatcatatcaatgtttcaattcatcttgctccattatttgtcctctttcatcctacttgacgcacatgtaccaactaccggtcacacaagttggccaagggcacactactgcaacaacaacaacgacatctctctctgtgttcatactaatgaagggttgcagtaaaataccggaccacgattttttacatctaggtgaatatgtatatctatatatagcttacatgtggctcacataatgtaaaaaagtcttaagaaattggtaacgtagaatatatataatgcagtaagtttatatacatacatgaaagactagatttattgtacattcggagaaacaaaagataaaattcagtagtgaacagttcctataagatataaatataccttttttttttctgtaagtgtgatcaaacttagatatgcgtattgcttataggacatacacatattttatcacacctgtttaactagaatgtcaatccgcgtgcaggcatcttcgttaatatcgtacaaagtactatacaatcatttttgttaattttgagtatgtatgtttgcataattgcgtgatattttcaaaataatgaaaaactcaaataatagaaatctccaagccaaatggaaagtaaaaagtataaaatcaaagttgaggaatatatataatgtgaatctcccgatatatatatatatatggagattcacattttatatatatatatatatatatatatatatatatatatatatatatatatatatatatatatatatatatatatatatgacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatgatgcccgggcaccatggagcaccaaacaaatttactatatatatatatatatatatatatatatatatatatatatatatattaatgttaactcattacatcgagaaaaaaaaagtcaattttactccctcgaacttttgcactggaacacttaacctcctaaataatttcttggctcattttacaccccaaaatattgaaaatggttcaccttactccctaacaatatttgtctttttcgtctctgatctatgtataggtcatattttgcaatgaaattttggtggattgatatataaattataacttatctctcaatatttagggaaattaggtggtattgatatatacattataacttatctctcaatattttattttgaaactttttaatcggtgtttacataggttgtaactactaagactaatttaaacgtagaggttttaaatttcaagtaaatagtcatgaaaaattttaaaactattttataactttaataatggtgtcatctatggctttaaaaattttaagcttaaaatataatttgtataaagagaaacaaataaggaaaatgtaattaaccagtaaagtgaacttagctagggggtaaaatgagtcgaaaaatagtttagatgattgattcaataaaatagtttacgggagtaaattggaccatatctacagcaagagcaacccaattaaaggaaagctaattatcaatttgtaacatacaaaatacaagttaaatttaagtatttaaatctattttggaaagttaattttgtttccatcgtaatactaaaaccaaaatagcaataatccaaatgaaattcaaaaaacccaactatgaaaataagttgtcgtgcaaataagtcattattaaattcgatagtggtgtcattggagtgtttaaatcaatattaaaaataaaatatcaaaacccaatttctagcggcgcattttgcactcacagttgcaatctcgtaattcaaatcaaatcttggctgttgcatttgcagtttatcccctttctttctctctatctaaattccctctttattactcacaaaaattcaaagcacactgttcattgccatctaggtgttcgacccgggactagcccaaaccgagcagcccagcagctggctgtgcgtggcgtggggtgtcgatcaccacctgcgggtgcgattctgccgcgccgccattgaagatgccagaggcggtaacgaagatcttgttcacggagtctaggatctccatgccaccgaggaggagaagcgcagcggccacgccagagccccgacatatcgttgagcacttggtcggcgccggccgcacattctaattaagctgtatcgcaatcgcatcttctcggtgatcccttgcgcgccttgagcttcatctcaaccagtagatgtttttgcctactcaattagaaaaagtagccgtgccggccggagcttttccgctccggccggcgaggagttcacggtggatatggctcgtctttcatcaggccctccaattcccctagatgtttgtggcataatttggctagtaattagttttatatggaaatgccaaattatttgtgatagctggaacaatcgtcattttgagggaccaaattaagtttgtgcgtgtaggaatttgtgatccaccgaggaaaggaaattagttgggatgaggctgccgtgtttaatttgatatatatggtgatgtgttgatcagttgagtctttttttttttttggtttgtgttggtgctgatcacttatatggtgagatgcagctcatgtgagtattgcgtagatttgttgcgagtgcatgtatggtagccagggtttaccttttgaagtgaaaaccgcttcccaccggtttactgaaaactgaacaaaataaaaaaaggtaaaccgacaactttcggtaaatattgtacaaatattgctttcccaaaccaacaaccatatcggtttaggagaatagctaatatggtccctaaagtttcactcctgagtcattttagtccttaatctttcatattgtccaaacaagtcctttaaatttgtcatgtgggctaatatagtccttggtcccaccaaaatcgccacatggacatgccatgtcacctttctatgcaaaatctatatgatttgtccaattcatccttacacataggaaaaggagaaaaaaggaataagttaaaaaaatatatggtatatgtaagagcaaaaatatacctcaaaagggtgataaaaagaagtatttttttcctatggttatgtctaattcacccttatatttatttttctatgatatacgtaagggtaaattggtcaattcatcatagattttgcatgaatgatgacatggcatatccatatgatgatttttgatggacccaaggactattctagaccttatgataaaggttaaggatttctttggaccatttaaaaggttagggactaaactgatcctacagagaaactttagtgactaaagtagctattctccctatcggtttcattaaaaccaataggttttgtgaactctgatggtagctcgtgagagtctattctttctcatggttaagctctagcaaccctagagttaagttgatctttgtcgttttatgttgaaaaacaaggaggttatcctttactagtttgctcaaaagctagtggtcatttaaatacgaatatggttctcttctgatttactcgtaaattagttttgtgattccacgaaagtgaattaaccttaaaattgactccactaactagttttgatcttttaattttggcaactctattgtttttactgcgaatcgttattaggtgagtctgtgttgaccatcataaaacatcaacatcagacaccgtagatgctcgcacgtggtccaatttggccgccactccttgcttcgccatagactgcaagtcgcaagacgaggtaagaccataaacatatgatcgatgtatagatattgtaatctaagttgctaaggtatcatttccgtatccaactagatagcgagaggagtggagaattaaggttacaatttgtacgacatatggactaattcatccccatcaagaactgatggtgacatagctggaagagatccatgcaagcatgtcaactgcgacttgtacatataaaaaccctgttatctagaaaaaaaagggggaaattttgtttgataacaccgaagcattacgcattttaggtgtaacggcaacttttcgacggtatatttaatttctaaacacataatcttttggtgtcactaaaccaattatcccttggaaagttagaataatcatccacacttaccagcaacctgcacggctccacaaactgatctaaacgtgatctgaaaaagtagctagtcaaagatcatagtgagaagtgaggacaggagaatttaataagttcgaagactttttattgttactaattcgttgtaagttataactagcgaaatgtaaattctatgcttctttggccatccaaaatcgcttatgaatagcagagttaaggacaacgattctctgtaattattaagatccattctctctagactatagcaaaaaaggcaccctataattaaacttcactggattaaatgaacgtgttcacaaacatgcaaacgcagtgatcaactccaaacatcctagtatatagcactatatttcaccattacaaattacaaggagcaatacttttatcatcatgacacatagttcagacttcagaataaataagttccgctatttgctctgattcacatttacatatagtcacataagcacgaatagcatatagtattgtcacttcaaaccaagatcacctgcatctattcaactttgcattcaccttccctcatgctcatggctaactccggtgattgttggtgattgagtgagaggatcaatctctttctgcctgctgagcttaggggtagttgatcctgagtggctggtaacatagctggtattcccacccctgaactgccactcggtgatgtagttcggcttcgtcactacctctgccacctcaacatctccagttagcattgccacaacctttgacattggtggtcgctgatagggtgagccctgtgtgcagatgagtgcgacatggatgactctatacacttcatccctgctgaattcctcaagtcttgggtcaacaatcccgagtgcttgctccttttcatacaagctccaagcctgtaaattaacataggcaaatctttataactagaagataatatgaatga

SEQ ID NO: 15546 - DNA, 10278 bp, Oryza sativa
  unsure (1)..(10278): unsure at all n locations
gaatgcgaaaacatcaaccttttcagtcaaatgtcgtctcatcgcatactcaggagccagataaccacttgacaaaaggttagataagtttaagttagctttgtttgtaaggtacaaatataagagaaatggtgaaatgttcttacaatgtgcccgcaattcctgtactaacatgagtcttcttctcatcataaagcttggcgagtccaaagtcagagatctttggggtgaggtctgtgtcaagtaggacattgctagctttgatgtccctatgaacaatgcgcacgctcgactcctcatgaagataagttaggcctcttgcaattcctaaaatgatctcgaagcgtgttgcccagtccagttttatgctaccgtttcctgtaaaaaaataactttaaggctctgtgaactaaatgatggcaaaatgaagagatgagttctcccaaagagcatgtgaagaaaaatacaattttgtaggtgttggttttgagcaaaagtgaactcaccaaataatgctttatccaagcttccattcttaagatactcataaactaataaaggtgtgttactatcaatgcagcaaccatgcaattttacaagattccgatgttgcacagcagaaatagttgcaacctctgtcacaaactgacttttgccctgatgggatgattgggaaagttgttttacagctataactcttccatcaggtagcacaccctaccagaagaacattgctaaagttatatgtatatttcgaagcatagaccaacaagtttgcaataaagttaaatttaaaaacaaatcaattgaaattgcatagtactaaattagtggaaatagacaaccttatagactggaccatatccaccttccccaagaatgttttgagaactgaaattgtctgtagctaacttgagttcagcattactgaagacatcaggctgtccaactaggttgtataattctacatttatttttcagggcacaccagaaacaataaatcgtattaaaattttgatgtctgaattattgtattattaaaaactattaccttcttgctgttttgccattcttcttctcttctttatgaccataaatattccgaataagatagctgatcctaaaaccgaggcagcaatcacaatcccaacaattgcacctgctttacttttctttttgggtacaccgtttcgcacagtaggactaaaatctgaaagaggatttcatttattggaatccaatgcaatcatttttatgttaacttaattattacgcttacttggagtgatgcttaatgctgagatcaatggtccgtagtaaccttgaataggaatacaacaagtgccctttccagcccagaatagatggatttcaagaaagttttttgacacagttgttgtgtaactcttgtaaacagcagtgaaagattttccaccagccatctttcttatattgaagtccttttcttttagttcaccctgtagaaatgtcaataatacattgatataaataagaaaaagattcagtaaacaaattactatataatggactcaatttatacctggatatatatgtcaaaaaatctccttcctaagctttgccaagttggcgtgtctggaaaacctaactctgcaaatttaagcagaacggtgtaatttccattctcaagtccaaggccatagtatctcagagacgacggcgacatccttgcagtttggaatagttctgaatccactgcattctggatcttctcaccactatgtattatcttactgtcatttggggcctggaataattttcctacattactaacgccccatcttgtttgacttgtaacataatatgatgagtccccaaggtttgtggaatccaattcgtacatagtattatccgaaactctgatagatctattactaccacagtctaccgcaaaggaataatctgcagtcatgacgtgcaaaattataatagtattagaatttcaagacccaatatatcagctgctatggttgaggaaaagtgagacatatacattttggagaaccacgaaaacatggagtatcttcctggaggcagtttagccctggaggtagcatgctgtggagatagttgactcgaaattaaaagtggtgagagagaaattagtaaaaacttatgaatgtacaaataaatgccataagtacccaatgttggtgctgccaagaataaagttgtttgccaccaaattccttgtaaaaaataaaaggttgagtataacatattttttcccttggaaacacaaatttgagaactttcttcttacaattgcagattgttctgggtaacccaggagggaaagctaccagtgagctggttgtatgagaaatctctgcaaacatgaaataaatgcatcattctaattttagctgtattacagggatgaattgtttactcacaagttcgttagcgaagggcttatcccatctggcaattctcctgttaggctgttgttgccaagaaacctgagttggaaagaagacaagatgatgaaacgtggtcatcaattataacatgtgtttcagtagatagtaataacccccagaaagaattccttacaggaatataagcttttgtagattcagaattgatttaggaacattccctgagatattgttaaaactcaagtccctgcgccagaagacagcatacttgaacagacacttacatgaaatttaagaaaaattaccaaaagtttcatggactgtgctatgacccataatgaaaaacgtacaggaaagttaagtttgcgaacttcgaaaaatctactgctccaaggtctccagatatcttgcagttcctcagtacgctgtaaaaaaatatttggtattaacaacttatatctttgtcaatatataaaattgtaagatgtatagttagaatttaaaagtgtcacatacagggtatccagagatgtcagactgctgataaaggccaatgaagagctcccatttacaatatcaccaatccgcctgctcatttgtgtttagtacaccagttatcgtgacaagaggggatgacaatgttgccactgaacgaagtacttacaaggttgtcaatttggttagattagacaaacttgctgggatcggtccttcaaaagaattaccttggaaagccctgtgagttcataatttaagaaagacaaaagttgggagatttaaggtccattagaatataggaaaaagtaacatctacatatcaagacactgttgaggtatgcgcatttcttaaaagtgatgaccaaacagaaaaaaaaatgctacagtttgaattaaaatagatagaacatttgcagaaaatttctgttgcaattccacttgtcttgtggtaaggataaaatcaatgatgtgttaaaaagctaataataaatcttacagatcttccaaattagacaagctcccaataaaatcaggtattgttccagtaaaattgttatctgatgcccgcctacaagcataaaaacatgtttagtgttgagcatataaaaacaaaatgaacatgaccactgtggttctgtttcttgaacttacaggagttttaggttcttaagccttgagagcgtagaagggaatgggccactcaacccagcactatcagtatacctgttattaaaacaatgcagaaatcattgatgtttaactgtaagtatcttgctggtccaaattaaactttgttcttctagaagtagcatctttcaagttagaaagagggggattacaaacttacaattgtcgaagtttggtcaagttgcccaattcttcaggaagttgaccagaaaaattggtcaaactaatgcctctgaaacaaaatgaaatatttcaggagtgatataatttagaaacttacaaatatttaagtttgctcaagttgcccaattcttcagggagttcacccgtaaaattggtcagactaatgcctctgaaaaaaaaaaaagctcaagagtgatataatttccgtgcatgcaatgctactagttgagaaaagtagcattgtatgtgctgacgagccttttgatccacaatattcacattttggatttcacacaaatttataagacaccatttgaaaagtaaaattacactggtgcttaaattttatttgtgattttctagaaatttgtagaaagaacttatgcatctagatttttccatataatgaaatactttagaccattattaatctgtgcaagaagggaacacttacagcaaattgaggttcgtgagatttccaagttcctttggaagtgatcctgagagtggattgaatcccacgtgccttttttttattacaaaaggaagaaggatgattcaaacaaaacactaactaataaggacaatgcaggaaaacttaaagtacaactcttacaattctgtcaaggcagtcaattgcccaatgaatgatggtatggggcctgacaagtaattttgatccaggttcctgaaaagaacaagaaacatcaagtcaattagcagcgatgaatttcaaacatgaggttcactttgaattgatgtcttgctgcaagatattaagaatatgtagtatatatccaacagtagttcatcatcaaggcagagccgagaaaagctagataccatacaagtaagttaggtaggtgaggttctgcaattctgcaggtatctgaccgacaacgttcaatgcgtataccctcctgaataaataaacaaaaaaagaaaattattcacatgagaaaaatactccattcatcccaaaatatagcatctagatttcaaattttattctaatatagtagcaatttagtacttattttaccattgaactacccataataacccttggtttaattatcatcatgcccatgcctcatctccccaaggcaaatcaacaagtccttttacctgtctccttaatggctgtgataagagctaatttctagagaacttttacggtacaatatactaccagtatatactggcagtatataaaagggcatattaggaatttgatagaaaataaaacaacactttagtaatttttggtttaaattgaatctaattgagagtacccggtcctggatcttatcgtgcactaggggaggagcatcctgagcgccatttgatgacaaagcacgtgacgatagcacgatttgattatagaataaccaagaaaagacaaaattaccctttcaaactttatattgcaatctaattaaataaaaaattaaatcaatctacaccattagatcatatatactttttactatttagtccaatatatgagctaactcttgaccaggcacacatagacagccctggtcccccacagaaaaatgggaaaaatacacacacacatcccaacaatattgtttggtcacagaaaatctgcttgggagttgggtctaatttctactatggttgcgcaccatgcgtagaattacaaaattgacgattgattagtttgatctctccagggctgcctggacttactcaaccggatcccagccagatccaactataatggaaggcagatggcagctgtggaaggttaagaactaaagatcttgcaggaagctgaacctcagattccagtacttggaccagtgaccaaagagcagtattaacaaaaaccgatcggtttttttaaactgcccgtggtcagtcatttgtggaagccaaacggttttagctggttttcgtatggcgttgaccaaaagtcatccgtttttgccgggtttcagcttgtgatgatcggttttcaatttaaaataaaatggtaaaccctgccaaagagatcagatttttctggccatgaagcggggtggggtgttgaaataacctggtttcccgattggaggagtaaaaataaaatacaagtcatcatgctttactcctaaatgaaattcggacccacaacagaatttcgggggacataaatgaggctcctctattcctaagtagtgaaactgaaacctgtggtcctatgcatatgctcaatggtgtggtcttgcaaaagttgcaatttcttttctttttctttttttttgcgaggatcaaaagttgcaatttcaagttaagtttccattagaacttatatatccagacgccaatggcctcctgttcccgtaggcactgcgtcgagcacctggtgtgcgtgcagatgaacagagccaaggaagcaggatgggagcgtatacgtacagctgggtaatatggcagacggtgccgctgttgtaggaacagtcgcacttgatgccggggttgttcttggggttgccgtcgaggtcggtgctgccgtcgacggggacgccgcggcatggctcgccgctcatcctccacagcggggacgtcgtcttgccccatctccccaggatcgcctccagcgccgccactgcaccgaatgtatagtaccagagtaataataagtgcaataattaagcttcgcattgcattgatatcaagactaattacgtgtatatatatatatatagcagcatgatttgattacgtgctttgattataccttcgattggatcagttgttgccgcttgctgggcatgaacagcggcgatcagccatgaggagcacatcacgagcaacacccacaccagcttaccactaacaccacccatctctctctctctttctgctgccgaaacaacacggaagcttgttaaatatatagatggtgtgtttgtacgatgcaactatatgcaaagggaggctctgtattttagggcgctcatacgtactctctacgtctcataaaacaccaatctaaaataggacgagacataatttagtacaacgaatttggatactctctctgtctgaaaataattacagccctatagttcaacacttattttggaacgtagtgagtaaaaatatgtccaaattcgttgaattagattatgtatcatctcattataagttggattttttggacggagtgagtagatgagataatccaaatagttcttatcatcactaccttattactaggaaaaatgtctatatttgacgctctttcggattcgtagtactcaaattgtctaattagctattaggtttgctatattttagaatggatatagtatttgtcatcacttcttaataagaattttattaagcagatgaaaatatttgactataacaatgtgagtatctaagcatcaaaacattgtaaactacaaggtcacaaatatgcgcaaaagcctgcttacggtttatatttatagtgtgaaattgaatatgatttgtgaaaaaaaatgaaactttcttatcattatattttataacagtgtttattatcctataactaaaagaaaatcaacggtagaaaatatgaacaggcctataaaaattagccatggagcatctctagcaaactaccaatagtcactactatatagtcacgttgttataatccataggtatctgtttcggtgccaacagctattattcaacaccaataacttggatcattggacatatgtgacaatataggtgctaggggtgcaccccttatattagtgctaaaaacccgaaaaaaataatatttttattagggacctatatggtcatatttaacttctcacgagtcacatgactttttcaacccatattcatgggcatgcttcaagcaatatttgaactcaacccacctctctccttttaagcctccttatcatctaacctacaaacgcttataatctataattaacaccatagataagtcttgttgagatctacaaatttgatataaaatttatgttcatccgattttatatgaaaaagttagataaaaaacacacatatacgagttgtgtcatcgtgccagttttaaacgtaaactagcacctatgggcttataagtgccctttttttaattaagaattggcacatgtgtgatgcctatatatatgtcggtttatgataaataaaaacctatacctataacattgcacttatagatgctaatttattataagaactcgcacctataacttgggggaatattggtgtcggtttttattacaaactggtataaatgagtggttataggtaaaagatggaaaaagcttcataggtgatatggttttaggcaaaccgataagacaggtctctatgtgatgttttgtagtggtgaatgctatcctataagttgttcacggggaacaaatagttttttttaatgaactatttctttggtctgaaaataaatttatctttgcttttcttgtttgtcctaagtaagttcattttgagctatcattgcattggactttgtaaaagaagtggacaaatacattgtaatagataaagtgggaacaattacattaggattcggtaagttggaggatgttattttgctttattattggtatgtgtggatgtgtgaaaaatgagcttattatggaaggaaggtagtatttagtttcgaatgggggcactactttaaatgactacgaagaaataatctgtcttagtgttttctttatttctttttttttcccatgcatgacagttgacgtggggtgggtggacagcgatcaagtcccttataaacgaaagaacaataattcatactctctgtcaaaaggacttgatttctagccatcccaaatttagtaataagaagttaagagcaatgagtttctcgttaacactatagtagtattgctaggtgggtatataggcaaggtgtattaaagggataagagtcctttgaaactcttcgttttgtgaaaaaatggtaggcaagagactagaaatcatctcgacacattagaaatcaactccttttgagatacttttaaatatctttagtctagattactggtaccaaccagtactaaaaattaaattttagtttggattagtcttactaaccagagctaaagatcatcaagcattagtatcggctggtgttaccaaccgatactaaagatgtactcttagtaccggttggtaacaccaaccgagactaaaaatatttccaaagacacttttagaactagtactaatctaactaagatattggtggttttgtgtaccacgacgaaagattagttctccaatagtgtcggaaaatcaaaaaagaggcaacgtgacctttggacatgacctgatccaaagaatcaattgaaaatatatactagtacgatggtgccacatgcatgtgccggaaatatgaataagcacttgtcattaaaatacgttgacaccaattactttgtgaaaagactacatttatttttgaagaaattaatggaatccatttagtaccaaattgcccaattggcatgactgccaccgcacctactggcactgctatcatactatagcttagctactgcattcctgcaactgatcagaggagttaaactactgttaactaatcagttccctgttgtcacgaaggtataccctccctcgcatccgatccatgcattgtgtccatatatactagtaaaatatttaccaatacttctgtagtacaaccgatgatatttaattgggtaaacattaaagtaaaacctagggctaatcaaacataatatgtatacggcatgtctgcatgaaagacaggggttttctctgtcctcaattactgatcccgcatgattttttttcccgggtcagcagaaggaaaaagatggaccaaatttcattaagatttatagaagctttttacatgagtatggtcctataacattaatctgccgagttgagagtggctcaacactctcaaaacatgtaaacgaaagacaagaaaaacaaaggtaaaggtactcctctcaggattgaaaaatttcgacggacttccaaatagagatttcttcgttcgcatcactgaccagctgctccggccttttgaacctgtgttcaaacactcttctgtttcgctcttttcagaggagccaacacaccatcaagaagagtgaatcgaacgccatcttgtagcttgtccgaaaatggcgacgctcctgctgccaccaatctgcgagcagccagtcgccatggcccggagacggaagtccaccctaatccagtcccgaagcaaagaccaaaccctatattggtgtaggcacattggtgaactgcaggttgttgcagtcctcgaagatggcgttacagagggcgcaaagctgtttcgtgtggccacttaaattcagatttttacaataccattttaaattttgaagtataaaccggtnnnnnnnnnnnnnnnnnnnnnnnnnnnnnnnnnnnnnnnnnn

SEQ ID NO: 15547 - DNA, 7228 bp, Oryza sativa
  unsure (1)..(7228): unsure at all n locations
nnnnnnnnnnnnnnnnnnnnnnnnnnnnnnnnnnnnnnnnnnnnnnnnnnnnnnaaagacaagaaaaacaaaggtaaaggtactcctctcaggattgaaaaatttcgacggacttccaaatagagatttcttcgttcgcatcactgaccagctgctccggccttttgaacctgtgttcaaacactcttctgtttcgctcttttcagaggagccaacacaccatcaagaagagtgaatcgaacgccatcttgtagcttgtccgaaaatggcgacgctcctgctgccaccaatctgcgagcagccagtcgccatggcccggagacggaagtccaccctaatccagtcccgaagcaaagaccaaaccctatattggtgtaggcacattggtgaactgcaggttgttgcagtcctcgaagatggcgttacagagggcgcaaagctgtttcgtgtggccacttaaattcagatttttacaataccattttaaattttgaagtataaaccggtccctgtaggttttccaaaaactagcaaaaagttgatatatgatttttgatcagttctgtataaaagccaggtaaaactgctcggattcagaaaccggtgtccaacgttttcatgaaaaccaataaaatttcatatagttttcgatcagcattgcaaaccttgcataatttcatctctactcgggacatccatgtgtccaggccggtaatctatctagctaggtcaggggccgggaggagctcgtctacgcccgtcattttcccaactactccctccatccaaataaacaaacttatgattagacgtgactaatataataaatatggatagattcttagctatccagattcatggtaataggatatgtcagtcacattaattttagagcaattctacggtccttgagtaggtaccatgaggtaccaaaattttagtgtaaaatttggtaccacctcatagtacctaggtaccacgaggtaccaaatttacaatagaaaaaatggtacctcatggtatctcctcaaggtccgtaaaattgatcttaattttaggttatttttttaagatgaatggagtatgttaaacataaaggtaattagcatgttaccatcatgggggcactgcacgctggtactacgacacttgagctagctagtactcccatcgacgacctgagggttgacgcgaggtgtgcatgcatgtgtcatgctatcaaattaattaacaaagcgacactacatacggcgtacggctatgtttggccgcgtaacgggagtggttagttgcaggggagaggctctctctggctgtgttttgcatagcataactatactttctttatgattgataaacactaacaaatattagaagctaatggctaacatgtaaatcgatcagctttacatatcatcattcattaataattagtccgtactattttagagcattttaaatcttatgcaatatacgtagagcttaatatataagtatgtcaaatcatttttctcacatcattttcacaatgtttcaaattttatcatttctataatatttaacatatattcatccataaatttcgcagcaaattaccacggggtgtcacgtagtaaatatatagatattactctgcccgtgctttttcacctgtcaaaatgcacatatttttatcgatagctactaatattttgcacaaatatatttcttattatatatttgtaaaaatgtattggaaatattaattatatgagtgcattttcataaaaaatgtactgatattattttaacgtatcaaatcttaatttatcttttaatttatgtctgatttaggattttttttatttcttgatcgtactcatctactctaaagattgtatctatttgtcgacgcaatgagtatgtatgaatattatttatacatattggtcgttggttcatatatatattaaaattttatcagaatttatacacagcattaaaagtttatcagaaattacgtgtaaaggtcgtatttggtactcgaaattactgtgcaaggaaaaatgtactttctttttagataataaggcaaaatgtacttttaatcatcctgtataaaaaccagataaaccactcggttttcgtaaaccagtctccagctctttcatatagctttcatgtattaaaaccaattgattttcatatagttttcagatctcctttcagttggcagttcatgatcacgtacacaacgatccattttgaaattaattagtaccaccaagtggcaggccagttgttaattaagcttgagtactatctctattccaaattaattgtttatttacgttaattcaaactttatgttgaaataattgatcataaagaagtattacttgtcccatcaatcacttataattcaaaatttcacttctctgtgtacactcagccatcattccacattgaactatacatcacataataaaaggtactataatcttttttctaaaaccttagcctatgccaaataacccagaacgataattaatatgggactgagagagtaacatatgtagcagaaaccaatagctccccagcgatcgatgtagaatgtaatatatacgtacgtgtactgcggccactctgttgaaatggaatggttttgctaggctgctagctagtactctctctgtttataaataatgcatgatgcattgtacttttagatattggtgttttatttacattttagtacagctattaaaaatattagtcaaggttaaaatatctttaataataaaacaaatccaaacaaaataaatactacgcaaatagtttttaaataaaacaaatgctcgaatgtaaaagtcaataacaatgtactaactccttttcaaaatgtataacacggttgattttcctaataacatttgatcattcgtcttattaaaaatttaatataaatatgtaaaagtataagttaaaattatattttatttgatgttttagtgacaaaaataatatttatataataatcaaacattacgtgaagagttaaccgcgtcatatattttaaaatagtgggtgtgcattttgaaattgagatagtgcatgtaagcatgaccgggcgggcgggccctgtacactgggacgatgacttgacctagttgaatcagatggacgacttgacccatagttgtagaatgcacacgtgtaacaaagtagtgctctcttcgttttaaaatataacaacttttagcctttaaaattatatctcaaaatataacaacttttttgtcaacattttcttcctaatgaatcacaactctccattatttgattttctcacctactttcacttcttatccaatcatatattttttctctatttaattctatctattttcttaataaacgtatcacacactaaaaatccttatattctgaggcaaaagtagtatcatattattgtttattaggtatacggctatatatgtttggccgcgtaatcggactggccgttggaagaaggctctctgtattttgcctagggatgatatatctgagaggaccgtaaaattgctccacatctgggcttgatggattactctatcccttctttcttcgcttgtcagtaacttactaccggttcttagcagcaaaattcaaatctaactatagatttatatttttataagtaatcaaaacattcgattcaaaacttttgctaatatagcttaacatagatttaatttgtcaaacctatatagatttgtctctttgtttgcttgatgtcgcatcgtgtacgtatagatcctcgtatcaacgtactctaatacccatactttccggtctacgagtatccctcgtcgacagacagcattgacgccaatatgccactagctagccatgaccactgaattataatactagcacgtatatagccggccgattgttaagctcgacctagctagcatgcagaagctgcatccacaacatagctacctcgtactaccatgagacacaaacaagttggccatgtgcacgcgtactgcagctagcgacactctttgttgaaatggaagggttgctaggcttcatgtaagcatcgtgagcagtgagcaaacgcttggtcaatcaatgacgacgacgacatgagctactagttgaattaagccgatcgacgacttgaccccaggccggccagatgcatgcatttactgtcatactttgagaagagctgtaatcgcagcaataagtactgaaaggatggattaattagtttacagccccattggctgatatgaggaaaatgcgaaatagcatatttacagatgaaaaataatttatgaataaaacttttatatatgtgttcttaacgatctaaaagcaaaggctaaaaaataaactacgatgaaaaaaaatctcaaaatcaactctaaatttaagattgaaaatttaaattttgactgataagtataagcataagtgaaaagatgaggccgttagtcagttgagcagatatgcatatatttcaaaggaaacttcttcaagccgacgaacatggaggaagtatttaatgagaaattaggggaaatggattctactctttcgatgggatatgttcccttgcaatgatggagccaagatatattatcactttcagcttagggcttgatgatgtattcttaacaaattattttatctcttaagagttaacattttgatagattttaataggtgttaacaccaaaatttggacaacagggatgttgggtctaagagtagggcttaattaaatcctagctgcccccacacttgtctacacccctattgtctcatgtaacctgacaatgtagagtatagcgatatctagtattaattccaacaaaatcaatttcaaattcaacctacgcatttgacaaaaaaaaagacaaataccaatgaatagtaccactactatttatatgggaatttgttttttatatcataatttgtgagttgagttttctatatcatatatatatatatatgtgtgtgtgtgtgtctatatatatatatatatatattatgtaatttttaccggggttgtctaaaaaatcttaaggacaattctctcaaggaacccctaggaaacgggagtaatactacttaagagaaatcgtaaatttttcatgaaattagatatgacaaatggacctaaatattcaatacaagctctcaaatcttttgttttagaaaaacaaaattttgagtttttgaacgacctcggatggagacatgctttgtatcaaaattatagagctcgatgggtctataactttgtagttaaaatttcttttatttgagatcgttgatgccaaaatattcataacggtctctcgtatctatatgtttttgaagatattcagtaggaagtccaaactttgaaacataattttaaatccttatagtatctcctttaatgacttttggccaacattttcttagtatatttcctataattgcatgtctcacaaaatgcttcatatcacccatctaacgtgagccctatatccccaacgcttcacctaggaaggtcccaccgaacccttctctctcatctttacttgctcactagacaccaccaacccattcatttctccacaacagctccaatcttatctcatctctccctctctctctctctctctcccccttatctctctccactatctcatcacgagcagtgatgaggctctcgtcctcgacaacggtggcctcttactctcatcctcgatggcggcctctcacgctcgtcctcgacgacagcctcctcagcttactcaaaggtggctcggtcggcctcggcttcctcaacggcgatgcggcacaacatcagtagccacccgtcctcaatggcaacgggacgagcttggccttggcttctttaatggcccacgcagagcacaacacaactgcagtgaactagtgccaagtctagcgatgcccggtcaccgcagaggaggaagtagttgagactatttttttcccattttttcaatatttaagccaatatgttttaagtgttcctttgtattggatcaaaatgttgcagtgagtttttgtgttgtttcatattcttttccttttatgggtgagatctgtggatgtttcaataattgaaacttgatgtttcaaatgctacactaaaatgttccacgatgtgatccgattgtgtttcaccattttaatttattaaaatatatatgttttgtttgagagctgaaacattttcattcaagcaataaaacatttttcccgattgataaaacatctaaaacattttcaatgaataaacatttttcaacaatacaatgcaacaccgatgttttacaaaatatcaaatgtccgatttgtagcaatcccccatgtgtcgtgctatcaaattagcaaccaccgttacatgatggtggtaacatatgactttgtttggccgccgcgtaactggaattaattattgcaccttggaaaattcttatatatattagctatgtttcaccatggatacacatgcatccgggcgtgttgatcagttactccgtttgtgctttttttcagtgtcaatgcacatatatgtagtatcgatttgttctaataatatgtttgtaaaaaatatatatattggaaatatagttatacatagcttgtaaaaatttgattctgccatccgttaggatttatcaacattctttggaaactattctggaacatgtaacttttaccacatatgtttactccggcaaaattggatttctcacacactatttggaaagatcgataaagggttaactaattaatatttatatcaactagcttaatgcccgtgcattgcaacgggaattaaaaagggaaccaactgtacattgtaaagcctaaaaaattaaaaaaaaaatatttgcatcgtaaaataaattttcattgtttgatggcttagggttgtgagactgtttgagggacccacatggtagtggactagtggtggtgggtggtggcagattcaccaccatcaccattggaatattttaaaagagtatggagtatagatactccacatcttgaattttgaagtactacacaactttcttcagaagcagtgatccctcttttgccatagactgaagatctttgctgcaagaaagccattgcccctcgtaggactgaggtccatacaaccttataactgtcacttgattcatttgccatt

SEQ ID NO: 15548 - DNA, 3702 bp, Oryza sativa
  unsure (1)..(3702): unsure at all n locations
nnnnnnnnnnnnnnnnnnnnnnnnnnnnnnnnnnnnnnnnnnnnnnnnnnnnnnnnncttcctcactgtcaaactcatcgagttttgggtctacgattttgattccttgctctctttcatatagcccccaagcctagtataaattatcatacggacaacgtgttgattgtgagaaatagaatcagccaatgtattttcttggatgcaaagaccattgatcaacttacccattcaaagagatagatcttgtcattatcaagggaattgtcggtgtttgatcggccagcaactgtttctagagcaacaactccaaatgcgaaaacatcagccttttcagtcagatggcctctcattgcatactcgggtgccagatagccgcttcaaaaggtcagacgagataaaattagcttagacttcaaaggtaaactcataagaaaagaaagggtgaaatgtgcatacaatgtgccagcgattttcgtgctgatatgggtctccttttcatcatagagcttggcaagtccaaaatcggagatttgggggctcagatcagtgtcaagcaagacgttgctagctttgatatccctatgcacaatccgaatgctggactcctcatgaagataagttatgcctcttgcaatacctaaaatgatctcgaagcgtgttggccaatctaggttcaagctaccatgtcctgaacatggagaaataaggccttgagaattgagatgatggtataatgcagagaagaaaagttcttgacagtacatgaaaggaagaaggtcgcacaactgaacttaccaaagagtgcttggtctaggcttccgttttcgaggtactcataaaccaacaagggtgtgctgctgtcaatgcaacagccatacaatttcacaaggttcttgtgctgcacggctgaaattgttgcaacttctgtcacgaattcacttttcccctgatgagatgattgagaaagttgtttgacagctataattcttccatcaggtagcttaccctgtcaaagaaagatccctgagttacatacatattttgattttacaccagttgagttgcaaaacaattttagttagtacacaataaggtaaatcctcatagattgattgacgacttgtgggaaccactaaccttatatactggcccatatccgccttctccaatcacgttttgagaactgaaattgtctgtagctaatttcagttctgcgctactgaagatattaggccttccaaccaggttgtatagttctgcattttttttcacaacacatgagaaagaataactcatttgaaaattttggcacctaaagagctgcacttaaatgataccttcttgctgccttgccgcttttcttctcttctttaccaaaacaaagatcccaagtaaggctgctgatcctataactgacgcaccaatcactatcccagcaattacaccagctttacttttcttttttggaactccatttctcacagtaggagtaaaatctggacaacgtgtttcagtaatcagaaaaaaaaaactatcatacattcttcaagttaactaattcgggtactgagcttacttggagtgatacttagtgcagagatcatgggtccatagtaaccttgagtaggaatgcaacaagtgcctttgccagcccagaacagatgtatctcaaggaagttttttgacacagttgcgttgtatcttttgttaactgcaataaaagattttccgccagctgttttccttacatcgaagttcttttctttcagatcaccctatgcagatgccaagttggacaaacaaatatgttaataaagggtacaaaataggtaattgaattattgtactatgcgctcaatatgtacctggacatatatgtcaaaaactctccttccgatgctttgccaagtctttgtgtctggataagcaaactctgcaaattgaagaagaacagtgtaatttccattctcaagccctaggccatagtatctcagggacgatggtgacattctggcagtctggaacaattctgaatccaacgcattttgaaattgttgcgagctgtacattaggtaacttccatttggggcctcattgaattttcctacattgctgataccccatcgtgtttgccccgtaacatagtatgatgcagctccgagacttgtagcatcagcttcgtacacagtattatccaaacctctcacagatctattactaccagagtctactgcaaaggaatagtctgcatgcagttaagatgaacaaaattataaccttttattgaaaatcctgagatattttcttaaatgctaaaatcgatgaagagtgcaaaaatatacattccggagaaccgaggaaacaaggagtgtcttgctgtaggcagtttagtcctgaaggtagaatactgtgcgcataacagaaacaagaaataaaaattatgaggaaggtgacgtcaaaaataaatatttgcaaatatgttataggtacctatcgttgttgcttcgaatattaaatttgtttgccaccaaattccttgtacaaaaaaatacgtctaacttgtcaggcaataatttcacataatgtagagagtgtctaaatcaatatatatttgtctgaaatttcagaactttcaacttacagttgtaaattattattggtagcccatgaaggaaagtttcccatgagttggttgtacgaaaaatctctgcaaaaagcctaggattacgaacgtatgaaatgaatatatcattgcaatgctgaaaatcattttagcatacaaattatttagtgaggagctcttcacatctggcaggcttcctgtaaggctattgttcccaagaaacctgaattgagtttccattcaagacgatgaggcatggacattagcttaagatgtatttctataacagaaataatcgccataaaagaattccttacaaatatcgaaggctgttcagattaaggatggactgaggaacttcgcccgtgatattgttaaaactcaagtccctgtgccatatgtttagcaatattacttgagtaaacacttcacatgaaactatgagaaacaataactaataacataaatagtcagtatgccataaagacaaaacctacagcaagtttaatcgagaaagcttagtaaaatttactgctccaagattatcggatatcttgcagttcctcaatattctgaaacaaagaatatgttgtctcagaaaatactactccaatagtactttgcaataaaaaaaacaataatatctatcgttagaacttaaaagcaggacacatacaggacatttaaggacgtcaggttgctaataaaggccaatgaagagctcccatttacaatatcaccaatccgtctgcatatgtgtatttggcactattaagacaagtttggccttcccaacagtcaagggacaaatgtggccaaagaacagaatacttacaagcttgtcaacttggttaacttagaaaaacttgctgggatcggaccttgaaaagaatttccttgcaacctcctacaagttcatgctttaagaaattaggaagatgtaaagtccaccttaagatatacattttaacatcttgcatgaatagataaagaaaatgtaaatttattcataacgtagcatttatgtcgaannnnnnnnnnnnnnnnnnnnnnnnnnnnnnnnnnnnnnnnnnnnn

SEQ ID NO: 15549 - DNA, 5981 bp, Oryza sativa
  unsure (1)..(5981): unsure at all n locations
aaaaaaacaataatatctatcgttagaacttaaaagcaggacacatacaggacatttaaggacgtcaggttgctaataaaggccaatgaagagctcccatttacaatatcaccaatccgtctgcatatgtgtatttggcactattaagacaagtttggccttcccaacagtcaagggacaaatgtggccaaagaacagaatacttacaagcttgtcaacttggttaacttagaaaaacttgctgggatcggaccttgaaaagaatttccttgcaacctcctacaagttcatgctttaagaaattaggaagatgtaaagtccaccttaagatatacattttaacatcttgcatgaatagataaagaaaatgtaaatttattcataacgtagcatttatgtcgaagttgaggactaaaaaatgaataacgttgttctcttaattcaaatgaaaagaatacatacagaaaagttatgttgcaagatttctattcatctccttgataggatataataaatgattatgttaagaggttgacaaaaatcttacaaatcctccaagttagtcaagctcccaataaaatcaggtattttccctgtgaaatcattatctgatatccacctgcaagcacaacaacatatatagcattgagtgtatgaagacacaataaacataataactgtggctcagttcttgaatgtacaggatcttcagcttcttaagttttgaaattgtcgaagggaatggaccagagaagccagaactatcaatatacctgttattgaaacatagtaattagcatgttcaacaatatagatcttgcttgtcagttctttctgaagtagtgttctactggttaattaaaggggggaggggggagatttacatttgctcgagtttggtcaagttgcccaattcttcaggaaggtttccagtaaaattgttcaggctgatacctctgaaacaaaaggaaatagttgagtaacataacttatttgtctgcaacagtgttgatccataatatccaccacttttgagacttcgttgtttgggtttcagtatattaaacacactaggaaaggaaaatgaaattgaaatgattaagtaacatgagaaatcgtggaagggatatcttacaatgagatgagatttgtgaggttcccaagttcctttggaagtggtccagataatggattgattgctaagctcctttttaaaataaaacaagaaagaaagaaagaaagatgattaagagaaagcaccagcagatattggatggtacaaaaatatataacttggaatttaactcttacaagtactgcatgggaaatttgccaaagaatgatggcacaggaccagtcaagtaattttgcatcaggtttctgaaacaacataagaatcgccaagcaagttagacagagtacaaaaaggaattgtatacctgatttctgatatctatttatccgtgttttgtctggcaagtgacaattgaatgttcaaagaatgggactgaattagtatttactgcagaaacatcgttcaacagattgtgttcgatcatcaaatgttaagacagacatgtgttccgtcatcaagacagaggcataaagagttaggcaccatacaagttagctagatgggtgagtttctccagctctgcaggtatctgaccgacaacattcagcgcgtacaccctcctgcataaacatcatcagtaaaattcctctgatgacaagtaaaaaaaaaaactatatatgctttgctaaatgaattaggtgatagttatccaaattcaattcatcgtcacttgatcccagagcattcctgcaaccaccagcatcctaattttggaggatcgcatggcctctctctttcagtcaggcaatgcgtcgaacaccttgcctgcagctgagacaagaggtttgagttcaggggaggatacgtacagcttgacgatgcggcagacggtgttgttgttgaatgtgcagtcgcacttgatgccggggttgacgatggggttgttgtcgatgtcggtgtcgtcgacggcggtgccggtgcaggggtcgccgccggtgatgttccacgttttgggcggcttcgttccccatcgccccagaatcgtgttcagcgccgccactgcgttgacatttgcacacgaatccaatcaatttttttaccttttattctctccgttttatattataagtcgttttgatttttttacaactttaactaaatttataaaaaaaacatattagtttttttaaaaaaaaaacttattatcgaaatatattcgatcttagatttaatgaaactaatttattatttttaatgtttctattttttctgtaaatttgatcaaacaagtttatctacgaaaaaggtcaatttttaatgtttctatttttttctgtaaatttgaccaaacaagtttgtgtagaaaaaaagtgaaaagactttaatttgaaaggaaggaagtatgtgtgaagagaaaactagcaaaaaaacagaggcgagaaaacaacgtcagaaagagagaaaaaattgactttttaacggtcaccaaccacaccaaacagaactcctctcctccattagtcaacaaaacagatacagcatgaagaagcaaagatttggatggtgtatcaaacttgaacttgatcactgaacttggaaaacagaagatgtctgatgctgttcatcgccgtaatgatgaaattcttgctctgaactttttcttttactgttcatcacaaaaacgtgggtgttctgacctttggtcttctcttcaatttaaaaaaaaaaaacagtaaacggccaagaaaggaacgaattaataatatccgaggaatccgaggattaactctcactgctaactgctaatttgtctctaagctgttgcaatttgcaagttgcgtcaattatatccatgctaaatgctacacatcaactcatcaaacatgtagtaagtttcatgtctctctaaagtcgcaaggaaaaggaaagaagatccaggcccatctctgaacctccaagaattagagacccctaaatattacagtttcaactgtaatctgttgcaagttgcatcaactgtacccatggtagatgctactacaaacaaggaagcatcatcaagcatgtagtagtcataactcataagccatgtctctctgaactccgaagtctcaaagaaaatggaaagaagagaggaacatgcttgtgtgcaaccatgaaaatctatgtcttttctccaagaacatctctccagcagaaaagaacagcggtgtctctgtaatctgtgaatgcatgtaattaactgataaatacatatatacataccttcgactggatcagttgttgctcctgccggcttctgagcctgagctcgagctactgcaacccatgagcacgcgatcaccagccagcacaggatgagctgatgaccaccatggccgccgctgctgctgctgctgcagcgtatcctcatcatctctttgcctctctgtgtctctgtgtcacgttatctcgctctgatcactctgtcagcctgtctgtctgtctgtctctctgctgcctaaaaatcgattcttgtgacaggtatatatgtacaaattaatgtacttttatcagcgtgtgttcctgggtttaatttagtgatcgatcacatccaccatcatcatatacatatcgatcgggaaggacgacgacggggtcgtccgatattttttttccaagaggcgaccttctgtggttatatcaatcggctacttgcaacccatcgttgtggctagtactgttgcactggactctaaaatgtacaccccggaagaatgacgaggtcatcgtccaatctctctcaaggacttgtgcatggctgggtgggtgccaatctcggtcctaaggctcagccactcaaccttgctgggacacagggccgtcccgtgaaattccggggccctgtacatatactctctccgtttcacaatgtaagtcattctagtatttcccacattcatattgatgttaatgaatctagatagatatgaatgtgggaaatgctagaatgtcttacattatgaaacgggggaagtagtggataaaccaaataacgtacacattaagggcttattcgtttctaagaaaaaccaaaggatttccaaaacagaggatttgaatcctgtatacagcattcggtttacaggattgagctataggaaatttgaagggaaatttccttttgtgccagctgtatcggtaaaacacaggaatttttgcatccagtatgacctcttgaaaattttcctggcgcgaaaagagcgcgccacgagcgcactgcgcgcgtaatcttttcgctctcacgacaaaaaaggtaggtaccgctgaaaggaaaataaaaaaaatcacaggaggcaaacagactcgcatagaagccatcgcctttgatcccatctcctctaccacttcctctcctgtctccacgattgggtactggacctcctctcccacatcgatcgccggcaccggatgcaccttcgccgcctaggtgacaggacgcaacggcaacaacgggaagagccacggcagagatcggcaaggacgcgttgattgcaggtttggtgcctcctcttccgttgttatgcatagatctgatgccccatgctgcttctttgcatacaccttagcatttgggtcgctgcggatggggtcgtagctgtaacacacaagggttcatagtgtctgcccaatggcaatcttgtttggttcagagaagttgttgccggcgggcggcggcgatgagcagcaacaagtagtaggcgagctagccctgttcatagtgtctaccgtacgttctgccgtacctatcggctgccgctgccatctgtttgtctacccctctgtcggctgctctcatcctttgctgtggtgtactgtggtctgctccttgattcgtcctgtgcttcagcgattgaccgctctctcatgatgagtattgaattttagggcttattcgttttaaaggattttttcattcataggattaggaaaaatgaaggaatagagatggttgtggagttcaatcctatgggaagctaaacctcaggaattgaaaaaaaaatgtgcattcggatacaccacaggagaagtgtaggaaatctgccatttgaaatatatttttttaagtttgcatcaactgacatcggccctcaactagctgttagctttgaagtgcataaatagccctcgttagccttgtgcaccattctcccctgttctttctatttgctcatcaactgtggaagaagcttgctgatcctttgttcttctcttcactatctgcataatttttccagaagctttactcatcgtctagccaccatagctagacgttacttgctcgtgtaacaacaaggtactacttgttcatctggtgcaccaaaattgttttttcctcagcaaaagtcttgatttttagctctcttctatgtgagtttacagcatcagtttggtagcatctgcacaccatgaatccaagctaccgacgtatatcagaaagtgatgatgagttcattcattttgttctgcctactttaggagattcatcacaatcatcttgtattaggagaccaatgcacacgtcaaaacttacagggggttgccgtgtacatgagattttaacaggacatgaaagattatgcaaaagaaacttccgtatggaggtcgacatttttcatgcactagtcaataagttacgtgagaaagagtacctaactgacacaatatatgtttcagtagaagagcagattgctatattcttatatacagtggcaaaaaatgcaaccaatgaaacacttcaagattggtttcagcatagtccagatacaatacatagatatttcaaagcagtgctggaagcagtcacaaatctcacatctgtctacatnnnnnnnnnnnnnnnnnnnnnnnnnnnnnnnnnnnnnnn

SEQ ID NO: 15550 - DNA, 2356 bp, Oryza sativa
  unsure (1)..(2356): unsure at all n locations
aaggcaaagatgaaaatgcttctaaggtcttttggccaatgcaatacaccacaacttggtctcatctctaatagttgaagccctgaaattcctatggtttcatatccaccaagcgaccaatagtactaaccaatgttgcttagtgatttgttgcaaagcctgacgccactacttgctgaaaacaacgtcatctggccctgttgtttgatggtgcaggtccaaccaagaacagcacagatcagaagcaaacacacttgtcaacacacacatcaagtagtcagcaagtgctgcatgttctcctccaccacacacatatatagtgtgaattattcatggtgatcaagactgcgacgacccaatcggtcagcagtccaacaacgattcagcgatgctaaccacactgaaattctgcagcgaaatggagccccaagttgtccaaattagcttccaatgctcaaattattccaccccctgccccacacacacacacaaatgaccgttagctgatctagttgtaacttgtaatttgtaagcacacctgatctgaagaagatgtggtgtccatatgagttgatctcttccactccaagagtgaacttaatcccggttcaaatttcccaaagttgaagatattccatcagagggttggggttggtaaacctaccctgatgtttttgttagcgcttcataacgcgttcttcaggtagcaattctccttgtcacatgctcacaaagagatggcgcgagatcaaatgaggatttgccatgtaaccatttatcactactaccttaaaatgagtatcgtacgcgaaaagtaaccatcggttccaatgttctattctcaatcaccctcctagcatatctctaattgtataagcctagcctgttagtacaacgtaaagacattattactagtcagaaaaaaaagatcatgttgccatcctcagcaatagacatgactaatatgaacaacataaccaccgagttgggagatgctgtggaagatcgggtttagaaattacgagtactggttttgtcatcatggaaaaaaatcagaataagtactttcgtatttgttttctgcaacttacatcaacatacaattatataggcaggaataatatccaaaattgtcacttgaaaccaggaacaacaatggtttgcactttgcagctctgcattcaccttccttcgtcaatgcgtccagctatccctggatacgagttgagaggggcggtctccctcttctccctgaactcaccagtagtagatccagagtagtaggagctggtggcatagctagtgtcacctcctcctctgagctgccattcagtgatgtagctcggcttcgtcaccacctcagtcacctcaatatctccggctaggatagccatgactctggacattgatggccgctggtgtggtgacccttgagtgcaaaggagtgcggcacagatgactctcaaggcttccttctcattgaattccttgagttttgggtctacgatcccgagtgcttgcccgctctcatatagtgtccaggcctataaattagcaaatgcacagcttacattactttagggactagcatcagctgatgtgttctcctggattcaaagatcatcaatatataggcttacccattcaaagagatagatcttatcttcttcacgagagttgtcggtgtttggtcgaccagcaacagtctccaaggcgactaccccaaatgcaaaaacgtcggccttttcagtcagatggcctctcattgcatactcgggtgccagatagccacttgaaaaggtcaggtgaggataaaaatattaggttatgttttgaacataaactcggaataagagcatggtataaaatgttcatacagcgtgccggctatttttgtgctgatatgggtcttcttctcatcatagagctttgcaagtccaaagtcagagatcttgggggtgagatcagtgtcaagtaagacattgctggctttgatgtctctatgcacgatgcgaacgctagactcttcgtgaagataagttaggcctctagcaacgcccaaaacgatctcaaagcgtgttggccagtctagattaaagcttttgcttcctgaacatgtagaaataaggtcttgataattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15551 - DNA, 3300 bp, Oryza sativa
  unsure (1)..(3300): unsure at all n locations
ataccttcttgctgttgggtcgcttttcttctcttacttatcaacataaagattccaactaaggctgctgatcctaaaactaatgcaccgatcactattccgacaatcacacctgccttacttttcttttttggctctccatttctcacggtaggagtaaaatctggaaaaagggttttagtaattagaatatactataatccattattcaggttaaattattcaattgttgggcttacttggggtgacacttagtgcagatatcattggtccgtagtaaccttgagttggaatacaacaagtgcccttgccagcccagaagagatggatctcaaggaagtttttcgacacgattgtattatatattttgttaactgcagtaaaagattttccaccaactgctttccttatatcaaaattcttttctttcagaacaccctatgcaaatgtcaagtgaacattttcatataaagaaaaaaaatcaggtaaacaaattaatgcgcattgtgatatgtatctacctgcacatatatgtcaaaaattcgccttcctgtgctctcccaagtctttgaatctggataagcaaactctgcaaattgaagcttgacactataatttccattctcaagtcctagaccatagtatcttagggatgatggtgacatcctcgcggtttggaataattctgaatccaatgtgttttgaaactgttgggaactatttattacatagtttcgacttgaggcatcattgaatattccaacattgctgacaccccatcttgtatttctggtaacatagtatgatgcgactccgagatttgcagcatctacttcatatatagtattatctgagcctttcatagatttattactgccacagtctaccgcaaaagaatagtctgcagttaagatgtacaaaattatggccattactgaaattcccgaatcctttcaactgctacaaatgattaagttttaaataacatacattctggagaacctagcaaacatggagtgtcttgttgtaaacagtttagtcctgaaggtagaatactgtgtgtaatggaataaaacattaaaaaataatggtcaaaaaggttttgtaaaaaacataggcttgtagataaatgacacaagtacctattgttgttctcacgaatattaaatttatttgccaccaaattccttgtacaaacaacgcgtgtaacttgtcaggcaacaaacttcatacaacatagtctgtctttatttccatttttcatcagaaattttaacttacaattgcaaattgttattggtaacccatgaaggaaagcttcccgtgagttgattgtatgaaaaatctctgcaaaaatccaagattactaacatatgaaatgaatatatcattgcaatgctgaaatctattttggctataatactatatatgttgaattggcagccatacaaattggttagggaggagctcttcgcatctggcaggcttcctgtaaggctattgttcccgagaaacctgaattgagtcaccattcaagacgacaaaacatggatgtcagcttaacaggcgtttctataacagcaataatcttcagaaagaattccttacaagtatccaaggttgttcagattaaggatggactgaggaacttcgcctgtgatattattaaagctcaagtccctatggcatacgtttagcaatattacttaagtaaacacacataaaactacgagaaataataaccaatagcaatagaacgtggtactatgtcaagaaaaacttacaacaaggttaatcttccaagcttagagaaatttactgttctgagattatcggatatcttgcagttcctcaatattctgaaagaacaaaagatccaaacttagaaacaagttttcaatgtataaaactgtaagatgtttaataaaactttaaaacatgtcacatacaggatattcaaagacgtcaggttactgataaaggccagcgaagagctcccgtttacaatatcaccaattcgtctgcatatgtgtatttagaacacaaattatcatgacaagcttggccttgccaaccatcagggggaaaatgtcacctaagaaagaagtacttacaagcttgtcaagttggacaaattagacaaacttgctggaatcgggccttgaaaagaatttccttggaacctcctacaagtttacactttaagaaaaggtaggaatatgctaaataaattaacataagaagtatgctctgcatttcaaagagcttggaatgacaaatttcagagttcaagcaaaagatagcaagaactggaaagtgaaactttggctttctttacactatactccaggacccttttttagaaacccccacgttactcgtagatagctaaaagggcagaaattcctatattaatcaaaatttcgcaaaataatcaagaaaaggagaaaaaccctaacaatccaatctatttaaccagcatatcctttagataggaagaggatcaatatcttaattggtgtattgcacagataccctaacaaatatgtttgagttctattaaaatttatacaagtgtcttgagtccccaatataagtaactaagaaaatattcaaaacaccatgcacacatacattgagatggagtttgagttagtcacaaaagctatttgaagaaagcctacatgtatgaactgcttggcatggatggttagaatctattttttgttagatactgatcaaatatgcaaaaaacacaaagagtctacagaaaaataaataaatatctgatccaccaaaaataaaacatattgcccatgcagatgcctgtgttgatgaatatttctcctaattcaaatgaaaataatatatgcagagcagatatgttgcacaatcgatctatttgtatcctgtataggataaataacataaattaaactgataagttaacaataaatcttacagttccaccaactttgtcaaggtccctaaataatcaggtattttccctgtgaaatcattatctgatgcccacctgcaagaacaacaacataaatacaatttgagcatatgaagcacaacaaatataactactatggctctgttgttgaccatacagcttctccagattcttaagttttgataatgttgaagggaatggaccactgaagccagaactatcaatgtacctgttatcaaaacattatagtaattatcatgtttatcaatacagatattactggtnnnnnnnnnnnnnnnnnnnnnnnnnnnnnnnnnnnnnnnnnnnnnnnnnnnnnnnnn

SEQ ID NO: 15552 - DNA, 12115 bp, Oryza sativa
tgaaaaatctctgcaaatatgaaataaatgcatcattctaattttagctgtactgcaatgttgaattgtttacacacaagttttttagtgaagggcttatcccatctggcagtcctccggttaggctattgttcccaagaaacctgaattgggtagaatacaagatgatgaaacatggtcatcaatataacatatgtttctgtagatgtaataacctccagaaagaattccttacaggtctgtaagcatttgtagattcagaattgattgaggaactttgcccgagatattgttaaaactcaagtccctgtgccacaagacagcatacttgaacagacacttcacatgaaatttcagaaaaaacaccaagagtttcatggattgtgctatgacccataatgaaaaacgtacaggaaggctaattttgtgaactttgaaaagtctactgctccaaggtctccagatatcctgcagttcctcaatacactgtaaaaagtattcggtattagcaagttattactttgtcaatatataaaattgcaagatgtatagttagaatttaagtgtcacatacaggatattcaaagacgtcagactactgacaaaggcaaatgaagagctcccacttacaatatctccaatccgtctgctcatttgtatttagcacatcagtcatcatgacaagaggggatggcaatgttgccatagaacagagtacttacaaggttgtcaatttggttagattagacaaactttccggaatcggtccttcaaaagaatttccttggaaagccctgtgagttcataatttaagaaaaaagtatgaaaatgccaagtttatttgaatattagaaaaagtaacctctacatattaagacactgttgggaccagagtaatggcatacaggtatgcacatttctgttcatagtgatgacttaaaagaaaaaaaacacgctacagttcgaattcaattggaaacaacatatgcagaaaatttctgttgcagttccacttgtcttgtgaataggataaaatcattgatgtgataaaaagttaaaaattactcttacagatcttccaaattagtcaagctcccaatataatcaggtatttttcctgtaaaatcgttatctgatgcccgcctacaagcacaaaaacatgtttgatgttgagcatatgaaaacaaaatgaacatgacaactgtggctctgttcttgaacgtacaggagcttcaggttcttaagctttgagaacgttgaagggaatggaccactcaagccagcactatcagtgtacctgttattaatgaaatgcaacaatcatgcatgttcaacaataggtatcttgctggtccaaattaaactttgttcttctagaagtagcatctgtcaagttagaaagagggggcttacaaacttacaatcgttgaagtttggtcaagttgcccaattcttcaggaagttgaccagtaaaattgtttgagctgatgcctctgaaacaaaaggaaatagtttagaattgatataacttgtttatctgcactaaaaatagcagaaaagtggattaacttttcctgatgatccataatattcacctttttaggatttcatttggattaaggttatgaacaccatttggaaaaggtaaattgcaccgacaagacttgcatatgagtaatgtttttttagaacttctccttgagaatatatgcaattaatttacttcagacactaatcaattgttgagaatgagaagacatgcaagaagatctcttacaatgatcgaagatccgtgagattcccaatttcctttggaaggggcccagatagcgaattgattgataaggtccttttttcataaacgaaaaaataacaaggagagaagatgtctaagagaaagctccaacagactgatgtagaagaatatataacttgaaatcaaactcttacaggtattgcatgaaagtaagcttcccaatgaatgatggcacagggccagtcaagtaattttgctgcaggttcctgaaacaacacaagaatcatcaaacaaattagccaaacacacgaggtatgattactattaatccagttttttcctgctaactgaaaattgattagtcaaaacatgggattggatcaatatttactgcaaaaatactgttcaactatttgacagtgcaacagaaagtgctccatcaatcatcataaaaaaaaattctaaggcataagaatttgaaaccatacaagttagccagatatctgagactctccagctccgcaggtatcgtaccgacaacattcaacgcgtacaccctcctgcataaacatcacgtcagaaaactcccttgcatgacgacagtaactaaaaacacaatgcactaaaaagattgtgtgttcgcaagtatccaaatcctattcatcgtgatttgtgaattgatcccaagagcaattatatgcttcttgcaactaccagaccaaaaataaaaataaaaatcggaggaccccatggcctctctctagaatttcctctgtcctctgaggcattccgtcgaacacctggcctgcggtcgaagcaagaggttcagtcaaaggcgtgcacgtacagcttggtgatgtggcagacggtgcggttgttgaaggagcagtcgcacttgatgccggggttgacgacggggctgtcgtcgatgttggtgtcgtcgacggcggtgccggtgcaggggtcgccgccggtgatgttccaagtcttgggcggattcgttccccatctccccaggatcgcgttcagcgccgccactgcattggcgttccacacaaacaccaatccatttctttatatgcaaggtctaaaccaatatagaaaaagaaaagaaaagaaaaaccagagaggaagaagcagcggcgaatagtgcaaaaaaaaaagtttttaaaatgtacgacgcagttcacttctcgaccaacattcgaccattcgttttattcaatttttttacaaatataaaaaatatttatatcatacttaaagaatatttgatgatgaattaagtcacattaaaataaataataattatataattttttttaataaaacaaatggtcaaactttgaaaaaaaattaacggtgtcatacattaaaatatagaggtagtattacacaagttgttcatcatcttaatgattgatttctcttcctctatttttttttcgagaactgcgtgtaatgtattattccctccattatttttatttgattgtgattattttcatcacgatcaaagacaacttaaccttttattttcatttaatgtgattatgtggtagaaattaatcaagaaacgtgcgctttaactaccccaaatactgtgctatacaataatgctatatgttaaatgaaggtacagtgtaatgtgatcttaatttgaaatttctaatttttaattatgtgatgatcgatagagtattactccctccgtttcaaaatatttgacacactttttagtacgtgtttgaccattcatcttattcaaaaaatttaagtaattatttattcttttcatatcatttgatttattgttaaatatattttcatgtacacatatagttgtacatatttcacaaaattttttttaataagatgaacggtcaaacatgtacttaaaaagtcaacagtgtcaaatattttaaaacggagggagtacattatagagttgaagaaaatcgtggaacaaacgatccggctaactctgctttgaacagaagcagggataactgacctttcgtcgaagataaaacaggtctctttatttttatttttagatgaaaaaagaggtcgcttctgactattggtctaaaaaataattgaaggaaagggacaagaaacagccaagaagaaaataattcttcttccaaaaaaagagagaagaaatgaattaataagccaccaggatcaactctgcagtgctattttctcttcaagatcggcaacatttttgctgatgcacatgtaataaaccctttctaaatcttaatgaaccgatcgaagacgttccatctctcatccggcgaaaagagaaaaagaaatcaaaacaacatcaaacatatctctaatctgtcttcctatctctgaagactcaatgaaaaaaaatggagagaaagctagcatatttgcaaatcggagaccaatgaacatgtatatatccaatccaaaagcacgtttcaactgatacacataccttcaactggatcagttcttggagcttgctgagcctgagcagctgcaacccaagaacacgcgatcaccagccaatacaggagcagcagctgcctgccatggctgccgctgcagcgcctcctcatcatcctgaaaaatctctctgctgcgtcgtcgtcttctctcctctccttaaaaatctatgtagctatgtctgtcaacgcatgtacatatataagctgataaaatcatcgatctgtcgtcggcacaaatggatgcgcaacttggagcagcaagttgcttgtcgacagatatgtaggagcagcagcggcggctccaggtgaagaggacctcgagaaaatcaatcgaacggcaccatgtgtttgtaatgccattagttggaagattaatcaacgccagaaagtcgtgtagacgtgtacagtgatgacgatcgaactggtgtcgagttgaccttgttttgttaattactagtataagagtaatttcgacgatttccatagtactgtacttaattagtactacacagttgtcagctttcaagacgttttaactttgatcaaaactgtttcatatttaactaaatttatagaaaaaataataatatttttaactcaagacaaatttattataaaaatatattcaattattaatttaataaaactaatttggtattataaatattactatatttgcttatacacttagttaaatttaaaatagtttgactttgactaaagtcaacacatcttacaatacacgaattagttccaagagtgtacaggtcatcaacagatatgcatagtttttctcactgcacagtaattggagttgctagcaggttaattagttttgagtttcacataacatctagcctgagtttagttggatccaaagtttggattttgattaaaattgaagatgatgtgactgaaaagttatatgtgtatgacaggttgatgggataaaaaaggactgaagtttagatgcacacagccctactactcctatatcccatcgactgacgactcgtcgacagtgacaattgttttggaagtatcaggaatatcctaggatcgatacatcggtcagggatcgatgccaaatatgacttgtgcccaaatctgaataatccatcgccgaattatagaggaagaaagcgcgaagcagtaaacgccatccatgagttgaatgcatgcgtctacattacagaatgcgacataaagttttggatcgaccagttccactactacctagctgctagtactaattgtgcatgcatgcgtctctggtcaattaagtaagagaagttcttcgagaaaacaaaataagattagtcccacacgcatgcatggctagctgggcaacaacctgcttgacttgtttactacgctctccgtttcctactataaatcattagaaaaatatccgtacgttgtaacggatgaagagactattttaatcttattattattatatggtttagttaaggtgaaattcattatattaaattcatttgaatatatatatttttgttagaaaatcatgtgctacaattagaagtctgatcatcttaagttagaatgcgagttttttaaagagatttttttatatgattccttctatatttccaaaaacgaactaacttaaaaaccgactaaaatatgaatttgtgtttctaaaagtgaatgaacttaataaccgacttatatacggatgacataccaaaaataccggcaaaaatatcttcaatttttataatattagagatttagttattttctaagtttaaccaaatttatagaaaaatataatactctctccatctacttttgataggcatatttccaaatctaaaaattttatttttgatagacatatttcaatctaacaatctatactcttaatgactttcttggatttaaggcgtgactctacattctttcatacaagattggctacatggatatcgagaaatataaatattaaagaatcgcttgttacaaggaataactagtagcatgtttaaatggatgataagtagaattacttatccttattctatctgccaagatgaaatatgactataaaaaatagatggagggagtaacatttttaacacaacataaacacagtatcaaaacatatttcaagttatatttaatgaaactaaatgttataaatgttgcttttttttaataaaacttaatcaaacgtaaaaaaagtttaacgcgaaaaaaaaatcaaaataactcataataatataaatgagagggagttaattctgtagttgacaagactcagattgacaagatgacaactgtagatgtagtactctgtatgcatgcgtatctcgtactctcgtatactcaaatacattaacgtacgaagagagcgatgtctaagctacctagttgttggatcgatgtataaattacgcacgttgggatatagcgcgcataactaatgctaacgacgcgcggtttgaaagcccacagtatcgaattgggatcacatgcagtttgtacatggactacaagttaagatactgcaggcaataggagccatctattttgttgatgaacggaccagatcatcagctagctacagtatctctccggccggttgcttgtttcgttgtagctagcgtacgactgtacgagcaaattaaaaaaggcaccgtatccggtgcaaatcagggttgttgtgcaaccttacaaactttcaatcaagaccacaggatgcccatccgatggctagggacagatagagctgggacttgggccgtgctttatcaggccggcccaaggcacgaaggtccggcacgatagaaagcacggtccgacacggaccgtaaatgggctgggccggcacggcccgtacgtgggccgtgcctgggcctggacaacgggcacaacgggcggcacggcacgaccactgggccgtgcttgggccggcacggcacgcgaatggctgctgcagcacgaggtcatcagccatcacccatccacggtcaaatttcctatgcagccagcaggtagcagcaagtagcagctcgttttcttcatcggctcatcggtagcacgtagcagcaaccagcaaggccatcagcccagcaggccagcactagcatttggcaagattgttggctgactcacgccgccacgccggtgggctgcgtccccgcgacgagctgacgaggaggagcaggatgggcgtggctgtcactgccgcgtcaccgcgacgggacgacgaagccgcaagccaccgctgccgcgtcgccgccagagtttcttcttagcgcagccggcctgctcccgtcttttgggtcgtgcttgtgccggcctggcacgaataggcccgtcgggccattgggccgtgcttgggccgcgtcctgaagaggccgtgctgacacggcacggcacgacaagtgggccgtgctgggccggaacggcccaatttggcacgaagcacgctgggccgtgccgtgctagcccggcacggcccaagtcccagctctagggacagaggtgggttacttttgcacttaaccgccctcactcatctctactaatttgttttttatgcaaatcccccctaatcacagctccgtccgtccgccctccccgcgtcgtttcatttctatagcacacacgattcgccgccgccgcctgcctgagtccccgccgccttccagcgactcgccggcgccccttcgccgcgccaccgccgccatgtcgcaaaccctcccgttgtgaggtcacggtgtagaacgtgccgctgccgccttggagtccggcacgcgcgacgtttcgaattccaacgcgacagaccctgtgcaggaccagcgggcgagcgccgttgatcctgtcgtcgccattgatcccatctccgttgaggccgccgccatggatcatgccgtcatcatcgtggacgagggccaaacaagctgtgaactatgaaccgtggaagtgtacttgctggaagtccctatacttgatgtattcctgaatgagacatgcttattttcgtattgtgaacattttaatcttaacctgtatgctcttgttatgggtagatgctgccaaaatttagtaaaaaagggtacatgctgccaaaatctgaactgcaacaagagcttcttatctgagacatatttgccatcaatatattgcaatacatgaaactgaacctgtatcaaacctatcaagctgttgtgctctagcacatgtgcagaaaatgcacaacaagtagtttgacagtttgacagattacaaaattcgtgttggtttcagttcatcttttatccgaatgcgtgaagctgggcatatattcagtttgacagattgacacagaaaacaactggtagttcattcaggctattattcataagagcatctccaacagactacccaaatccgactctccaaacacctatatagccaactctccaattgatttggagagtcaaacttatagattactccaacaacatctctatccacgctctctactctgagtctatgacaacgacccacaagtcagtctctactctttctccccctctctctcgcttttctccccatatgcgatggcggagacggcggaggctacgaggcagaggggcggtggacggtgtcggcgtggtcggagcagaggcgcggtggacggcgacggcgcggttgagaggcgcggtggacagcgacggcggatgtagaatgcgattgcggagacggcagaggccacgaggcggaggggcggtggacggtgtcggcgtggtcagagcggaggcacggtggatggcgacggcgcggtggacggaggaggcgcaatggatagcgacggcgccgttcttcttcccctctcctccccgagttcgcgcctttggatggccgggggcaaaggcggcgacaaatgtggctgtggacgaaggcggcgatgctggcgatggtaggggatccggtggtgggcgggacgacgatggcggagatcgagacgacgatggtggagatcgggacggcgacgaagagggaggggatgacggagatggggacgacgatggaggtgcggccgaaaggagcaccgtggcggtgaggaggagctagggcgcccatctgggagcgggagatccggggcggcgcgcggccatggccggagatcgaaggcagagaggggaggtcgcggctagctccggcgcgaacgacgacggtggtcgcggcgggcttcggcgcggacgacggcgtcggtcgcggctggctccggcgcctctctcctatgtgccgtcggccgtcgctgtcgtgcagtgcggttcatgccgtcgccgttcacgagcgtgctcaagccgggggagatagatgggtgggagagggagtggtgggtcccacaaatagccaggcagggagactctccaagtttgaccagtgaagtatgcgatttagccatccggctgttggagggtatttttctcccatacttgctaaaatttaacttggccagtcatttagccactctattggagttgctcttacacacccataggttccactgtcaccacaagcaagaaaaaaaattttatggttccacttgactcaatctcattatcaaatgacattacacaattccattgcatatttgcagtcacaatctttcagagttttagattacaaaatcagtacatcagtgtcaatctcagaacacgattccattgcatatcagctcggcgggccaacgaccgcgttgagccggctgacgcggccacggcggcgagcggcgacggaaggaggcacatctcggcaggccagcgacagcattcagtcggctgggcggggacgcggccgcggcggcgagcggcgacggcgggagggcaaaaggagaggccaggcacaaggcaaaggacggcggccacacgaagcacgggggatttgcataaaaaaaacagattagcagatatgagtgcgggcggttaagtgcaaaagtaacccacctctgtccctagccatcggatgagcatcatgtggtcttgattgaaagtttgcaaggctgcacagcaactctggtttgcaccagatacggtgccaattaaaaatgccaccttctcacacggttaatctaaatatttaacaacatgcagcttttgatttgatcaaattaaccttaccaatctctctctcttttttttttgaagaatctccactactcataagttcagaacatgcagccttcgtttcatattatttttgtcctaaaattaattaccttcttagaaaaatatatcaacatgatctattagattaatttcataaaagtcctcttaagagacccacatgcaaaaaaaatatatattttcacataggagcctcttaacacacccgcatgcaaaacacaagcattttttagcatgtggatttcttaagcgggcgcatgcaaaaatgtctcttcccgctcagcatctttaaaattttaagtccccatcgttatctcctcaacttctctctcacctctcatttttccacaccctctcaatctccttactcaatcccccactcatttttctctcctcctctcccacttcctcctccatcgctgggtaggagcgcgggcgggcgacaatggcaggagcggcgggatgctccccggctcctcctccacagcccggtgggagcacggcgggcgggagttgcagcggcggtgacaagcttggcctcagatggagccggggtggcagtgctagggttttttttttccttttggggaattttatttttttcgcgattttttgttttcgcatgtagttgcgttggtcgcatgcaaaaatccgattttcgctgacctttgggtgcaagcgggccgccccatccgcatgcaaaaatcgattttggcttcatggaaaaactgaatccgtagtagtgcacgaaacatatcttgatgatgtatttatttattattgtatatatttctgcatttttctataatcctgatcagagttgaagaagtttaacttaatcagtacaaaagctaaaacaacttataatacagaaccagtggaatatctcataagttcaccgcacattgaagaggtagtatgttatatatttttatactacctaacaagctacctcataatttatatatttttatgctatctaacatactacctcttaaccgcacattaaagagtatgtactttaagtctttaaccataacttacccaaaaattttgaataagataaatggtcaaatgtatgtctaaaaattaatgttatcatatattaaaaactgaagggagtctcttttcctatttcatggagtcatactacctataataaaaatatattattattattattattattattattattattattattattattattattattattattattatctttattagcacagttaaaactcgaccaattgtgacgatgtaaagtggactttttcccacctccgttacatgtgtgcaccctcggcccaaatcggtgtaccccaaattagtgtacctttcggcccaatccggcctgacatagagagccaacgtcaggtgtgtctacaggcagcggacgcgctaaccgacgggagtatatcaaaccgatttttaatcttttgattaaaatccaatagacacagtaaaaagcaaaaagcaactcaaaacaccataatgaacactaaattaccatatcttcaagaaaaagacaaaatccaatataaatttcaaaacttacatgcaaagattaaaaaattacattgtagcttacaaaagttacaatgtaagtttcataaattacactgtgacttaaaaaaaatatactgtaattttgagtgaaaaaattgagtgagagataagaaaaaatctttcgagtgagatatagcaaaatcgat

SEQ ID NO: 15553 - DNA, 11550 bp, Oryza sativa
  unsure (1)..(11550): unsure at all n locations
nnnnnnnnnnnnnnnnnnnnnnnnnnnnnnnnnnnnnnnnnnnnnnnnnnnnnnnnnncaagtttacacatctaaagtttatacacctaaagtttagagacccaaagtttataagtcaaaagtttatatatccgatttaaatttgaatttgaatttaaatattttttatatatagtatttctatacatctaaagtttatacacatatagtttatagacacaaagtttataagtcaaaagtttatataccctattcaaatttgaatttgaattcaaatatttatatatatatagtatttccgtacataaatttttctaactttgttttcttatttttttttcaaatttatggtgtagtaggaagagaagaggggatgagaagggggatggagggggggtgatcacccacccattagcgttgcccattcctgattcaattgtgttaagattggggcaattgtgttcctgcccttgctttctgattcaattgtgattttacctcttctttttagggtttgtgattttgcccttgttttttcaaattgaagcttctgtttgcccttactctgttaggatgaattaacggtgttaatttagtagcagaaagactggtgtgccctttgcatttctttgtgtggatgtactgtttttgccccgatatatgatgtggacattaactttgagattgtatggcaactccacacaaatcaatttattgccagttattttcaggaacatgtcagttgcatatattcatcatcacgaagggaaaaagaaaggagaacgcaaccaattgtccaaacaaatctattacctagctttttcatgaacaaagagattgcacacatcaaaaaggagaaagaacagagagcccaagcaaaaaataatccccagatccatctaacagagcctcaatgattcatcgcagttgcttgccggttgattcaatcaacaaagcaaaccattaaaccctcccagttcctcggtggcaacggtaactttgagcaaagctgggatccaacaaggaggaggcgcaggattcacatgagacgatgcacccagcggcaaaatgtcatggctgacgcagtcgctgtcgaagtgtcgataccgcgcgggaaatcagaagcctgccgcctttgcgcctgcttgcctccagcaggctccggtccgcagtcccgacgacggtcggccgcgcgtgcgcctcccctgcgttggcctgttatccccgccgcgcctccccttcatgtcgacccgtagtcccggcgacattccgcggcgcacgcacctccccttcgcgccgccgcctgctactcccctgcgtcgcgtcgccgtgcctccccgtcgcctgttcgtgtcgccgccgcttgctcgtgccaccggcacggccaaatcctctagccctaggttttgggatgggggaggggaatccgtagctttccaacccaattcgcacagctacttgagtgatttatttactcaccaggggtataacagtcattgacaaattacgaaattatttttttattttcttccccctttgtttaactcggaaattctagccccactaacagccgtcaaaatcgagggcaaacagctacttcattttgaaaaagcaagggtaaaaacacaaacctaaaaaacaggggtaaaatcacaattgaattagaaagtaaggacaggaacacaattgccccttaagaagggcttaaacgctaccaataactcaataagagcatcatcaatagtgcctctaatccacttccaatttatatttttaatgattttagtctaaaaatccggcccaacggcctccctaccttgtccctaaatctttgggaattttcttccctttgattttcgctctaggcatatgagggcgaggcctcgctcccaatcttgcggtcacgtcgttgtgaaacatactaggtctcttgtgatgcctacgcatatatcgaagcgggttgttcgatcggtttaggttcgccttgcctacacatggacttatgttttaggcaccatagaatttactaatggtgcatattaatagcagaagtcccaaaagcagcaaactagtagcgaaggtagtttgatgaaggctcccatttttcaggaattcctagacgagaagcggtgctttattactcccaatgcaacaagcatgcaacttgacaaccatgcgggtgccaccactgaaaacaagaaaaggaggagggggacgcaaaatagacttattccttaacccccaaatcatctcattctcctctattcggaactccggcgtcgggcatggccatcggccgtcgccaagaacggggcgccactccttggccccggcgggggaccttgctccagctcgtcttcgggggctcatttaccggttgcacgcgcgcgcgcgcgcgcggggtgtcacaccgcgacgtcaagccacagcggagcaggaagccggccgccttcacgccagcttcgaggagaacgtacggcggcccgccccaagtccatcccattcgccgggcgcggtcttctncgacctcgacctcattgtcgtgtaccccgcgcccgcgggccggtagaacgcggtggtgcgcgctgccttgcctcgtttctcgcccccttcttcgccttgccgtgtcgtgctgcatctgtttggcaggcaacgcgtcggccgcggccgttgaacttggtagtgtggccatcagcaagcaggcaacagcatccaattttgattttggtttgacgacggtttcagaatgggtttaaatccatttcttagcttgtttggataattggattagctttaattttgcacttggggctgttgagattataggcatataataatttaatatattccataaataaatcatggcattgcagatgtatactagcattaacgcatcattagatctacacatgtaaactaagcagtaaaacatgaacagatcaaatatgcgcaacatattgaacacgtaccgaggtggtagaaagaccggctgctcggcaagaacatttcgcaattgcaggcgtctacgaaggcgcgcagcacgcgagcgaagaggaagacgagccgtcgcggacgaacagggagcagtcgcgctaagcgcttcccaaaaaccttattgtcgccttctctcggtgcaggacatcgaaggcagaggttcaagagacctgctctcccgatcgccagtgcacgccgacgagcgcgatggagtaatctacgagcgacggtgcagcatagagtaggaggcaaaccctagattgattttgcgtgcgttgcgtgaagacggcaggtcggtttatatagagaagggtcgcttgatcagggcgcccgcacgatctccactgcgcataaccgaaccggataagtcacgcgtaacttatccggactccacgccgttttcacgcaccggatttttcggaatgtttccaaaacaaaaatgaatccgaatttgcagcaaaacaaaactgcaaaaggaggctgcatctacgccttgcccaggccaggcgaggcgagcgagcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccatccattaattccaacgggggcaggccggttcgggtgttgcctttgattaatggatttggattggtttggtttgtgaagtatagtgtatatacagatgaatggagcgggtcctactaatgcgcgggtgatcgctgggcgcactcccctcctctatgccgattcctctctccccctttctccttcccatcttctcttcctactacagtacaccacaaatattttttaaaaaaacaaaaagttagaaaaaattatggatagaaatactatatataaaaaatttgaattcaaattcaaatttgaatttgaatacaaatttaaatttgaattcaaatttgaatcaaattcgaaatcgaattcaaattcgaattcaaattcaaattcgaattgtatcgggtatgtaaatttttgacttataaactttgtatctataaactttagatgtatagaactactatatatagaaaatatttgaattcaaattcaaatttgaatcagatataattcaaattcaaatttaaaacgggtatataaactttaggtctataaactttaggtctataaactttagatctataaactttaggtgtataaactttagatgtatataaatattatatatataaaaaatatttgaattcaaattcaaatttgaatcggatatataaacttttgacttataaacttttggtctctaaactttagatgtgtaaacttgaggtgtataaactttagatacataaatttactaaaataggaaagtaatacggtgctaaaaaaggaaaccaggtggagggagggaggggggaatagggtgatcgctagccaacagccagggcgattgatcgctgattagagtttctggaatggagcggaccaatccctagccagctggccagagaatcctcttaagatcagctttcatggaagaatcacccacatgatctgtcctcagagatttgatattttgacaccacaaattgggctttgattattcgacatcgtgacccactgtaaccaactcagatggacccgcatgttattgtcaagagtgttaacatgatcgaagcggcaacaaatatggagtgtcaaatcatcaaatttaaccgtttcagtgtagatcaaggaaaaaaagacaggcaggactggtcaaagatcataaagcttacagaaattcagaaaacttgtggttgtgatgctcaccaacccccagcttgggtctacatcatgtgtactctccactgaagacttattcagccaagtcagggactgtttcaagggaagtgaagagcacagaggatggtgattttgttcatccttcacggcgaattctcccaatttcttccatttaagttcttcttggttgtctgattattaggtttctgcttcgaaaatgctggtttgctctgctgctggctgcttgggttcaacctgatctggtgcttcctagtcgaattcaaggagagccggtgagctaagctccaaaccagttgcaatttgttaaagaaccagtcgattgtcatatgcttgctaacctgcttccgtatttgcagaggaaaatatttgggaggggcaatggcagaaaccgcggtgagtgcatctaagggtgtgataggtgccctttttgagaagctcactaagctggtggaggacaagtgcaccaatctcgtaggcatgtcaaaaaatattgtgttccttaaagatgagctcccaaccatgagcgcgctactcgagaagctagaggatgcagatgaacttgatccagtggtgaaggcttggaggaaccaggtcagggagatggcatatgatattgaagattgcatcgatgactttgtgcaccacgtgggaggtggtgatgtggaagctggcttcatcgataaggtttctcactttctcagaactttgagggcccgtcttgagactgccgagcatatcaaggatctcaagattcagctaatagagataaatgaacggcacaagaggtacaaatttgatctagatgacactcctagttctagctttgtggccattgatcctcggttgccagcactgtacagtgaagccgctaatcttgtgggtattgaaggcccaagggaacaggttataaagtggttgacagatgcggatcaacaaataatggtcctaccaattgttggctttggaggtctgggtaaaactacgctcgccaaggaggtttatcaaaaaattggacagcaattcaacaccacggaatttgtttcagtttcccaaaggcgagatcgagctcgataccctcaaaggaatacaatcaaaacttccgatacggctgtcttctgaatattgtgaagttaaagacatcattgacaacatcagagcatatctacaacatagaaggtcagtatccatttacttataatagtggtaggcattaattctttttccgttctatgttttcaagggttcatatggtttcaagaagttttctatctaaagtgcctgttttgctctacataattacttgtttggagctgacaggcatcctttgccagctttttggcttctagaaaagtaaagctcttctcttaaatgggtcatgtgccagagttgaggggcaaaaatatctaggtctatattagcatagcgcacagatgttggtgcgatttaggtttgagttctaaatgaatatcctaatttagcaatataattcatggttagtacaaggaaaaaaaaactcatgaatttccttgaaccaaatgtgcttattaattgttgaatttgttgatatatttcaattattcatcgcacataccaaagaattgtatggcacttgataatttaatttaacaggtacctttttgttgttgatgacttgtgggatgcacctacatggaatattattcggtctgtttttccagaaaatggcatgggctgtagaataattgtgaccacacgatcggaagatgttgctagatgggtatgctgcaatcatcgacgattcatttacagaatggagcccctcagtgatgaaaactcaagatggctattctttaacaggatatttggctcggaagatggttgcccttcccaatttagagaaatttccgctcagattctgaaaaaatgtagcggtttaccacttgcaatcattaccattgctagcctattggctaatcagcctgcaccacacaagaaagaatattgggagagtattcgtaattctattggcacctgggggtctggcacaaatcccacgttggaagggatgaggcaaattttacaccttagctacaaggatcttcctcgtcatcttaggacatgcttcctataccttggtatttatcctgaggacttcaccatcaagaaggatgatttgattagacaatggctggctgaaggctttgtccatcatttccatggggggagttcagaggaagttgctaagagttatttcaatgaactgatcaatagaagcttaattcaaccagaagaaaccaaatatggggaggtagtttcttgtagagtacatgatatgatgcttgatttgatcttaagtaggtgtgcagaggataattttatctgcgtggcatacaatctagaagaattgtctggaaaacatgaattcaaagtccgtcgattattggtcgactctagagttggtgattcaggagataccaaaatatcaggaacacctgctcctagattgttgcaactcagatcacttcagctgtttggagtatctgtatccctgtctttgttgccactgtctaagtatatccgagtgttgatattacacttgggaaaaaccgggacaggaggcaatgaaagagttgatgtgaccgcaattgggcaattattccagttgaggtatttgaagattgtaagcctccatcatgcgctcgtactagagcttcctactgaaattcgaggacttcaatatttgtcaacattggaaatagattgcacaaatgagaacagtttgccatcagatattgttcatttgtcccgcttgtcccacctgattgttccaagtggtatagggttacctgatgggaagataggcagcatgaagtccctatgcactctccaaaaaattgagatattagatatcaagagcgccattggccttggtgagctgaccaatctaaaggaccttgagctgtacagtaaacaggctctgtcagagagagagattgatgcgctggtaacttcccttggaaaacttcataagctcatatctctgcgcatgtctaagtttgcagaatgtatctggtatgatgaggataaccggctcggttcattgtccaatcctcctctcaatattgagagactccacctgggaggatggaggttgcgtcgagttcctagatggatcaatggtcacctccaaaacctctgcttcctcgttcttgatgttacagagatgtcaactgatgaggttcggctccttggagagctaccttcactcagtgaactctgcctgagcgtgaagcgtttggctccatgcagcgcatccctcgtattcggtgcagggttcccagcattggagtgtcttgaattcttttgcggtggagatatatcacacctgtgctttgaggcaggggttatgcccaatctcagaaagatcattctgttttacatagatattgaatggagcggcaccgcaccagttggcattgagcacctactgaacaaacaactccgatacatccaattacatccggttactgacacagcagtggatgccgagcgtatcagcctcgcattcacagaagctataagagcacatacaagccgtggtggtgctgaaccttacctgcgcttcgcccggatccgaagtggtagcctcataggtgcaaactctttaatccggcacagttttacttgtcatagagtttctgctttgtttctcctgaatcacattcttgccattcttttttctaaatttatattgtgcatttctgttctaagtttacttttttggttgtacgcgtaccttgctgagtattggaaactcttccactttcagaatgactgatcggctaccttctatcttgaaatggcgcggggacgcattcatgtttttagttcaagctgcagcaatgtttccttgaagaacattctgttaaatggtaggtgcccttcacatctctttgggcttgttcactttgatgccaaaaaaaaaccttaccaaattttatcattgtccaaaattttggcaatggcaggattttttatataattactaaaatttgacagcaaactaaatatagccactttttgataactttactaaaatttgataaggttgaaaatggcatcaaagtgaacagggcccttcatcagctccaggagacagcttcgggcttcggccagagtcactagaacagatcaatgtgcagagcacttatgtcatgccagttatgacccggcactaataaggttttctctgttagtagtgagctactccttccaatttcacaactcttgacattttggataatattgtttaaaatgtcaagaattatagaactggagggagtcactgctcgtaattgttcgtgcatctctggtaacaaattaagtaaagtcctggatgcacaattagttatagaaattcactgcaataagaagctggccattgcatacatgggcaacatgctggacatagattgtttactagtattaacaacaaaagaacatactggacaacgatccgtggtgacctcgagttgatttttttttcttcaaaaaacggacagattggattgaggctggcgccgcacctgcttatgcatagtcatatatatatgaatccaggggcaaaaaagaaccgaagccgaatcaaatgcaaatcaatcgcgggacgggacacaattgagagttgagaggctattcgagtaagcatggaaacaaattaaatgatgggctggaaatcttgccggggatcggcctgtcttggtgaaatgggcagcccatgtagaaagaaaaggcccaaattcgggggaagaagtttagaggcccaaaatagcattgcagcctggactgaccattggatcggaccgaccgctttcatctgtaagggccgatctgcggcgatcacgaccgatcactttacacctccatcatctcgcttttcacgggaatgaaagggagatatttaacatgggggcaattatattcttacctctactttcgtatgtaattgtgattttatctctcttttttagtttgtaattttactttttttaaacaccggtttacccctactctgtgaagatgacttagctgtgttcttttcccctctttcccaactcgctttcctcgttatttacgcacacgcttttcaaactgttaaacagtgtatttttgaaaagatttctatatgaaagttggtttaaaaaattatattaatctattttcaagtttttaggctaatagttaattaatctcactataatttttaggctaataattaattaatctcactataaccacgtactttgttggaatattgcccttccgaacacagccttgacggtgtcaactcggttataaaaacacatatacaagctttaacacttgcccatacttttctaacaagatttgtatattttattaaatttaacgaaacactgatagatttttgacaggattttcacaaacttgcaacgggtgcaaaaaaaaaaatcttccaaaagtattaatcacattcaccataaaaaagatcaccaaataaattccttgtagtcaggggcggagccaggtgtggagcaacttgggcccgggccccacacctggcagaaaaaataccaaggaatttactaatttttctattaaaatttgttcaacaagttcatactctaatgattaagccctactcttaacataatcctggcttcgcccctgcttgtagtgattgggaaaacaaaaaaaaagaagagaaagaacaaacgttgcaagctgcccgtggacgagccgctcgacatgcctcgtcgacgagatgctcgctcgccgcccaaatcgtcgcgtgctggcgtgcagctgccaaggccgccgccgccgcgagctcgcgcactgccgctggagctgctcatacacgcgtgctgctgccgaggtcaccgcatggtccgcatccgcgcccctcacctgctcgcgcgctgccgccgccggagcgcctccttcaccgcctggcacctgctcactcctggccgcgttgggatgcttcgcgcagccgcggccgtcgcctgatgctcggtgcgtcggcccgcctagagcaacccaggctctaggcatctgctgctcctcgcctcgccccacccagccgccgcgccgctgccgcagccgccatgtcgttggtttcagaatgggggagcgggtgaatggtgccacggaatgggtataatggtccatttctactttctttacagtttcatatattcttttcacactcttattccaggtccaccaaacgatctgagcgtaaataatagcttcatttaaaaaaagtaagagcaaaatcacaaactctagaaacaaggggtaaaattacaattgcttctgaaagtaggggcaaaaatacaattatcccatcaattatttactactgttagatgtagcaattaatcatttattacctagatccacacatgtcatgcacatataagatctacatgtgacacatagatagtaaatgattaaacgctaaatctaagagtgggattaagttaaatgtcctgagaaaaacaagggaagaaagataaaataggacatcgtgactttacggttttagctatatgctaccacacgaagtaacttttataagaagacgtacactttgtaaatatggaaattagctcatggacaccatgtatatt

SEQ ID NO: 15554 - DNA, 2686 bp, Oryza sativa
tatgtttcaaatgtaatgggtcaggaattacagaccagatattacaacaccatgtgcatccagtgtttgatctactatacatggaagaaaagaaatacacaaattgttctgaagtaagaaaaattaggcaaacatgattatatgaattataaccctaagatatgaaacccaacatgtctagttctcatggaaagttaatgaagggcacaatgtttgaaggagaaaaagggaccaagattcactcaaacttaaaaacagcacccttgggtacttatctatcaccttccctcagcaaactcactgatagaattagccgacaaaacaagtgggaaggtttccccttgggattttgtgttgtttcctgagcttgatggcacactagattcggtgcctgaagattgctgcatcgatgacgtgaagaaactatcacttccactcttcctctgccactgaggcacatagctaggccacatactcatatccacctcactcatctcggtatcttcagtaagcatggagacgacttttgacatcggtgggcgttgctcaggcaggcccacggtgcaaaggagaatgatgttgatgacacgcacaacctcttcctcgtcaaatcttgcaagtttagggtccaacatttcaagagtctgacttcgctcatgtagccgccaagcctattaaaatcagtttagtttgatgatttgatgtttaaccatggaaaagtacttctcttaatcaactcacccatccaagcagatacttcttatcatcctcgaggctctcatcaaagtttggccttcctgcaataatctccattgccacaacaccataagcgaagacatcagccttctctgtcaagtggcccatcatggcatactcgggtgctagataaccactaaaggtaagaaaccaaatatatgatcaatgatcattttttttgttataggtcaattaaaataatatcatcaggagagtttcttacagcgtgccagctactcctgtgctaaggtgagtcatgttgtcctcataatgcctagctagcccaaagtcagagatttttggattgagatcaccatcaagcaagacattgctggttttgatgtccctgtgaactatccttgtgctggactcctcatggagatatgctaggcctcttgcgatgcctacgcatatgtcgaagcgggttctccaatctaggttcatatttgtcttgcctacaagtgaacttaaattttagggaccttggaatttgctggtggtgcatattttattattacagaagtttaggaagtcgagagaagcaaaccagtagcaaagatagtttgatcaaggctcccattttctaggaattcatagaccagaagtggtgctttgctctcaatgcaacaaccatacaacttcacgaggtttcggtgttgaacggtggatatagttgaaatttctgtcatgaactcccgtttcccttgatgagatgttggagataattgcttcacagctaccattcttccatcatatagcttaccctattcatggaagatatagataacaattcaaaatgatgaatgaaattatgcaaattttgctacatgacactaaaaaatgctggtagacaacgtaaagacgcgtcggctgaaagacaccctaaaaaaccagtaatttgctggaggacgctttcggctcaatatgatgagagaaattctttaaattataaagacaagactaccttagggccaaaagcattcgagttgaggctagagtgaatatggaatatgatatatgctagcgatgtatttgggtgatggcaaatttagagttgtatagtttcaatttttcactccaatgccacatttgaagcatgtggccctaggggcattctcgtcattttgaagaatgtctctcttccagtgttcacctagtcgctaaacgctagtcggacggccacctactgactagcgactaggctgattaggcggcgactagacggattaggcaaattagacgttttttctatttctttcacacaaaaatacttattctagacattcggtacttggtaaatataggcatttaggcaaatagcataaatcatagttaagttcagaaatcatcaagtccatacaacgcactgacactgcacacgaagcattgggtttagtacaaatctatagggatagcgaacacatcagtatagccactgtacatgcacatcataattcataaatcataactttatagatctgaggggctagagctaggagagaggaagaaaaatttatctggaactggaagaacagaggaggtgaggtggtggaggggagcctgatcccctgatggcctgatttagggttggcgtaggctgcttgagtggtttcgtgcttgactgcttcaatcggtgtgtttgccaccttccattgatggcaaggatgaaggatgggagggagagcaggagcagcagaggagggggaagaacgtggagcagcagaggaggagagggaagaacgtagcggcacggtggaagatcgatgggcgcggcaacggagtcgtcgctcgtggcggtgtgaaaaaggggtaggcagggattgcgctctctctccaggctctcaaataaggcaacctaaatccccttctataccgagtcagtcccaagtggtgcttctaaattttatcatgcccaaattttgatttctat

SEQ ID NO: 15555 - DNA, 1692 bp, Oryza sativa
  unsure (1)..(1692): unsure at all n locations
nnnnnnnnnnnnnnnnnnnnnnnnnnnnnnnnnnnnnnnnnnnnnnnnnnnnnnnnnctagtagcaaaatttggcaaagtatggtgtaactgatcatgtagagtaacatacgagctactgtacaccaataattagattgaggaatattataagatagaatcaaattgtactactccctccgtttttaaatatttgacgccgttgacttttttaaatatgtttgaccattcgtcttattaaaaaaatttaagtaatcattaattattttcctatcatttgattcattgttaaatatacttatatgtgtatatatagttttacatatttcacaaaagtttttgaataagacgaacggtcaaatatgtgctaaaaagtcaacggtgtcaaatatttagaaacagagggagtatgttgtaacgattggaaagctctaccatgcatgggttacttacactgtgtaagttcccaatatataaaacatggaaggaaggactattggactaataataactgcatgtaaaaagggaatcatgttcttgtgaaactatatttgtttggtcttttgtaactcattttctagtttagtcagtaagtaaactaaaaagggatttttttaatataaaatagagctgaccttgtaaacaaggccatagcccccccttcctaggatgttatcctggctaaagttgttggtagctgattttatttcaccataactgaagacatctggccttccaactacactgagaagctctgcaaaatccttcacattgtcagacaaaacaagggaatcatataaggctatgtttagttcacgctaaaattgaaagtttggttgaaattagaacgatgtaatggaaaagttagaagtttgtgtgtttagaaaaagttttgatgtgatggaaaatttaaaagttcgaagaaaactttggaactaaacacggccataaataagtcccactttttccaaagagtaaacagttatgtaattttaactacctcccatctccgcctccatttttttccttttctgtctccaaagaaatgtccctgtggataaaaggcctaaaactatagtacagacaacaactccagctaccaaagctattttacttttaccagcactgtttttaataggaccaggatcaaccttattgttgccacctgcagtaggataaaatgaaacaaaatagatgttaattataagatgatcacatagaaccaatggctcttgatcaagttaggtaatgaacagtaccataaggagatacacttaatgctgagattaatggcccgtaggatccctgtctaggaatgcaacaagttccttttccagcccagaaaaggtgaatctccatgaaattttctgtaactctaacaacatactgcctcaaaacaacagtataagattttccatttgtttgtttctttatatcgaaatccttttctctgagttctccctgcagtaaattgaaaaatagaaggtgtgaatgcacaagaaaacgtgcaacataactgttgcacactattaaaaggtatacttattttccaaaaataacattcattggacctttataaaaaatccacctgaataaatatgtcgaaaatccttgttccnnnnnnnnnnnnnnnnnnnnnnnnnnnnnnnnnnnnnnnnnnnnnnnnnnnnnnnnnnnnnnnnnnnnnnnnnnn

SEQ ID NO: 15556 - DNA, 722 bp, Oryza sativa
ggcgaattcgagctcggtacccggttttaagtgatttcataagttccggggggattcccaggtttcccgccatggatattttagtattacattcgattaaaagtttgtttttatctcttccaaagagatcttggcagtcacagcatgcgcatatccatgcttcgaccatgcgctcacaaagtaggtgaatgcgcaatgtagtacccacatcgtcatcgctttccactgctctcgcgaataaagatggaaaatcaatctcatggtaatagtccatgaaaatccttgtattcataaatcctccaggtagctatatgcaaattgaaacaaaagagatggtgatctttctaagagatgatggaatctcccttcagtatcccgatggtcaatgcgctggatatgggatagatgggaatatgctgatttttatgggacagagttgcgaactgttcccaactaaaatcattttgcacgatcagcgcactacgaactttacccacaaatagtcaggtaatgaaatctgatataaagacaggttgataaatcagtcttctacgcgcatcgcacgcgcacaccgtaaaaagtctttcagttgtgagcctgggcaaaccgttaactttcggcggctttgtgtgcgacaggctcacgtctaaaagaaataaatcatgggtcataaaattatcaccttgtccgggcggcgaccgatgttctgtatgcgctgtttt

SEQ ID NO: 15557 - DNA, 1069 bp, Oryza sativa
  unsure (1)..(1069): unsure at all n locations
cgggccgggcctagtttatagttggtccgggccgggccaagttctgttgatgattggtcctctcggctctctagcatgagaaaattgacatttagccattctcggattggggtttcgctagaatgccatccccgaacgtggcttcgttataatgccatcttcaaacgtcaccatcttgccacattgccatttcatccaatttcggttatttgcaaatgttatccactatgatcggacttttttgcccctatggctatttcgttgacttgcatgagagggacagatcgatctccatccagtcgtcttcttcctctagcaatcgcagccggacggcaagcatagctcggacgtgctcccagtcccagcgctatcgcaaccgagctctagcagtcggctgcgcatcttctccggcacagcgaacccgacgctggcgcaggaggtggcgtgctatcttggcatggagttgggtcgggtaaagatcaagcggtccacggacgaggaagcgtgcgtggttgtgacatgttcctggtacaggccacctgcctaccgcccaacgagaacttgatggagctcctcatcatgatcgacggacggccgccgcgcatcttgcggtttgggcggcagcagcagcactagtatggctatcgatctcgccagccatggcggagctcgccattgaagagggacttcaaaatccacaacggaattaagccgatttgagtgggatttgtggggggaactaatgaggaggatgagagcagtcgatttttacattcaatctggggcgagagcacccgaggagggagatcaagagagggcattgttgcatgagttcgccggaagagataaggatggtgtcgggcggacgtggaacacgctcctggcgagcgggccccacggtgataaggatcttgctcggtgagtggagtggctgaatcaagggcatttgggtcaagccaaattagctttactatggaccatgcatgcaaatagctnnnnnnnnnnnnnnnnnnnnnnnnnnnnnnnnnnnnnnnnnnnnnnnnnnnnnnnnnnnnnnnnnnnnnnnnnn

SEQ ID NO: 15558 - DNA, 669 bp, Oryza sativa
  unsure (1)..(669): unsure at all n locations
caggtcgactctagaggatcccctgatattattaaagctcaagtccctatggggcatacgtttagcaatattacttaagtaaacacacataaaactacgagaaataataaccaatagcaatagaacgtggtactatgtcaagaaaaacttacaacaaggttaatcttccaagcttagagaaatttactgttctgagattatcggatatcttgcagttcctcaatattctgaaagaacaaaagatccaaacttagaaacaagttttcaatgtataaaactgtaagatgtttaataaaactttaaaacatgtcacatacaggatattcaaagacgtcaggttactgataaaggccagcgaagagctcccgtttacaatatcaccaattcgtctgcatatgtgtatttagaacacaaattatcatgacaagcttggccttgccaaccatcagggggaaaatgtcacctaagaaagaagtacttacaagcttgtcaagttggacaaattagacaaacttgctggaatcgggccttgaaaagaatttccttggaacctcctacaagtttacactttaagaaaaggtaggaatatgctaaataaattaacataagaagtatgctctgcatttcaaagnnnnnnnnnnnnnnnnnnnnnnnnnnnnnnnnnnnnnn

SEQ ID NO: 15559 - DNA, 752 bp, Oryza sativa
  unsure (1)..(752): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcaacaatttcacaaggttccgatgttgcacagctgaaattgttgcaacctctgtcacgaactcgctttttccctgatgggatgattgagaaagttgtttgacagctatgactcttccatcaggtagcttaccctgccaaaggaagatctctaggttacatacatattttgattatataccaattaaattgcaaaggcagttcaacttagtaagataagtttcacggattgagttggggggccactaaccttatatacttgcccatatccaccttctcccaccatattttgagaactgaaattctctgtagctaactttagttcagcattactaaagacattaggccttccagcaaggttgtacagctctgcaattttcagtacacatgggaaagaataaaccatttgaaaatttcaatttttgaatagctgcactaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15560 - DNA, 846 bp, Oryza sativa
  unsure (1)..(846): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagctcaggggaaggaatagcagccatgtcaccaccggctactccgggtctactgccgatgagctcagtgggcagagggagacatcccctctcacaccttccctagagattaacagagaaattatcgatgatggaagatgaatgcgaagttgcaaagtgatggtagtgatcttcgtttcaagagctaattttggacattattcgtgttcaaataaattgcatttttatgtgagttagagctaataaaattgaatgtgacatgtgctactattgtgcagttgactgtttgattataactaattcatgagctcaggatgaattcgcacgattgaataatggcattacatgtttgggggttctattgcgcgcagctgcaccgagaagcgaagtaaagcacgtgcttccacgccgctcatcatagcacttagcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15561 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcaagttcaaaccaactctggccccttgattcaatggctctgaagactgacaagtgctctccagtcaaaaaccaaaatacaggagcaattatcagcgagagaagattgttgtagagcacgaaaccccatgtattcaggcccaactttgtaaccatgtgcttgatgtacaccatctcagttgttatagtcaccagataagcgactgcccatgagtaggctgtgaggctgaaccccgaatctgtcatcacgtaaccaacagcgcctcccaaaatagtgacaagggacacaaatgtgagcttggaaggacatggctgcttcctgaaggcagtatcagcgatggcgaccaaaagcggggtcaacgatctgaacactatgaaggtatccacattggcatgcttcaggagatgggtgttggtgaagatggcaaggtagaacacaagtgcagccggcgcaaacttctttgcggtctggaggttgaagggatcatggtagaggagtccgagctttccgagggtccagacaccagccactgatgtcaagtactgcagggcagtgaggaggccagggtagctgaacttggtgatgnnnnnnnnnnnnnnnnnnnnnnnnnnnnnnnnnnnnnnnnnnnnnnnnnnnnnnnn

SEQ ID NO: 15562 - DNA, 770 bp, Oryza sativa
  unsure (1)..(770): unsure at all n locations
agatttgatattttgacaccacaaaattgggctttgattattggacatcgtgacccactgtaaccaactcagatggacccgcatgttattgtcaagagtgttaacatgatcgaagcggcaacaaatatggagtgtcaaatcatcaaatttaaccgtttcagtgtagatcaaggaaaaaaagacaggcaggactggtcaaagatcataaagcttacagaaattcagaaaacttgtggttgtgatgctcaccaacccccagcttgggtctacatcatgtgtactctccactgaagacttattcagccaagtcagggactgtttcaagggaagtgaagagcacagaggatggtgattttgttcatccttcacggcgaattctcccaatttcttccatttaagttcttcttggttgtctgattattaggtttctgcttcgaaaatgctggtttgctctgctgctggctgcttgggttcaacctgatctggtgcttcctagtcgaattcaaggagagccggtgagctaagctccaaaccagttgcaatttgttaaagaaccagtcgattgtcatatgcttgctaacctgcttccgtatttgcagaggaaaatatttgggaggggcaatggcagaaaccgcggtgagtgcatctaagggtgtgataggtgccctttttgagaagctcactaagctggtggagcacaagtgcaccaatttnnnnnnnnnnnnnnnnnnnnnnnnnnnnnnnnnnnnnnnnnnnnnnnnnnnnnnnnn

SEQ ID NO: 15563 - DNA, 632 bp, Oryza sativa
cttacccattcaaagaagatagatcttatctttcttcacgagagttggtgggtgtttggtcgaccagcaacagtctccaagcgaactactccaaatgcaaaaacgtcggctttttcagtcagatggcctctcattgcatactcgggtgccagatagccacttgaaaaggtcaggtgagaataaaaatattaggttatgtttggaacataaactcggaataagagcatggtataaaatgttcatacagcgtgccggctatttttgtgctgatatgggtcttcttctcatcatagagctttgcaagtccaaagtcagagatcttgggggtgagatcagtgtcaagtaagacattgctggctttgatgtctctatgcacgatgcgaacgctagactgttcgtgaagataagttaggcctctagcgacgcccaaaacgatctcaaagcgtgttggccagtctagattaaagcttttgcttcttgaacatgtagaaataaggtcttgataattaagatgatggtctaatgtagagaagataattctcgagagtgcatgaagcaaggagcttaccaggtgctagtgatgagcaaaatggaacttaccaaagagtgctctgtctaggcttccattttcg

SEQ ID NO: 15564 - DNA, 1450 bp, Oryza sativa
acttttccacatatgtttactccgcaaaatgatttctcacacactatttgaaagatcgataaaggtttacctaattaatatttatatcaactagcttaatgcccgtgcattgcaacgggaattaaaaagggaaccaactgtacattgtaaagcctaaaaaattaaaaaaaaaatatttgcatcgtaaaataaattttcattgtttgatggcttagggttgtgagactgtttgagggacccacatggtagtggactagtggtggtgggtggtggcagattcaccaccatcaccattggaatattttaaaagagtatggagtatagatactccacatcttgaattttgaagtactacacaactttcttcagaagcagtgatccctcttttgccatagactgaagatctttgctgcaagaaagccattgcccctcgtaggactgaggtccatacaaccttataactgtcacttgattcatttgccattcattttaattaatttatgcaatgccaagcatctgtgattacggaagtgtgctctagccaacaaattcgtcagtcatttctcaaaaaaaaaatcaaaactaatttaactaaatgaattttaaagcacccatgcaaatacaactggcatatacaaattaccaggatgacttggttatgagtatggaaaatattcagaacaaaataaatccatatatttgttgcaactccacaatgtccaaaaatatcacttgaagctaaaaccagaagcgatttgaacatatttgcattcacctttcatcatatgtgactccggttatcgttggagaaagggtgagtggggaagtctccctctgctctctaaattcaccagtagtagatccacagctatagttgctgcttatatagctggtgttccctcctctgagttgccactcagagatgtagctcggcttcgtcaccatctcagtcatctcaatgtctccagcaagaattgccatgaccctaaacattggtggtcgctggtgtcgtgacccttgagtgcacaaaagtgcggcatacatgactctgaaagcttactcactgtcaaactcatcgagttttgggtctacgattttgattccttggctctctttcatatagaccccaagcctaatattaattatcataccgacaacgtgttgattgtgagaaatagaatcagccactgtattttcttggatgcaaagaccactgatcaacttacccatttcaaagaatagatcttgtcattatcacagggaattgtccgtgtttgatcggccagcaactggttctagagccacaactcccaatgcgaaaacattagcctttttaggcagatggcccctcattgcatcctcgggtgccacatagccccttcaaaaggtcacacgagattaaattagcttaaacttcaaaggttaacttttaagaaaagaaagggtgaaa

SEQ ID NO: 15565 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggtaaaacacaggaatttttgcatccagtatgacctcttgaaaattttcctggcgcgaaaagagcgcgccacgagcgcactgcgcgcgtaatcttttcgctctcacgacaaaaaaggtaggtaccgctgaaaggaaaataaaaaaaatcacaggaggcaaacagactcgcatagaagccatcgcctttgatcccatctcctctaccacttcctctcctgtctccacgattgggtactggacctcctctcccacatcgatcgccggcaccggatgcaccttcgccgcctaggtgacaggacgcaacggcaacaacgggaagagccacggcagagatcggcaaggacgcgttgattgcaggtttggtgcctcctcttccgttgttatgcatagatctgatgccccatgctgcttctttgcatacaccttagcatttgggtcgctgcggatggggtaccgagctcgaattcgcc

SEQ ID NO: 15566 - DNA, 2881 bp, Oryza sativa
tttttaatgggacaaatagagtaaagacatgctccaagaatagtactagtattagaatacgtcaaaattatcttttaaatcaataagaacatgtaacaaaagttttatgttgctttaatttgttgtaaaccttttattacatgttctgtcagtcaataagtcgtaaaaaatgaacaaattaaagcaacgtaaaacttttattacatgttcttagtgatttaaaagataattctaaaaataaactataaaaaattaaaattaagttttggctacggctgataacctataagtcaattaaatgatggttatcaccaatgctatttttttttttgcaataaaggaccaactaaggataatttcatttcatttcaacatatcattattataaaattatctgttatactctttaaaaatgtatcaagatgtaccatatatataagtggatgtatcaaatttcagtacttgtatagtatctctttgtatatatatttctgctttttttacacactgcactatataatgtcaaattcattcatttgccaataaaatctgacagaatataaacacatgcatgcacaatgatgtaggctaccaatatatgtacctatatataatgttgtggagtatgtactgcgactggagagctacatgcatatatatatactcccaacacaactgcagcctttgcaaggcgtttcaaaaagcctccaaaagtcatggataaaaaccttaaattccttttcatgcagtgataaaagtcgttgtcttcgtcacagcatgaggcagatacttgggtgctactcctttggctcctagttatttgttgtacctactgataagataagaagttcatatacatccgtttgaaaaaggatgacgtcctaataaaaaaacatgtgagtaaaacctcaaaatcttaaattattaataggtaaactatatatgctttatattaacagatttttgattgaaacactctttcacttggttatacttttagtaatatttataaatgcataatttgaaaattcaatggtacactaccagactgtcgatgtcgtccaaagcgctaagtaaaaaaaaggaacgtgggaagtaattatactgatactttttgtcacagacaagatatagtcattttcacgctatatataaatcgtagtaagatttgtgcatacattggcgaccgatgtacctctccgcgatagaataaatcaacttttgtacacaaatctacacatagggtctacatccatatatatttaaaagtttgatgatatactcgcatatacagtacgacaaatcgacgatatatatcaacataaatcgaactatacgatttttccgtatatcagtggtcgatatattcctctgtcccaaaataaattaacatttatatactaatctagatatatatgtgctatatatatccatatattcgtgtataaaagtttgtttgatattgtgctcgcatagtacgatgaatcaacaacatcgatcgatgtgctatttaaccagctaagctagatagatagcctccgtgtttgtttccggtgagagaaatcaagagatgggtggccacgtcatcgtgtggatattgctctcggtgtgctcatggcggatttcagctgctcaggctcagcaaccaccaagaaccgatcctgtagaaggtatagtaatcaatgtcgccgcgattgattaattttacttctctcgttgcctcaatcaatgcgagtttgatcatttttaatcgatcgatgcagtggcggcgctggaggcgatcctggggagatggaacaagaccaattcgccggtgtggagcatgagcggcgagccatgccgcggcgtccccgtcgacggcgtcaccggcctcgacggcaaccccaagaacaaccccggcatcaagtgcgactgctcctacatcaacggcaccgtctgccatatcacccagctgtaagtgttactatgttttttctggttcttgtttgcatgcacgccaggtgctcgacgcagtgcctacaagagaggccatggcgtctggaatctggatatatgagttcttgtggaaactaacttggaagtgcaactttgcaagaccaccactgcaactatgcataggtttcacttgggagtaactttttttatgtcgccaaataactgctctgctgttcaaatttcaccatgatcactacttggagtaattagagtaaattattttttgtttttacccctcgaacttgcgaaaccaggttaatctgggaccttggtcactggtcagtagtgaaatctgaggttgacaacacatctgtacacaactagctaacgcccactgttttctgccctcttctctctacaagctacaatcacgagtgaaaattggacctaagcagagtttcagtaaccaaccagacatggacatgcttgttgggctgtgtatgtgtgttagtggcgcatgagtatggtaacatactaacatatgtgcatgtatatttggagtaaacagcaagaattttcgtacttatttccaatttttcttactccttgtttatgtaattcaggaaggtatacgccttgaacgttgtcggtcagatacctgcagaattacagaacctcacctacctaaattacctgtatggtatctaactcttatcagctctgcctagatgctgaaacaactgtaggatatgtattaatatcttgcagcaagccagcaaattcaaattcaaacccatgtttgaaattctttgctgctaatgactggatgtttctggtgctgtttcagggacctggatcaaaattacttgtcaggccccataccatcattcatagggcaattgactgccttgacagaattgtaggaagttatagttcaagttttatg

SEQ ID NO: 15567 - DNA, 422 bp, Oryza sativa
  unsure (1)..(422): unsure at all n locations
nnnnnnnnnnnnnnnnnnnnnnnnnnnnnnnnnnnnnnnnnnnnnnnnnnnnnnnnnaagagatagatcttgtcattatcaagggaattgtcggtgtttgatcggccagcaactgtttctagagcaacaactccaaatgcgaaaacatcagccttttcagtcagatggcctctcattgcatactcgggtgccagatagccgcttcaaaaggtcagacgagataaaattagcttagacttcaaaggtaaactcataagaaaagaaagggtaaatgtgcatacaatgtgccagcgattttcgtgctaatatgggtctccttttcatcatagagcttggaaagtccaaaatcggagatttgggggctcagatcagtgtcaagcaagacgttgctagctttgatatccctatgggtaccgagctcg

SEQ ID NO: 15568 - DNA, 494 bp, Oryza sativa
ggattatttctgatattagaagagccgggcttgattttaaatctttgtgtgaaatggcagaattgggaaccaggggcggtctaaccggcattgcacggccggtctgaccggtgaccaggggctgtctgaccggccgcatgccgctggtctgaccggcgtccccgaacggtctgaccggcactgcgtggccggtctgactggtgttgggcagagcgctggggggcacgcttcaatcgatttgggggccgaattatttgggaattcggacatttgtgtccaggatacagaagatgattggagaattcctttgattcaatatctaaaggatcccacgcttaaggttgatcgaaaaattcggcggcaagcatttaaatatacattgcttgatggagatttgtatctccgaaatatagatggtgtcttgttgaagtgcttatataagatcaatctaaggtggctatgggagaggtacatgaaggaatttgtggaactca

SEQ ID NO: 15569 - DNA, 5389 bp, Oryza sativa
  unsure (1)..(5389): unsure at all n locations
ctatgtatgaattggatttcacagaccttggcagctcatcatattacgttaccagtgaaacaagatggggtgttagcaatgtaggaaaatatttccagtctccaaatgacagtaagatcatatatagcaatgagaagattcagaatgcagtggtttcagaactactccaaactgcaaggatgtcaccatcgtctctgagatactttggccttggacttgagaatggaaattacactgttctgcttcaatttgcagagttaggttatccagactcaccaacttggaaaagcttaggaaggagagtttttgacatatatatccaggtacaaattgagtgcattgtatggtaatttctattctccttataaaagggactagtggtggtggtggttctgctaccaccccacaaccaattcctaacttttcttgaagagaaaaaagaataaaatactcctaacaactctctaatttttgcgggaatgaaaaaaggacaacgtggggccaaagggtccacatgtcagtaacagatttgtacagcaattaagagatgataataacgggttaatgataattttctttaattaaaaataccgttacaatgcacgggcaatatgctagtgtttactaaaagcaaaaacagaaaaaaatatttactggatccttttcttctttatctgattgtattattgacatttttatagggtgacctaaaagaaaaggacttcgatataaggaagatggctggtggaaaatctttcactgctgtttacaagagttacacggcaactgtgtcgaaaaacttcctcgaaatccatctgttctgggctggaaagggcacttgttgcattcctattcaaggttactacgggccattgatctcagcattaagcatcactccaagtaagcctaatcattaaggtaacctcaagaaggattatattgccttctagtaaatgaaatctctgtttcagattttactcctactgtgcgaaacggtgtacccaaaaggaaaagtaaagtaggtgcaattgctggaatatcgattggtgcctcagttgtaggattagcagccctatttggaatatttatgttcataaagaagagaagaagacttgcacaacagcaaggaggtaaatatttttattatacaggaattcagacaacaaaattttcaaatgatttattctttctggtgtgcgctggtgtctacagaactgtacaacctagttggacggcctgatgtcttcagtaatgctgaactcaagttagctacaaataattacagttcccaaaacattcttggggaaggtggatatggaccagtctataaggttgtctattttccctaatttaatactgtgaaattgcaattgaataattatctgatctgtattaaatatagatttcttgcaaacttgttggtctaccctcaaaatataaatgtaacgtaagtaaagttcttcctttggcagggtatgctacctgatggaagagttatagctgtaaaacaactttctcaatcatcccatcaggggaaaaaccagtttgtgacagaggttgcaacaatttcttctgtgcaacaccggaatcttgtcaaattgcatggttgttgcattgacagtaatacacctttgttagtttatgagtaccttgaaaatggaagcctagatcaagcactcttcagtgagttcaagtctgctcataaccaacagtgcaaaattgtattttatattttgggaaatttcttctcttcattttttcatcatttgaattctcaagaccttaaagtcatttctgcttgtacagggaagaatagcttaaaactggactgggcaactcgcttcgagatcattttaggaatcgcaagaggactaacttatcttcatgaggagtcaagtgtgcgcattgtgcatagggacatcaaggccagcaatgtcctacttgacaccgacctcaccccaaagatatcagactttggactcgctaggctctatgatgagaagaagactcatgtcagcacggggattgcgggcacattgtaagcacatttcaccatttctcttgtggttgtcctctaaaatgaaagctaactaaaacttgtctaaccttttgtcaagtggttatctggctcctgagtatgcaatgagacgtcatttgactgaaaaggttgatgtttatgcattcggggtggtcgcattagagactgtcgctggtcgatcgaacactaataactccatcgaggaaagcaagatctatcttttagagtgggtaagttgatcaatgctccatcctcaaacaacacactaatctattcatgtatatgatgttttgattattgaagctatacctatgttaatttacaggcctgggacctgtacgaaaaggagcaagcacaaagaatcgttgatccaagacttgaggatttcaataaagatgaagttctcagagtcattcatgttgcgctcctctgcacacagggctcaccaaatcagcgaccgccaatgtcgagggtcatggcagtgctcactggagatgctgaggtagttgagatggtgacgaaaccgagctacatcactgagtggcaatatagagatggaaacagcaccaactcagaatctaccacctcagagttcagcaggcagaaggagatcgaccctctcaccatgtcgccaacaatcaccggatctagtcatgatggaaggtgaatgctgcaacctgcaggtgatcttggtttgaaatgattgtatgtaaatgtaagacggagctaatagtggaacttaattattctgaagtatgtatgatgataaaagtatttactccttgtaatttgtaacaggtcaaatagagtagtatcctagtatatatcttagaaattaatcaacgtattcgcatgtttatgagcacattctgcagcaaaatagtaaaaactgtccatgaaatttgttggctggaggacaacttcatgggttcataggcacatatgcttgccacaagaagggatgaggtgaaataattaaaggctgtatggagatttgatccttaaactcttttaagcctccgaaaggaaactcaataatagttcagtgaacttgatagggtccttttttttcccataggttatgtacatataggggtgaaaacgtccacgaaaattcttgactaatcgaccctcgtctctacttttaccaactgagcaatatggattaatggttaccaacaaaaacaaaaatgaaaatggtaaaaattattaaaataccaactatttctgaattttgccgaattcttacgaattactattttttatattatggtaattactatatttctaaatgcatcaatgttcttaaaagtagctactttttatacatcaatatttatgattcatttctttatttgacccatagtttataagctcattgactgattcatttctttatttgacccgtagtttagaagctcatcgactactcaaccaaatttttaactcaagtataagcttaaatggacgaccatttgtaatttattacaaacttaaaatttatttcattatatttagaaagttatgcaaagttaagtgtgtgtgattctacagttcaattttttcgaacgataccaatatgtttccatctatatagttatgtttccggttttctgatatttctaacatcgttttcatttacggctttaccattttccattttttttcttagaagagcaattttactatatccaacatttggtacctcaaagtactaaattttgcactagaaagtacttagaggtacaaaaaaatttgtagtaccttgagataccaaatgttggacggtgaaattgctcttcttagaaaaatatggttacggaaatggttgggacttttttccaagccgtttccgaccgttttcaaccgtatgtattaagtaatgttgtatttaaatctgctattcgtaggcgattttggatgtccagacaagcccacaaaagattgcatttcgctaatttcaacttacgaatagtaagcataaaaaaaagtcctccaactttaattctcatgtcctcactatgatcttttgactatagttagtttttgagacattgagatcagcgtggaggtagcaggtaatagtggatgattattccaaaaaaagggggctttcatacgtacaagtcgcagttgacatgtccgatctcttccagttgtgtaccatcaatagtacgttgatgccatgaattagtcaatgtcgtaaacattattgaaaccttaatgctccactcctctcgctatcttggaaacagaaataatatcttactaattagcaactgaggtttctcttggccttttcatattgtcataattaggattaattaacttttcgccttgaagctcccgttgctgctggtacatatatacacaacacctcggacaattcatcactatatttcaaaacaaaccaaaccaaacctgctgcttttgctttggttaattagctgagagagaaattaagagagagatgagttgcagcagcagcagcgtccatggcttcttgtggctgatgctcgtttatgcgtcctgtgcagctgttcaagctcagcaagcagcgagaactgatccagcagaaggtatgtgaattcagttttgcaaattacatatctctattgatcttgttctacctgcaactctgcaagtggtagctagagggtgttaattcagaaactggcaggattactagtaattagcagagcttagttaattgcgtgcaaactgtgtcttgtcgcttaatttgttctccggtttcattcactaattttgaagagctagcttcaaattcaatctataatactcaaatccgaaataaaacagcatccggttagtacccaggttgtttagttcactgaacaacaggttaatgacagaagcaaatcctaaaattcagataataacttagctcctatgctttcaaaataaaaagttaggcctgtagacaacgtaagtgaaatacaagtcagaaatttaactggcaacattttcagtaaacagggatcaattatgacgcatcagaaggttaaagtctatctagacgctgaatattaaaggacggactttgatattaaaggaaggctattggaagaattaatggtgagcagcttgaagtcaaacccaattggcagcttagagatgggttgctggcatgcaccccatccgcctgagttcgattttgctcgagcatgctcacctgaaatatttgcttctttcttcttaaaaccatggacaccaattccttccttgatttccgacttatttttttttcaattggcaacctagggcccatagggtaggaaaaggtgagatgtannnnnnnnnnnnnnnnnnnnnnnnnnnnnnnnnnnnnnn

SEQ ID NO: 15570 - DNA, 4171 bp, Oryza sativa
  unsure (1)..(4171): unsure at all n locations
ataacttagctcctatgctttcaaaataaaaagttaggcctgtagacaacgtaagtgaaatacaagtcagaaatttaactggcaacattttcagtaaacagggatcaattatgacgcatcagaaggttaaagtctatctagacgctgaatattcaaggacggactttgatattaaaggaaggctattggaagaattaatggtgagcagcttgaagtcaaacccaattggcagcttagagatgggttgctggcatgcaccccatccgcctgagttcgattttgctcgagcatgctcacctgaaatatttgcttctttcttcttaaaaccatggacaccaattccttccttgatttccgacttatttttttttcaattggcaacctagggcccatagggtaggaaaaggtgagatgtatttgtcccacttaattaaataaatgttttatttagacaattgaaatggacttgagtgggactattttaatataaaataagtattagataattttctcatatcttctaccatatatgtgccttttgagtctaactaattagacacctaattcaatccacaattctctcctccttcaaatgacacatgaagtaccacaatgagttgtgtttgtcccacttaattaaggaaatggactcgactcatatatttcaatataaaaataagtagaaatttaactagaacggtaagatagcgagccggtaatgttaagtactccctccgttttagattatatgtcgttttgactttgatcaaagttaaactgctcaagtttgatcaagtttgtagaaaaacgtagtaacattttcaacataagataagtatattatgaaaatatatttaattgtagatttaatgaaactattttagtgttgtaagtaaacttgattaaacttaaagtagtttggttttgaccaaaatcaaacttgattaaacttaaaatagtttgattttgaccaaagtcaaaacgaattataatctaaaacggaaaacggagggagtaggtgtttacagaagtagagcgtgtggttatatggcttgagcgtgcatatgtatacgagcatctgccttggtatcttgtttagcggaaaacaaagaaaaggttttcgagctacatttgcttaaactgaattgcgtatgtgtctctccagtggctgcactgaacacgatcctggggagatggggcctgcgggcgtcgccggcgtggaacatcagcggcgagccctgcagcggcgtcgccatcgacgagaccggcgtcgacaacaaccccaacatcaacccggccatcaagtgcgactgctccttcaacgccggcaccgtctgccacatcatcagactgtacgtatcctctcaacctgcgctgatccagctgcacaccaggtgttcgatataatgcctacaagaggccatgagtgaccatggtgttgctgaggattaggcttgcacacatgaaaatgaaattgtttgatattagttccttccaatccgtctctgcaaactcctatgtttggtttgtttttttccctgaaatcacgatctttaggatccaaggagctctagctaacaggtttttgtgtgtctattcaggagagtgttctcgttgaacgttgttggtcaaatacctgaggagctgcagaatctctcttatctgaataacttgtatggcctctaaactttctcttctctgttttgaagataaagcagtaaagcactactttttctgagagctagctagtaggatgtagagaacatcgactgaggaatggcaattgagatgctcttcagctcttgagggtccttttatccaatttatgaataatcttttgagtccaacttctcatggtaaaattatgctaaaaggatatatcacttcaaagtgctaaatctggaagaaagaatcagttgtatgcgccgacaagatgggtgcacatgtcattcacacattcttggaaaaattcttaaggtgtgatctttgtgggggtagattatatataattgttctgtctgttgactgtgatttggcttcaatatagcagatattgggaaatacattatatagcagaagctataatcctataccacaatcttgatagtattaaataagtatggaacaaataccatatatatgttttacgaggacaatacacataaatattttgagaagtttgaaaataaagcttgcagaatacctatcaccataccctgttctccattgtgttactcaagcgttcagtaaaaaaatcctaataactagcgaagaactatcatcttcctcatctagaaaaactagcaagaataatcagggtacaggagcctgattatgaagtgtttatgtttagcttgatggttttgatattactgaagggatcttcggcgaaattacttgacgggtcccctgccatcctttattggaaacttttctgccatgcagtacttgtaagaatctgatttcgatcactgctttagttttattttctcttagcattcatcagttgttactttctgtttctctaatcagtaatcgcataatgttgaaaaaaaaattactagggcggtgtccctcaatccgttatctggacctcttccgaaggagatcgggaatcttagaaatcttctatcattgtaagagatatcttagttaaatttcttcagagttgaagtttacattacagactattttttctactcggagttgaagtttatactacggactatctgaagtaaattagttacacaggagacacaaatgtgtaactgtaacttattaagaattttataaaaatttatcatttctacatgagtttcttatgcttgcatcagatccaaacagtaataaatagttcttatctgctatccaaaataacaaaattgtagattcttaagcagtgttttgtaacatgcttaattcttacagaggcgaatttatgctattttctgtctgtacataaacaaaatcgtagtcaacatgtttctttgggatttcaggggcattagttcaaacaattttactggtgaactccctgcagaactgggcaatttggaaaaactcgagcaaatgtaatcccattgtccattttgagcttccaaatttagactcctgttaactaaaattttgatgaggcccatctaaagttgtttttaattactgcagtcttccttttataggtatattattagttctggcttcagtggtcccttcccttcaacattctcaaagcttaagaatttgaagattctgtaagctattggagtgtcacaaatgttattttcattttggttccatatgctcgaagtaacagattctattttgcctgcaggtgggcatcagataatgatttaacaggaaaaatacctgattattttgggagctttccaaatttacaagatttgtaagattaattatcaacctcttgctccatttaaatatttatcctgatttattataacagaaaatcaatggaactgtagcacaaaatgcttctccttcatttcttgcccttacattaggacaagaacatatcatattctcagccctagtcctaacaggagtgcaacacattgcctgagtgataaatttgtataattttaccttttgacatcatatatttatgatctaatcaaaacattaacctgtagaaggttccaaggaaattcttttcaaggtccaattccagcaagtctatcaaatctaaccagattaacaagtttgtaagtatttttacattacactgcctgtttcctccatggagatcaatataagtactttattctctaagtgtccgtgcttcaggcggatcggtgatattctaaatgggagctcctcgctgtcgtttatctctaatctgacatctttgaatgtcttgtacggtgaaaagcttttgctatagagttcataattgcttagtcttcacaaagtggcaagttactaagttagatacttttattacagaatactgaggaactgcaagatatctgataatcttggaacagttaacttttctaagcttgcagggttaaccttactgtaagtatttcttttcctgctctttacttttggtcagtttgatataaggcatctgtatcgacgatgttgctgnnnnnnnnnnnnnnnnnnnnnnnnnnnnnnnnnnnnnnnnnnnnnnnnnnnnnnnnnnnnn

SEQ ID NO: 15571 - DNA, 5392 bp, Oryza sativa
  unsure (1)..(5392): unsure at all n locations
nnnnnnnnnnnnnnnnnnnnnnnnnnnnnnnnnnnnnnnnnnnnnnnnnnnnnnnnnaatagcatcgggcggagagtttttgacatatatgttcaggttcatactgagtgtgtcacataatattttgtgcatgtctgcatggaatgttttctaactagacgttttgcatagggtgagctgaaggaaaagaacttcaatataaggaagatggctggtggaaagtctcttattgctgtcaataagagatatactgcaactgtgtccaaaaacttccttgagatccatctgttctgggctgggaagggtacttgttgcattcctactcaaggacattatggacctacgatctcagcattaagcgtgaccccaagtactgaccaattagtcaatatatatgtacaaccaagaaaagggaattccattgatttttaattaatgtaaaactcatgtttcagattttattcctactgtgcaaaatggtgttccaaaaaagaaaagtaaagcagggacaatttctggagtagtgatcggcgcttcattctttggattagcagtcctagttggattatttatgttgctaaagaagagaaggagaacgtcacaacggaaagaaggtagatattcttctagcaattcactttttaaatagatgattttaattcctaattatttccaatatgtgatggtttttttttggcagaactctacaacatggttggaaggcgtaatgtcttcagcaatgcggagcttaagttagctacggagaattttggttctcaaaacattcttggagaaggaggatatggaccagtctataaggttggttatttcccctaatttactcaatgttaattgtaagtgaatatttatctgatctagcaataaggaaagttcatcttttgatagggtatattaactgatggaagggtggtagctgtgaaacaactttctcaatcatcccagcaggggaaaagccagtttgtgacagaggttgcaacaatctcttctgtgcaacatcggaaccttgtgaaattatatggctgctgcattgacagtaatacaccattgttggtttatgagtacctcgaaaatggaagtctggatcaagcactcttcggtgagttcacatcgtatcaccatcacctatcaaattgcttatgctgcactccgttatcgagatacctggttcttaactctttatatttttcttctctttatcatcatgtcatttatcttggtcgtttttggaaatgcaggggatggtaggttcaaccttggctggtcaacacgttttgaaatcattttaggcattgcaagagggctaagttatcttcatgaggaggccaatgtgcgcatcgtgcatcgggacatcaaggctagtaacatcctactcgaccctgatttaacacccaagatatctgattttgggcttgccaagctctatgatgagaagaagactcatgttaacacaaaagttgccggcacgttgtaagcgcattcatcatggctatcatgttcgtgtatatgttaaataacctgtactgattgcacttgcttgaactttgtctagtggctacctggcacctgagtatgcaatgagaggccatttaactgaaaaggttgatgttttctcatttggtgtggtcgctctagagactgtcgctggtcgatcaaacaccgactactcccttgtggaagacaagaaatatctctttgaatgggttagctgataagaaatctttgaatcctagagaatacatcagtttatcagtttatccttttataggttactgaaacatgttcccttcgtatgttaaaccttataggcttgggggctctatgaacgagagcaagcgctcggaatcgtggacccaaggctcgaggaaatcaatgaagaggaggtcttgagagtcattcgtatgtcgttcctttgcacccaaggctcaccacaccaaagaccacctatgtcaagggtggtggcaatgctcaccggagacattccggtgagtgatgtggtggcgaagccgaactacatcattgagttgcagctcaggggaaggaatagcagccatgtcaccaccggctactccgggtctactgccgatgagctcagtgggcagagggagacatcccctctcacaccttccctagagattaacagagaaattatcgatgatggaagatgaatgcgaagttgcaaagtgatggtagtgatcttcgtttcaagagctaattttggacattattcgtgttcaaataaattgcatttttatgtgagttagagctaataaaattgaatgtgacatgtgctactattgtgcagttgactgtttgattataactaattcatgagctcaggatgaattcgcccgattgaataatggcattacatgtttgggggttctattgcgcgcagctgcaccgagaagcgaagtaaagcacgtgcttccacgccgctcatcatagcacttaacgctaatatcttaggagttcagtggcaaatgtattttcttgaataaaataataattaaatagtgaattggaagttttaaaatgcaacttgatagttaaattgaaagttatataattgagcttgaaattttcacaattttgagtgaaagttntaaagttttataatagaatataaaaatgtgagttgaaaagttttgaaataagaattgaaattatataaaattccagaagtgagttgaaagtttcaaaacttgaattaagacttctaaatttgacgtgaaacttttaaaattttgtgtcaaaagcttcaaaatttgtgttgaaactttcaaattttgacttgatatttttaaagtttcatttgaaggtttactttgaatttaaaatttaaattcatttgaacacatacttaaaaaaataaaaaacaaatttggcctataaaattccttgtccagccttgaggccactagcgatgatagtagattagagaaataagtattgtccatcaactttacattgagtttgattgacatccctatatatactaatactaaatattataaatcttcaccccctaaacggatggcagatgtccaaacccacctatcagcatgctgagtcatcaatgccattgttaaacggagttaatgacgtgcacgtgtaaactctctctccccgttattgcttagaaaagactggctcgtcatcttcgggtagtttgccacgccgctgttgccctccttccacccacaccactgttgcttatgggagagttggcaccggagaagtgcatgtggatagggcggtcacccgagttgttgtttcgatggctgttgggaccaattgttgttgctgcaaatcgacaatgttaatagccgttgggagctgcgcgccggtggggaaattgacgagctggtactactatataatcgatttttccggataagaccccttctaagttgcaggtaactaccctcacctgcaaaaattgcacccgataggacagtttaaggagtcgcatatgaaaatgcattatggcttgtggccccttatgaggcctgtctgcgataatagacgtattgtataccgcaggcgggcctcttaagggaccgcatgcgataatgcattttcacatgtgatcccttaagaggctcgcatacaaaaataatattctctttgaaagtcaaatccatcatcctctaatccactcccatctcttctcctcaacacatccactccctctcccccccccccccatctcctcccctctcctctcccctcatcctcctcctctctcccgcttccccctcctcactcttcctaccaatctcatcaatgatggtggcagatctggcatccctgttctcgggtgaggcacatccgccaccctccatcctgggagtgccaatggtgggcttggcggcgaatcaggcgttgtcgtcctcgtcatcgggaagggtgacgatggagtcggtccatcgcccacggaacaagaacgtggtgagaaattgtacacgcatgtcttttaactccgtttaacggtggcacggtaactcaacaagctaacaaatgcgtccggacatataccatgtaagcgacaacatggaaaaataagatctatactacggtcttaagtactccctccgggctggttttactagtcgtttgagctcagttagctgtggatgagaaaatctgtcgttggagcatttttctcacgtacgggacgagattgcccttgtgcattgatgatgactactcgttactccttgaatgcttcgttcccatctcatgtacttaatggcggcatacgtgcatgcaagcaaacgagagaacttgaacaggattacttatgtgggctttgagcacaaaaaaaaaaacaagaagccatagttcctgacatcatgtacgaggctcacgatgaggagtcgatggccagagacaccatgaacgaggcgagcaagaaatagctcgtagtctcggactccatgcacgatgaggccggtgaggaagtggtcgtggttgccgactccatagacaacgctgccgatgagaaagtgcacgtggtcgccgacttaatcaccaagacagaaaaaaaggtgtgcacctatatgtcacgccctgaagtttcccccttttttccttgctttaaaaaaatggttaaataaattgcgcgaagaaattgtttcattaacctagagctaattccataattaataaatgcaattaataatcggaaatagcttgtagaatttttcttgagttccccatgctccaatatattaacaggatttttagtggaattttcagaaccttggaaataattttaacccatttaaaaatgagcatgtgcaattttaaatcccaggaaaaatcctttttctttttctttttcctcctttttttctccctttgcgccgcgggcccatttcttccctcccccacccgccgaagtccatccggcctccccctctccacccgggcgccgacaggtggggcccacctgtcgggttcgcccctaacctccagccggagaggcggcctccctcaaccgccgccgccgaaaccgccacccatcgccgccgcttcccccgcttctctcgcgcccactccgcgctccacgcccccacgtcgccacccccacgccccgcctttccccgctcacgcgcgcgcgcccgcaagagcgggattcaattcgaatccccccactctctctctccatcctccacgtcggcgagaaatccggccgcctcccggtcttgtccaccctccccatgctttcaaaaagcaacctcgcgtcctcctctcacatttccccttttcgcctcccttccccgtgcactctatcgcgccgnnnnnnnnnnnnnnnnnnnnnnnnnnnnnnnnnnnnnnnnnnnnnnnnnnnnnnnnnnnnnnnnnn

SEQ ID NO: 15572 - DNA, 3194 bp, Oryza sativa
  unsure (1)..(3194): unsure at all n locations
nnnnnnnnnnnnnnnnnnnnnnnnnnnnnnnnnnnnnnnnnnnnnnnnnnnnnnnnnnnctagggccgtcgtatagcctccccaccgccgccatcgcgatccccggtgccggccgctgcttgttcgtcgctcgattgccgcgaatcgccaaaggagctccgattccctcgcgtcgccggtgagctctccatttttatccatctccggctggccactttgatcgtcgcgatcgtcctctccatccctaactcctctcctcaccttctttaggtgttgccgccgcccgtccgccgtccgtgtcgccggtcgtcgccgccgcctttgtttccccgcgccggccgccaccgcctcctcggtgaggaccggtctccctcccttcctctctctctctttgtcgcgccgcccaccgcttagcgccgccgctgtccgccgctcaccgtcgtgcgccgccgctcgccgccggtggccgcgccgagccgccgcgcgccatggccgggccggccatgctgtgcccgagcgccatgcccgggctagcctcggtgccgcccgtccccagccgcccgatcggccctcgaccgatcgtggccgtccatcccgtggcccacgtggccagccacgtggtgccacgtcggcgccacgtggtacacccccaccccggccccatggactcggtccacggcggaccaccccctttgagccactgacccgtgggccccacttgtgggcgcctccccctcccctcgctgacgtcagccctgggcatttattgcacaataaataattaaggacttttctttattagtaaaaacacagtttatcttctaaaattcataagtaattcatccgagctccgtttaagtccattcaagtctcagtaaatcaagaaaaatgcaaagaatccattaaaaatggtttggtttcctgtttcagtagtcttatagcatgttttgcttgcgtgctttgtttgtcgcgtagatttcggccgtttcgtcgatccgcggtttctcgaagacgttgctgtggtctcatcagttcgagagcaaggcaagtcatgcaatacgtttgatcatattgtacccaatttaccaatatctcgcatttctgttaaatgttgcattcttttgcaatgtcatgtgggatgggtcctattactcagccgtttattgtttaccatatgccattgataacttgggtatcaaaatgactagatgttggtttaggaaatgcttagccatgcttagttcaactagtacacaaatggggatcacattattacattgactatgaccatgagcatagctttggattggtgccaccgcaatggtgttaggtaaataaaatacactgaatggtgggctgtgggtgcatagttttgctggtcgcacccatggcagttaaggaccggttcacgggaaaccctgagagacttaccgtgcttaccacaagcgggagtgggtaactgcttgatctgaagtatagctcgacccttttctaggcaccggtggcgagggtgggcgtgatggagttgggtcggctggggtgtccggttgtccagctgctggattcaccgcggcacaagaggggaccgcccactgccttttgaggggtgggggtgaaaccttagcgtggtgtggatggttaggggagggttatgcggagggtcttgtcacgatttccccctttgcagtatcatggtgatacttcggggcatggtgacatgtgtggaatcgtgtcttgtggatacagttgtacacctctggccagagtaaaactattcgaatagccgtgcccgcggttatgggcgatcaccagattcaccgtgattagtctcacccctagtttagtttattgaactggtgtagttcaaggtgggtggttgggcctgttgcagcgtggtgtaacattggacagtgatttggttaatactgcttaattactacaattcgttcactgttttcaactactgctttgaaatgcctgctttatgcaaaagaatctctagcctcctttggttatatcctgtatcatacctactcttccggtatgacttgctgagtacagggggtagtactcagtcttgctctcttttcccccacaccagagttgaagttcttctcagttggagtcatctcagagaggttggtttcgtcgctgccgtcaaggtttgcctatggagtggagttgccccgctgctgaagtcaactttccaagtctagctcgttttatcttttccgctgcatttataatcttttatatttttgtaagacgtggatctgtatgtcaacaattgtcgtttgtgtaccctggctggtcctggacagggatttaatgcacattcagcttagaaattctggttcgtgaatttctaggtgtgacacaatctaaccaactaagatggatgcactaaaccaactgagagagtagtagttgcttgtttgaatgctacacccaaccgtatttaatatggacaaaataggaaacaagaaccctgcttaatgacttcttggttttcgaaattgtgtccgaaatgactaataaaaccaacccggagggagtagcatggttttgtattagcttagaagtgaagatttctagtatttagtatttaggattaggcatatctatcagactcacgtaaagttgatggacggtaagcggacttattcctaggagagatcctaggagagatgttcacgattccataaaagcgaagtgcggatcccgcacgatgtgcctggtctacgggccaaaaaccgtgtggtaaccatgaagctgcgtagattagcaatctcgcaatgtttgtaagcatgtttagctgtagattgtagattttagagaaccactgtaacattgtttataccttagggtatctgcatatacattgatttgtggtctgaattcaaagaaaaaaaataatatgtcgatttagataaaaacatggttaaattcatttctggaacagtggcatggcactatgctagaggagaaaattgacatttagccatcctcgggttggggtttcgccagaatgccatcttcgaatgtggtttcgttataatgccatcttcaaacgtccccatcttgccacactggcattttagccaatttcagttatttgcaaatattttccattgttttgcttatttggtttgannnnnnnnnnnnnnnnnnnnnnnnnnnnnnnnnnnnnnnnn

SEQ ID NO: 15573 - DNA, 1781 bp, Oryza sativa
gtcgcagcgccgagcaggggcacaggtgacccacccgttagcaccgggcggcggcggcggctgttcctcaccgacttcgtccgcaacgccgccggcgccggccttttcgaccaggccaagccgttggcggcgcgcggcgggctcctcctcgtgcgcgtcctcccctcgccctcgccggcgccgcagaacgcgctccacctctgcgtctgcaacctgctcaccggcagccacgacgtcctgccccctctacccatggattgcttcgagaaagacggcgccagaggctacgccatcctcacagccgccgaccaccgcgtcagccgcaacccatcaggtggctacaacaccttcttccaggtgctcctcctcagcatccaccatggcaaccatcaggtatacctccacagattctcctcagccgctgccagtgccgccgcggcggcggtcatttttgagatatcctggagcacgcccagaaattgctctgaacaaatccggggctatgtctggggtccctctggaaacagagttgcagctgtcagccatggcggcgcacactggctcttcagttggggagaagaaagcctctacacccttgatgtgagcattgacacagacaacatcggcgcaaccaatatcccaattgatcctccccccactgtcttccaccaatcttggttgtacgtaagcgtcgacgagaggctttcgcttctttatctttgtgacaacaaacttcatatttggaccaagctagaaacacaggagagtggtcgtttgctctggaattgcacccaatcgatttgtgttggcgtgaagatggggttgtttggaacggagtcgctttccactgtgtgcataggggaggagagtggcaccatgctcaccctctacctttcggaccctaacagcgcatatgtgctcgacctcccatctgggtcgattaccagtgtggacgattggaaacgctggttcaactacatgacggctgtgtcctttgagatcaactggcattcattcttcttgactcggctaggggacttctggtacgcatagatgaccagacttttgtaatttgcacttttaatgtgtttaaacgcatgttttgctgtgagattatgactgaatcttgtagaagttgacatattcagctggcaaatgaatcccatctgatctcacttactaatagagtagaatagtagatcttatgcatcttcaggtaagccgtgcatttaagggagtcctttattctgcaaatactgaaccatgttcttttggcgtttattatctaaatgccatgattggaataaagaagtgtccatgtggtttctagttttgttgcccaatctgtgtcaattgtagctgtagttggtgggtttgaaagattgttttcagaattgttccacggtcatcttcacaaatgatatggcaattacatggtttcttcagatatattcatcctgtaaattagttcttcgtatattaaaagagcctcatttctattgcctgcatgtatttcactaaagtcgtaacttgaatcatgattcatgaatatgggacagtttatatgttcaattacactttgctataactacctgggctgctgggcaactgccatgagctacgtcctacagttcctgcatatttaatacaatcaaatttttcttgttactgattctgtggtctagtcaaattatctatcagaagctactccctctgggctgataatacttgtcgttttggacaagggtgaggtcaaactttaaaatctttgattatcaatt

SEQ ID NO: 15574 - DNA, 1609 bp, Oryza sativa
gggcgaattcgagctcggtaccccgcctctaactaagttccttgacctggttacggaatttcacaggagatacttattctctcaaccctcatcagtcaagaacactcgatccacaggcttggtcaagaaccagactggctctgataccaaattgtcaggacccgagcctgaattcacacccaagtctgaacgtttcttcagatttggctagtagctacctatctgggttcggattggaagggaaaatagggaatttaacagtaaattgcaaggaatcgaaagtggtagccgcaagacaagtgaaagatagagttagggtttatattcttgatacccaaatacgtggatttgatcggcttatatggagtgcgccactgctaggatacaaaatagctgagctcgcttcagtctcaagccattcccttttcggccacgattacagaaacaataattactactagcggctcttcagcgttggattcacatcagtgaaccggtatggagcaatctcagccgtccatctatcgcatcccctgttcccccatccaatacttcagagattagcaggttcagaattacagagttctaagttcaaaaaaaaaaagaattacagagttctctgaagtaggagagatggggttcaatatgaacccactgtatgaatagtactacaacgggaggatagaattttagggaattttattgcaaacttgatgtaagaaatggaggatgttagtggagtgccatgtgaaactcttgcaaaataaccttaagcgggtatgtaatttccttcaaattttgtgtttgaaacgatgccaaaatctactgattatttgtgctagctaactcaaccccttatgtcagaatagttacttcagctgctacattgcttatatgaatatcatataaatataaatggagaacgaattgtttttttttcctttttgttgttctgggtggtcatcttgtttatgttgctatcgaatgtcatacatgcctttgtgtcaaagtgccagtttagaaaacagagctagtttgttctttccatggtatatatcctttgtattgtattgttaaatgcagaacataatgtatatcaatttaatgaaaacctaggcgataaacctgccgattgtgaataggattcaacaaacaatttaaggtgaatgaaacacagctgcatggtcaaactatttttcacctgtttcagtgatatccactatagctcccaaaaaatcttgatacaaaatttgtacttgaatattaaaatcagttaaagcagacaaaaataacaggcgaaaaatattggaatcgtcatacttgagaagttctggagatgggcaccaacatttcaagaaattggtggtaccagctattacattggtttcctgaattctgcttctgaatttgtaagataaggtcataagggaatttcacgatcaactgaacgttggaaccaaaacatcacttagttcgcattaagattgaacatggaagtgcacatatgcgaagcactagatcattggcatttgaactttgaaacagtatataaccatacaaagtagtgctgaacaattaaaattgtccgaaaagcatcatcactccaata

SEQ ID NO: 15575 - DNA, 1257 bp, Oryza sativa
  unsure (1)..(1257): unsure at all n locations
nnnnnnnnnnnnnnnnnnnnnnnnnnnnnnnnnnnnnnttgttgagcttactttgtaagtttgggcatatcgaattttgcttaattatcattgaaaccttgttttcatcctagttttgtagtttagtttttaaatatgtccatattacagtatcactccacttcagttcaatgtcatgtatattagcatgccatgttttcgatgatgttgtaggtttatatcaatcaattattagcttaaagaggatgatatacagaattctattctgtggaccaaacggaaccttgatggtttgaggacagtcccttcaatgatatacaaatcaaatattttcttgtgtccttgagaaatttggaagacgcactgttaaaatccatgtcttttttgctatgcatggctgatgtggactctaatttctcctcggttttgaacttttgatgcggactctaattgcaagatccttttgaaaatcgtggtttttcttccacaatgtggttttgactaaataaacgttcaaagtttaaaaaaaaagccctcatgacttgacttgtgcatttttgtatcaacctgaatcagctcagcatcttttcttggtttgcaacattgcataagtttgtagggttttagaagccgtgcagagcactacaacagtgcctacaatccgtctgttggatgcacggcctttatgtgatcattctaatggagtaatggccttccattgctatatctggaacatatagataacaagtcttgttttgagtgcaaaaactgtcactttgatgtgatcttttgaatttgtacaaattttaatagtgggcaggtttaagcaaggatgaagctgctgctgtgtaagcaaaggagggtaacttctgaatatgactctgaacgttggtgtgaagttgcaacaacgggaagatggcgagtatgttgaagaaaactgatgcagtcatgaagatcatatttaatcttttctactaccagttgttgtcgatggcttcttcattctttgttgctgatctatcgctgtttgtcaccgactcgatacttcccttttagttttaggttgactaaggctaggtttgtcaccgactcgatacttcccttttagttttaggttgactaaggctagcttaagcttgggtattttgtctgtatgatcacctgctttgctttccctgttcccaaatgtactctgaaaataagaactatgttatttctnnnnnnnnnnnnnnnnnnnnnnnnnnnnnnnnnnnnnnn

SEQ ID NO: 15576 - DNA, 6639 bp, Oryza sativa
  unsure (1)..(6639): unsure at all n locations
gaggcattattactaagttatatatatacatgagttccataatgtaaacatattgtgcacaattttttcttactgaagagggaacaaaatgtcagagctgagtaagcagcgctagctgttttctaattcttcagagctgccattacagatccaagaattaaacataagtaacaataaactcagagcagatagatatatacaaattaaaatattaatgttgcgctatgctatacatgctggcatttgctactaacagctggtttgcatgtataattttttttcttagctaggtaacgtagatatatgctacgcgcatttttgtggttaatttcttttttttcttgaaactttttatttaatttgtggttaatttatccaacgccaactagcttattagtgtatatcacatgacaatatgacatcaccacatggcttgcatgcgccgtccaactagctttgcatatataaaccggcctggctgcacgtgattatctgacagtgtcaacacaatttctgacagtagttagctagcttgcaacaagctgtagtgctgtgcttgctagctgtgtgttaacctcaagcccgctcctaacttgtgtagcaagcttacatatacaagacaagaatagaaaattgattgtgtgctttgcacctgatagagatctactatctctcatttgttttccggcctgcagtgcaccatttcttatcattggcatcagtctaatccaaccaatgttgcaatttgctccgtgaaataattagtgacagtacaatatataatggtgcaaagtgcaacatttgcacaaaaaaatatatgatcacaatatgtatagagaactaacaggagaagtctcataaataaatggctcccaaacatgtatgtgccacaacatatcaacaatcagtagtagttagcaccaacaaattaattaacaaaacaaacacgacctttgtatatacaaaagaaacctattaagcaaacggaatatatatagacgaatgatctcgctagctacctaggaagaactaaataatgaagcagtcaacaaaaataaattgcacacacatatattcctaaatctcgatgatgtccatgttcagtacgtaattcagtaatgcagtagccaagcacaaaaattctcagaacgcagcagcatgcaatatatatgtatatgtgatcattactgtcgtgatatgtaatgatccccataattctctatcttgtactgcggcacgccaaggggattctgctgcgtaagcccagccatcgccgacttcgataaacccttcagcttgttgctgctcggcagtagagtaccaaaattcgggacagcaatgacattttctagggctttcaccattgctgcctgctgctgctgcaagttgtagtagctgcttccaattccatgggctcctccagctccaggcgtaatattccaagaagagacgtgctgctgcagaggagcactatagttgctgctgctgctgctgctgcttttgttgatcaagctgtagtagtttggctgctgctggaagctaacggcagtagtattagtcgtcgtcgtacttgcagaaacggaataaaccgcgttgttgttgttgggcggcgccgacaagatgttggaagagttgctgacgaagtagatgctggggtcaatgatgtcgtctagctgaaagaagtcatcgccgccgtcgatgtcgccggcttgaacgacggagctgccgctgttgggggtttcggcagagtactgatccacggctgcatactgtggttgctgctgctggttgttgatggcttcgtctccctgcttcttgtggaagaccttgcacacaacccattcgtccttgggattcagacgaaggtttgggtggtggttgtgaaggttggcgtgnaaacggaactcgtgcatcacccagttggtcttggtgcccttgggagccctccccatgtagaacaccagcgtcttcttcatcccaaccagctgcttcttcttgttgctgctgcctccatagctgcttgtattaacagctgcaggctgcctgaagatctccctgtccttgccggtggccttccagtagccctccttggtggcccggttggttcgcatgccagttgggtatttcatgtccttgtggctgaagaagtaccattctttttcccccatcttcgccttgccttcatcaaattaatatgaaaaacaagcatattaacatcaagatctaattaactacttgtgcatctaaatataagcttttggatcgaagaagaaaagaaaaacaaatttgacttacttggaagatcccatggctcgcacttgttgaggtcgacctcgccgatgggcaaggaggtgaagctagggttgagcaacttctgcaggaggtagcttaagattacctcagcgtccgtcgggtgaaacctgaagcctggaggcaagaacaagcctccatcttgctctaatttcacaagggatgtagtagactccaccatgctagctagctagcttgctccctagcttgaattgaagctagactgaagatggaggaagcactagctctagctagaggagaaggagaggaggagatagcttggtggcacaagcaagaaaggtggagacgacgcgcgatgaatgggaaatggaacagaaatgaaggggacaaagccagcaagttttataatgctttgagaccttttccatggttttgaggggaaggccacaaaaatcttggttagcaaggaagacaagtcctcactcggtttcattatgataaagaattaatatatgtactatatataaagtgtggctcttgccaaactaagtattttgtggccgtcaaattaatcagatttatatatactacatgttgtgcttaattagatccccatctatctatattattattatattcttcttctataatcttataatccgttttgccagataatgctggtgacagctacggctaggaaccgacctaaaagaaactaactgtccggctggaaggcttgtgtggtacgattgaggactacttaattaatttccatgtatagtgctcagaaagatacaaatcactgttctcatctgctcatggtataatagcatgccgaaatttgttacagatgttcaaattaaatttatggccttgtttagttacaaactttttcttcaaactttcaactttttcatcatatcaaaactttcctacatacataggctgtgtttaattcacacaaaaattggaagtttggttgaaattggaacgatgtgacgaaaaagttggaaatttatgtgtgaaggagagttttgatgtgatggaaaagttggaagtttgaagaattattttggactaaacacggtcataaacttccaacttttccatcacatcgttccaatttcaactaaacttttaattttgacgtgaactaaacacaccctatgtaatttgccagtgaacatcgtaaaactattacaaccatagaacttcctaaagctggttatttgtttttataggaaatagtgagggaggtccacagtaattttttctttatttaagattgaaattcgcttactggaaaattcaacctatatataggacctagagaggtgctacttgagcattggaaccgttaggacaacccctttcgcaagctggttattttttgagcaccttaaccactattttattatttatgatctaattggaaagagaaactacgttgaaataacggttttgactctcgaacccgcacatattacttggcttaaggccgagtttagttcccaactttttcttcaaacttctaacttttccatcacatcaaaacttttctacacacacaaactttcaacttttccgtcacatcgtttcaattttaaccaaacatccaattttcccgtgaactaaacacacccttagtttgctcgaatgaggcatctcttctcccattccctccaaatgtactcatgtccatgagtacatttttgtcttccaaaattttcattctcccccgccccacaattttcaaactcttaacatttcatcagtcaagtacattgataccatatgtcatattctttttcactccagcatcggtttagaaacttgtctgtctatcattcttttttttaaaaaaaaagattctctctaattgagccaaaaataatataataatagttatagacttgtggtgtcctctcataaattatcagtttttaaagatgttctacaggctatagatatgatacatttttttaatgttcattagtaaatactccctcctttcaaaagtctaagtcatatttctttttacaccaagatgaaggtgtagttaattcattcatcatgtgacaaaatcaatgaacatgcaacccataagcactaaaatgactttttgggttctgatcaagaatttaatatagcacatagtgactacaaatagaacttagacttttgaaaaaatcaaagaatgaaataggacttacacttttacatttttggaaggagggagtagataaattttaagtgtcttgttgcaaaatttgactaatataattgtttttgtctttttcttttttagaaagagtttgtgcaggtctagcaagttgcaagaagtttttagatgactagctaggtcgcaattgccatcagctccaatgcacaggttagctggcctttccggacgggtggtgtactgtctttcttctcgtgtgtgtgtgtgtgtaatttccatgcatttatatcttgatctctttttgacattaattaattgctagtattagagcgccgagtcagatcctactatgttttatccgtagagtatgtacagctagcgtcgaggaagggtcgtcgtcatgggggagtcaataatcacatgcatgcatggtcaaagaaagaatctgcatgcaatcaaataaatgacggctgttcatacttgatacctgcactgcagcctgcaggccatatataagctagcagctgtagtatccaagttggtcagctcttagatcatgagagagtttcacttctaggttcctctaagtagagtagttcttttttttaaagaattacacagtacaacgcaaacacgcggaccctacccctatgagtatctttgaaaactgggccgataaatcctagagagattaatgaagtcaccacagacgcctcactgtcgacggatacgtcacctaccactgaaagcacaacgccaatttggtgcacttccaataacgtcgacagcttctgttgatattttcttatacttcctccgtttcacaatgtaagtcattctaacattttccacattcatattgatattaatgaaactagatagatatatgtgtctagattcattaacaacaatataaatttagaaaatgctagaatgacttatattgtgaaacggagggagtaacttttatttcttcttaatatattttgatggcctcgatttccaaggaaaaaaaataagtttcacttctcataagctgcagtccctacagttaattatacggacggctagcggcctagcgcgcacgtgctaatatatgaaatgcacgtgcagatgccctcgatcattttcagagcacacaaatgtgcggtccattttatctgttaggcgcgcaagttgcattttggaggctggatgatcaagtcgaaacctgacatatataatttcttgaccgctgacttatataattaggtaaacaactcatatgctccaacttaacgtgcgtacggttcgtccaaaagatagtacaattaatacccctagattatttgacaaaaatgtttattactaattggtttatccaaatattagtaagtttcttgtttactgatatttcagtaatgcaacttagttgaccagttattaacctctgtcttaaggagctacttcctctgtttcatattataagattttctagcattgcccacattcatatatatgctagacatatatacatatatatgaatgtgggtaatactagtaagtcttataatatgaaacagagagagtacctatttttatttatactaaaaatatactaaaagtgattcttttcatgatgtatatgttaattctgaaattcataattaataaatatcgagttgtacttaatttgtaatcttagttttgtatcttttccatatacattttttagtaagtttgaaattttagaatctataaaaacataaagataggtttttaacatggcacacgatgttaatatataatagtaataatggggatgttcagattgtagccaaaataaaccttaccaatgccaaaatttagtaaattggtaatattaccaaaattttggcaggattatttcttatgcatttaccaaaatttggcaagaaactaaatgtatacatatttttagaaacttaaaaaaaaaactatgatttaaaatggcatcaatcggaacaactccaatatgatcatctgatcaacaactagatcttcttattaatgtgaagctatagagtgcccaacaaaatagattcttaatactcaacggataattgaaacacggagtatatacgatgtatttgacatagtaatccgtatgtgaaccggacagctggctcatgcgagatctaacacgtcatcagctgctagatgtatga

SEQ ID NO: 15577 - DNA, 2009 bp, Oryza sativa
  unsure (1)..(2009): unsure at all n locations
nnnnnnnnnnnnnnnnnnnnnnnnnnnnnnnnnnntagttttgtatcttttccatatacattttttagtaagtttgaaattttagaatctataaaaacataaagataggtttttaacatggcacacgatgttaatatataatagtaataatggggatgttcagattgtagccaaaataaaccttaccaatgccaaaatttagtaaattggtaatattaccaaaattttggcaggattatttcttatgcatttaccaaaatttggcaagaaactaaatgtatacatatttttagaaacttaaaaaaaaaactatgatttaaaatggcatcaatcggaacaactccaatatgatcatctgatcaacaactagatcttcttattaatgtgaagctatagagtgcccaacaaaatagattcttaatactcaacggataattgaaacacggagtatatacgatgtatttgacatagtaatccgtatgtgaaccggacagctggctcatgcgagatctaacacgtcatcagctgctagatgtatgacctttggatagatgcaagaaaagtattccatgcctagctagctgtaccacactagttaatgaagaaccccatgcatgcatttatcttcttttctttagaatcagatctaaacaaaaagaatctgctcgactagtctcaagaaagctaaatactataatatatgctacatgattctagtatctgctaatactagcaaacagctaaactgctaaagaatactagaaagaaggggtctccgaaatgtggttaattagttaatttctggcccagcccaggaagccaggagtacgtacaaactgtccagaagccaagaaaatctgggaccttgggcattacggcccatgtaatttctggcccagttcgctaaaaaaggccagtactctagatcagagtattgggagttcacaatggttattaactacactagccactaggcaacaaattattaatgtctagctagtggattaattactgttagttacttccagaaacagaatcaaccgtacgtcaatgtcacggataaacttgtgacgtggtgccacacgaagatcctaataagctcaagccccatacatatttcaattaacttttcgtaagcatgcatgcttacagataatctatcatatgcatgcttaaggcatcatgactttgccaccctgattttggacgcacatacccttccttcttatctactctcatctgatcgtcatcaccttttaggcactactgcatgaattgttatcctatcctaatccttcacctaaactagtgcacaagcaccaattataagcagcctctctaacatgcatgtgtgagcgtgacttaatcatcatgctttagctagctgtttcttggtgattgcttactaattaatccaatctatgggagagattgaaggttgttgctagctagctagagccgtagaggtagaccaggacacacgatgaattgttagggtcagaagaataaacaaatcgctgtctccaatagggagacgtggttaagcaagtggagagaatcaacttagtttaatttgggcttatctagtgggaagatgtcatgctatttgcacgcttgatcaaccactccgttgagcaacgtgctctgccgccgtctttccgttgtccttgaacgacataaacaatgctgttttgattgtttaattaggtcgctgatgacgcgtgttaattaagtaggcgccattgcgttttcggatattggtctagcaatctgaagcacagttcttcctcagtactgaattgtggacaagacgaccattaatttgtcattttggttggagtcgtagagattagttgatgaagcagctggtttgtcctgaagtatttgacaaattgagcaagaatttagtcagtattgttgtttgaaagtacaattgatcagcgtactnnnnnnnnnnnnnnnnnnnnnnnnnnnnnnnnnnnnnnnnnnnnnnnnnnnnnnnnnnnnnn

SEQ ID NO: 15578 - DNA, 4261 bp, Oryza sativa
tagtcctttgcatagtacaagaccaattatatatcagcacattcagacaagaacaaattgtttaatttgtaaggtccaatgaatcaacgacaaagtagcatgtttctttcgtgtgcttgataccagaataattaagaaacatgcataaagattatcatataaattggcttgagtactagcttgcacgatattaccatttataatttacattcttgtacatgaaaatgaaaacaaaaaaaaactcacaaattaatgccataggaagaaatctgaatctttccttgcatgggttacatcaagaattccgtctgtttgtctatctgtcatgcaactcctcaaaataaatccaaatggaacaatcagtatcttcctctctgaatctgtagtttcattcgttgaaattaattcacctctcttcagatcgatcggtaaacggatctagacgcctactagctactgcatctgcagatgattgttcagcagtagctgctggttcagaggaaatggatggctcaacatattgccgttctgaaactgaaaaccagtcgcagtctctgaaagctgctggttgcagtaacctcctccaaaaccactgccccttgaatcacttggcagcagcagcggtttcttggcaacatgcaaaaagtcactgctgctgctgctgctgccatcatcaaaagaagttgcactacacgccatcattctcttcctccttaggccattaacattataattgttaacgtaaccatcgtgatgatctaggcgtgactcgaaggcgtgtggcatgttgttgttgatgttatagtttagtgtttggtttggatatattagagggctgggaggagcaggaagctcagcgatggcgtcggatgagccgtcgaggagaaactgcgagagcgcggcgcagtcgaggttgttgaggagatcggtgagggagcatgacttgctcatgctcatcgccgtcatgggctggaaatctgactgttggttgttcatgtcaggtggagcaggaggttgttgagaggaagagttgttgtcatggatgtcttcaagctgttcatcgacggttgatccctcgggttcttggtcgtgttggtcagaggaattgaagtcgttgctcttcttgtggattctgcacagcacccagtcgtccagctgatgaacaatatcacaaatgcagtaaacaataattagaagtgtgcaaacttgctttatttatttttaaaataaagaataaaacacaagctcaatcaacatcaacaaatttgactttgtagagtgagttaactaagagcaacatgcacgtttgcttccttcaatatgccaattcaaacaacgacgtagctttcaaagaagacgtacgacgaagagaaaaacaaattaataatgaactaaaattaagtaattaaatgaatctcaccctcatggtcatggatgatgctctacgctgctttgtggtggtggtgttgttagctgatgtgcctgtgaggcgatactcgtgcatgatccagtcggtcttgacgcccttggggggcttgcccttgtagaagactagggccttcttgacgccgatgttgtcgctcgtcggagttgacaagatggacttgtcggtgccggtggccttccagtaccccgagccggcggcgcggttggggcgtgccccgttggggtacttgcggtccctcgggctgaagaagtaccattcgttctcgccgaacagcgccttacctgcaacattccatatccattttcaaagcccaaaattaaatttggtcagtttgaaggcattaatttgatcgagtttaattgatacatggatagtttatatatgtatggtgattagttagttagttaccaggaaggtcccatgggttgcacttgtagatgttgacctcggcgatgattggcacggggcacttgatggaggcggcctggttcatgaggtagtgaacgatgagctcctcgtcggtggggtggaagcggaagcctggtggaagggcaggcatggcgccgccgctgctcggcatgctcagctccttcaatcggctcgcctagctagattttttttctttttttaaaaaaaaacaaacaaacagaataacagatggtgtttggtcagcgtgagctgaaggaagaagatgacgacctggctagcttagattacgtaggaggaaaactggcactagtgaaggaaggaagctaataagctaaggaagaggaaggattgaaatttttgagatggagggggtagggctctcttttatagacgccatgggcttggctcatcttcttgctgttcgggagaaagagaggtgggtgcatggatggattactacaaagcaattgattaatgagagctaattaactaggggcacaatagacaattaactagttattagtaggtggcgtggatgtgagtaccaaagactggaccacatttgacacttaaccatgcatgtcagattaaataacttgaaatttcagcgtccaagcgatttagtcgtaagttcagtttgacatagggttgtactacttgctacctcctttgatcgttgcattttttgtcaccggattactatttatttgcaaagtttcactatttatcttttttcaaaaaagaatgacattgttcttagtactctctatggcttcatatgttattgaagttagtagcaaataattcaaaaagtcaaatctaactcttgtaaaattaatcagtggcaaatgaaggtaatacaatgaaagagccatacaaatatatatttcaatcgtcttctatcttcattccaaaataaatttattttataatatgaatatagatacattcaaaataaatttattataaggcgaagataagataccatgagaagagaatatcgtcaaaccattaaccatggcatgatatactaaaacaaatattactccgcgtacgtagtagtaccacccaaggacaattggtaatgcaagaagctaatgacctgtccttggcgcatgcatatatacacagtaattataattgtacgtacgtggctccacgtcagctagctaccagtgggcaggggggaccacaacgtacgtgtggtgtggataaactcatgcatatggaagcaaaacaaatggatcgatcggctttaatttgttcttcacatactgtactaaagacgatgacgacacatgcatccagtagtacatggatttatgttgagccgtccaggtgtcaactacgcattgccgccaatgatatgtgcaccgatatgatggttccgtcttggcagcttgtgcgcgtggcacgctttcgactctttcttcttttgttaggccgaccggtgggccccacctacctcgtggaaaccacctgcatcgtcactccatgggctctaccctcgcttacactagacgacaatttggttgacgattaattaaagggttaattggatccatactactttaattttgcccattcattagatctatgctattatcatcatgtttgatattatcatatagactaaaatatctctagacgtgagatccacatgctagtcatatcttctttctccatcctcccattttttctcttatctgccggacgacacaacgcctatatctgcatctcgtcctcctctcgatctccccacgccccgtccgctagagaccaaggcctcgccctctctctccatctcatgtcctcctcctcccgatctcatcgtgctccgctcacttgctagagaccaaggcctcggcctcggcctcaaccttcaggacctcggatctagaggatgaaaggcggaagcatgctggccgtcgaagctctggtgccccttgcaacaagcatcaggatgacgacgttgatcagggagccgcgagcaaggagaagggcggagctctggtgcctcttcagacgagtagcaggatggccggctagggagcgatgagcaaggagaagtgcaccggggaggggggatagtagtggtggtggattgtcatggccaaagctcctccatgcggtttgcggcacctggcgcaccaaagaatttactatttgccatcttttcaaaatgtacatgcccaactctcccaaatgttcacttgatttgccatccggtcccatatgtcagcctccttccacgtttggacaaatgagatgtgggatcaggtgatgaaggaggctgacatgtgagaccgggtagaaaatgtgaatgaaaattatggagagtggcatttgggcttgtgcattttgggaggatggcaaatagtaaat

SEQ ID NO: 15579 - DNA, 5462 bp, Oryza sativa
  unsure (1)..(5462): unsure at all n locations
nnnnnnnnnnnnnnnnnnnnnnnnnnnnnnnnnnnnnnagtagtggtggtggatcgtcatggtttaagctcctccatgcggcttgcggcacctggcgcaccaaagaatttactatttgccatcttttcaaaatgtacatgcccaactctcccaaatgttcacttgattcgccatccggtcccatatgctagcctccttccacgtttggacaaatgagatgtgggatcaggtgatgaaggaggctgacatgtgagaccgggtagaaaatgtgaatgaaaattatggagagtggcatttgggcttgtgcattttgcgaggatggcaaatagtaaattctccccctgacgcgccgatgccaagcaacaggacggcggtgttgcccagggagcacacacgcctaatccgagtgctaggagcacgaatatttccatgcgacacatcatcttggcctaaaaggaacatcgtcttggcgacaagtgtgatgacggcttccgtaacgaatgttaccgccggctgcatccatgccggcatgctcgtgtcctctactcactgttgcgctctcttgccggttgaggaatggggatgagacagtgtggtagagaagatgagagaaatcatggagtgacatggttcaaattttataaatttccagtgacacttaaccaatatctcgaattgtaatagcacttttttgaattagcaaaattgtaatggcatggatcaaattaaccattaattaaagcgcatgcatgtatcatatcatgatgtgtagtactccatccggcccaaaataacttaatctaggatagaatgtgatatatcctggaataacaaatttggacaagtgttatcgagattcgttatcctaaaatatgtcgtattttatccaagattgagttattttttttagatgtagggtgtactctcttcataaggtaccctgcactaaagccaaaacaaacagatgaagcacgccttgactttggtgtgttcagttcacgttaaaattggaagtttggttgaaattggaacgatgtgacggaaaacttgaaagtttgtatgtgtagaaaagttttgatgtaatggaaaagttgaaagtttaaagaaaaattttggagctaaactcggcctaagacgacgacgaatgctccaaattgacaagatcatgatcgatcgaccgatatggatgatcctgctgtgcacatgcatgcagcaaattaatgcggcatgtgccatggatatatagagtatagaccagccgcctgaaaaatgcacgtgagtaacgttgataaagtatctcccacgcggccggagctaactagctagatgaggtacacgtacgcgcgatggacaacttcaataccaatactggtactttgcaattttttatatatatgaaaataaatttatttttcattcatctaatacatactccctccttcccagtatagtggacgtttttaactttgtactttcaacgtttgactattcgttttatttgaaaaattagtgcaaatataaaaaagataagtcatatgtaaagtacttttgataataaagcaattgacaaacaaaataaataataattccaaaattttttgaataagacgaatgatcaaaaattataaaaaaaactcaaaaagacaagtaatatgggacggaggtagtaccaatatatttttgaaaaaactcaagtttaaaacatatcgatcaattaggaggagacagaaagtacagcgtgtggctgctcaaatggaccggtcataaatctaaatctaacagctagaaaggagtcaaagaattcggcccacgtgtgagtgtgtgcattgctggctgacggcccaagtgacgaaatgtgtgaaagggacgtagtcctacatacgtacgtcgtagtaccaaattaattaataacgcatctaataattttaccgagtgaatactactcctacgtaccagtataattcttccttatttcatattcaccactgatggctatgttctaccagtacaattgacattctaccactggtggctgccgatatatataaaaacaggctagcgagttgggatgaaaaaggttcgaaaatttttctactctagatgttcacatttgtacttagtattgaggtggttagttaaatgaacgttttttttttcagtcaggtgttttagatcatttttcttttgcctaatcgctattttttgttttggtactacttatagttaccaattaaataattgttgattattgtagttctatcggagagtgaagtatacaattatttgtattattaccaattgatgacaatcgatgaaaaggttctatatgcagattggaatatttggaagcatcgaaatggttatattaatttttgataatgttgcaccctcagttttctcttgaatgacattctttaagaatgacttatcccatcttgtttttttgtttaagtttagattaaatatcagcgtctatctcctggataagtcagttgtagtaccttttattttaacctcctttttataatatatttactatgggggcttcctcatagtgctttcataaaaaaaagatgatagatttattatttttaaaaacaataagctacatctctttgttgatttgagaaggccagttagaattgtttttatattccgataaacattgttaccgtattcgctccgatctatattcactctattttagtattcaataatattcgattccgtttttataaccgtggttttcaattctgagaagaaatggaaacgaaaatggtagagctagttttctagctgttttcattcctaccagtgattatatatatataatcttaattaatttacttacaaaataattactagtcgcaggcacatctggggacgtatgacgtgcaagggctctaggcgtcaaagggctggtacctttcttccttgcccgtgcggatggaacggattatctactaccggagtacttgactaaaacaaacatcagatccatatagctttatagttggccttattacacgtcacgatcttgacacccagttcaacaatcctctactcatttctaccaagaaattctagcttgtgataagtacctataccaatccagtttgcatgcgtccatattagactctcctgtcaaaagatgttcgttcatatagatcgatagctatgtcaactgtgtattatatactagtatatcattagcaaaagtcgtacacaaagcaagtaaagtcatactgtagggcttttttgtcaggcgctatacaaattaattgaaattaatgttgaagggtcttaaaatgcaactgtactgcattcagatatgcacgcatatccgttcatgcaaatatatctatgttgacgtcttaaaatcgcacgtataataagttatttatgatatccatccatgtacggcccgccgtgacgccgccgccgcacgccgcagcaacgcacgccgccgcccgcgcaaccggctgtctccaaacaaatttagggttagtgtcttagggaattggggatttttggaggaggggatttttgtttggaaatgggctcagttgcggcccaagtggaatgcgggccgagtggaaagggggaggggagtggaaaatttaggcccaatacaacagaaatggtaaaacaaggcccaaataagtagcttctttatctttttgcatacatatatgaactatagagtatatatacctattttttgtccaaaaatctttggtatacatctgaatacccttgaattatagctgggcctgcccctgcacgtacctattaatcatgtgactcatttttgcacaaaattactacgattcaaaagtactacatgggtgcaaagcggtcggtttaacaagaaacctctttctcgttaaaaaagaaaaacctctttctcaacctactagaccaacttaaatttctaggcctactaagcctacttagattcattgtgctatcaacttattgggccattcttttcaggatacctatttagttattgggccttaacgttgagccaatatctgctgtaatcgaccctgctcatgctgttatgcagataaattaattagctgcttaattaatcacttacatccgaggccatgtagtagaaactggtcgcaacgtagagctcgtcctgcccagcgccaccgccgccgttccacactccgttgaagctgcagttgttggtttcgcagggcgcgtccaggttgagtgccttcaccacctcatctctgcacttgtggtagtctgctccttgtggcgcgccgttgcatcatactgctccccgttataaatgtacttacctttaatattccaaggattggcacaattaaaccacttgattaattataattagaaatgtagtaaacaatggattaattacatactccctctatttattataagtcactttgatttttttagtcaaattttttaaaagttcgaccaaatttatatacaaatacaataatatttatagcaccaaatcaattttattaaatctaaaattgaatatattttgatagtttacttattttatgttaaaaatattattatatttttttataaatttagtaaaaactaaagaaatttgacttagaaaaaaataaaacgacttataatataaaagagatgtatttcgtaaaacggaggtattatatatgatgcatcttgaagaaaaaagatgtgtaaacaaatctcaaggaacaagctagtaccgcaaaatccgcgcagcatgcagttgctaaatgtcccattcttcctttttaggatctccacgcgagaagcccgagcaccatagtgcaggtaactgcagattgatgattattgatcttagctagtaactacagtgataaaaagtatgcataattccttcccatagcttcagttatatattcactagagaactgttcaacaacgtagcagactgaggattgatcttagttaactgaacgttacactcttgaaaaccttattattcagctgctggtagtagagattgagatgtaaaatgagatcgatctgataaaaaaaataaaaacgaattaagttactgacctgtgcacataaacattgtaatctcttcctttaagatactcctttataatgtaaggatcctgcccatcgggcatttctggagcattagcagctgtgcctgatgagatggcataggccatttgcacggatccgcctccgagatcaatcacacccacagttttggagtagtcacctcctaatctatccaacaaatagttaagtgcaacccacatgtaagatcattcttgagatccactaagaacattaatccagtttggattgtattggaacttggtcttggtgtggacaacatctctaacctgtattatgaatcaaattgctgctagtgatatgaaggtgtttaatttgtatggtacgattattctgaaagtatacttaccgcttcaaga

SEQ ID NO: 15580 - DNA, 1668 bp, Oryza sativa
cagactgaagattgatcttacttaactgaacgttacactcgtgaaatctttatgattcagctggtgctagtatagattgagatgtaaaatgagatcgatctgatcaaaaaaataaaaccgaattaagctactgacctgtgcacataaacattgtaatctcttcctttaagatactcctttataatgtaaggatcctgcccatcgggcatttctggagcattagcagctgtgcctgatgagatggcatatgccatttgcacggatccgcctccgagatcaatcacacccacagttttggagtagtcacctcctaatctatccaacaaatagttaagtgcaacccacatgtaagatcattcttgagatccactaagaacattaatccagtttggattgtattggaacttggtcttggtgtggacaacatctctaacctgtattatgaatcaaattgctgctagtgatatgaaggtgtttaatttgtatggtacgattattctgaaagtatacttaccgcttcaagaatctagtttgtcttgtcatctccaataagtctgagtccagcagttgcctacatgttcgattggcaagttaaaaggtttttttgtgagtaatatttgtttcaatttttctattttaatttgttcaaggaggaaacatatttttacaacgttacggtaggaaaatggtttcaactcgagtgatactccctccgttcgctcttacaaggcatattctaactctacaaatgactttaagactaaatttgaccattaatttctgataatatatattcatgataagcatgaaactaatattatagtagtatatgaaaagctctttgaaatccagatctagtcttataaaactgaacggtggaagtattctaacttatgggtaaaggatataagcaggttcataatcctaataaatcaaatctgctcacgagcgacatcatcggatttcatgtaatccgtaaaaaaactgatagaaaccaatgaaatctggataaattttatcaacaaaataaaattcactttaaactttttaaaaaattgatcgaaaaatcaagtggtttgtgtttacgacctggtcaaaaagttcggatttcgcgagatctaaatcagatttaattgaaattgggaaccctggatacaagagactacttcgtcacatggtccaatatttttttcttgtctgtattgatgttgttctcaagtagttgcaccaatctcaaaaccaggggccaacttaaatatttgattaaagtcataaacgtctactatatctatcgttttagaaaagcaaattagatgaaaagcaaattaaattttgttaagtacggtaccccaagttcaaggggagttttgttcataagccagatagggatagcgtggttggccttgtcaagcagaggcattatggattttgctgcctcttgcggccgcccagcgtacgagctcagcccaggatccacctgcaaccaacacaaaaattatgtttatatatctttattagtagtagtagtaattaagtagtaggaggataataattatctttagcagttaataagtactctcaccaattgataatacttgttattttgaacaaacatgatgtcaaactttaaaatctttgattacgaataatttttaaacactggtggag

SEQ ID NO: 15581 - DNA, 2151 bp, Oryza sativa
ccctctttttggaaaaaatttagaagcttgctcgggcagctggaggaggaagaaaacatatatatatatatataagggtgggactttagtcccggttggtgttgccaaccggggctaaagatcccggggatctttagccccggttggtaacaccaaccgggactaaagtcccacccttatatatatatatatatgttttcttcctcctccagctgcccgagcaagcttctaaattttttcaaaaaagaggggaggtcatgccaaaatttctagtgaatttattttggtgattacatacaaatcggaggtgcctaaaaggtttgcaacttcatcctccatcctccaaggatcaatttcaagggtatctacgaactataccagctggacaccctcgacgtctctattatgagttgctggattttgtaagtatcgttcagttagatttcttattacgtttcctttaattaattaggtccttgtatataagtagactatatataatatatactcccttttattgttgtagaatggagattcaaagggcccgacggcagggggttttcgatactggattcatcgaccctcggaaagtaaacgtcgcaatgctcgaccagtatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacctggagacctgcaccgtcaacgtatatgactcaatggataaaaaagagtctacgtttgacaaggttttcgaacttatagacaggtactgtcataagttcctatgttaattaagaatcttgttatagttaattgctactacgaatcatagctttaaactccatgtagggcttggtatcggttccgtcatttggtccgcagcaaatggagaaaaagacttaggcggaagttcaattttcttgtgagtacacatgctctacatttatatttctccgattcaaatacatacaagtgtatattaattagatctctcgtcgtttgtcatttatttatagtgcgcaaagcaaaagcagggaactaacttgtgcggctactacgtgtgcgagtattgccactgccttgcagaccaaatcatcaccacaagagagctcaatgtacgtacaaataaattcaaaatttcattacgtatcgatttgttgtttaattactaattaatttcatatattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttagcttctaagatatcaactactactacgtcgaaatcgtagctagctaggacatataaaggattgtaattaatacatgtctatgtttctatatgcatgtgtacacatttctataatgtaaatatatattttggtcatatatatatatacatatgcatttgcataacatatatatgtataaatacatatatattatgcatgtacatatgtattgaaacatatataaatataatatatatatatatatatatatatatatatatatatatatatatatatatatatatatagtaaatttgtttggtgctccatggtgcccgggcaccattgttgaaattgagtacatacccaattcaaatgagtatgaaactttttcaattcaaatgagtatatatatatatatatatatatatatatatatcgtcatataaatacttctttttgacgaaaaaagataaagccagtctacgaaaaatacatggattggttgggccaaaattttcaaaagccataaaagatatacaatgaaagagagaaaagtgagtttgtgtatcttgtggatcatagttaaccttgaaaactctatggagcaatcaaataacatattggtaaagaatattcgaagaacttacgaagcactctacaatatgcatagacacaccgtgcagtatagctaa

SEQ ID NO: 15582 - DNA, 899 bp, Oryza sativa
  unsure (1)..(899): unsure at all n locations
caggtttgggcgcaactgcgactcngcntccgccttcaagccgcaaacaccaaatatcccccggtatggtttcctggtggctgcatgaacacgagcttcataacaaacaagggaagaaggtgtttgacgctagactcttcctcttctattggctgatttggaaagaaagaaatgggagggtcttcgaaggcgtttccaacttccaagacagcaaccgaggtggcagaagccatgacagaggagtggtggacttggagagatgctggtttaggtgctaggatcgagtctgtatagtcctcctgtggtattagacttggcagtggcatgtgtatagctatgttgtgggtcttcttccctgtggtacttagctcagtctccgctctgggcttggcgatggcccgactctctgctccctaggggagcgttagccttctccgtcaagaaccgttattgttgtaactgataatcttttctctcattttaatacaatttcgtcggcttccgctggcccagcgaaaaatcttgcttcctctccagaagttcactttatcttagtaatggttgccccttgttctctaattgatcagacaaaccaacaaaaagttaactatcctaactctcttcctttcaaatatattccattatacttgaacgcatgtattggcgctcaaatcttttacatgttcgcttggatcaaatatcaatcataaagggttagaaataactagttgttgttagtgctatctatattcaaattttaattgtttgtcaaatatgttgattattttccaaattatagcaacatagattaaaagaagagtctatccacattagtatttcttgaattgttacgacttnnnnnnnnnnnnnnnnnnnnnnnnnnnnnnnnnnnnnnnnnn

SEQ ID NO: 15583 - DNA, 1396 bp, Oryza sativa
  unsure (1)..(1396): unsure at all n locations
nnnnnnnnnnnnnnnnnnnnnnnnnnnnnnnnaagctcaagttaaaaaccgcttaaaacagtgctcaggggggttatttgttcggtttgcataattgggggtgaaggatgtctggttttatagttcaggggggtaattcgatcgaccacgatagttcggggggggggaggggtaattcgtaccttttccttaatgtgttcatgtgttttttccttgatgacaagatctattcatttagaagccaacaactacatcgactctagattgttactttgaatttcattgtttgtttactttctacgttgtctaaacctaacaaggatcagttcattataacatatgcttgcataacattagataagtcagatggaccattggatcttttcatcttaaccttgttgttcgcttgcaatgatcagtcaggtttcctacaatgttaaaacaaaatagttcaacacttgttcttgctatgttcaaaattatgaggtagaggctactgatcacagatataaacattactttgcgtcaatttcagtctattactcaagatgcacaagcatgtctaaacaaactctctttgtaccataattttcaaaatcaactggaacaaaaagcgagaggtgagagcatgcatagcttaggagagagggtggtaatggttgaagatctcatccatgcacgtccatccattttacctttggtggccgctccaagaaacttcgggcagcatgcaacacaccatgcttaccatctctatgcaataggtgtaggtagtagtcaacacaacttaatttggcagatactatatctacgatacggttcatctaccttgttctcacctgaatatgattgatgacatattttgtttttttttttgccaagcttttgaaagtctagtgacacactacacgcgtgacttggtcgatactaataataactgaggtacgcaatcatgcatatatatatatttcttggtttggaactaaaaacaagtggagtactagagacaagcctttagtggcctcatcatctatcgtttagtgattgaagtggtctctttatcactgtacataatggcagcaagcttaagcatatatatactctcgtaaccatggtgcccatgaaagaaaatggcttaaagaaagaatggaagaaaaatggctcctagatggctagccatttcaagcgaacaattgaacatacacaaagccagcacaacaaactttttaaatttcaagttttgtatgcatgacttccatattgtgttggacttatgagtgatcagtgcaacctgctcgtgtggaagcatctttattgaatgttgatccttaatgaagtttaggttcaatttagaacgaaaaacacttacgagttggggatcctctagagtcgacct

SEQ ID NO: 15584 - DNA, 1042 bp, Oryza sativa
  unsure (1)..(1042): unsure at all n locations
nnnnnnnnnnnnnnnnnnnnnnnnnnnnnnnnnnnnnnnnnnnnnnnnnncagtcattcagtgttcatcagcactgctgtgcttaacattacgttaaattgtctatgcagaaactgtatacatttctttgtgtcaatatgctttttatcgcctccaatttgatgcatagtacactttagttttgactgtgctaatccaggtcattgagtaattagtccctaatctatccatctcctacttgttcttcctgtgatcattgccaccccaaactctgaggtcctcatcgatgaaaatgaggaatgagcacaggaaggataaggggagccgggaacgagatagatttagagttgataaaatgtacaaggaccatcaataaattagggaacatagatagattcagagtttggggtgattcatgcagatgcagagatgacaaaaggtacaacatagatagatgcagagatgacaaaatgtacaaggaccatcaataatttcactactgacatcccgtcaagccaaaaggtacaacatagatagatgcagaggtgacaaaatgtacaacgaccatcaataatttcactactgacatcccgtcgagttgcttaacagaagatagagtagaggggataatatggtcacctggtggagttcatggttggtgactttaacgaggatgtggcagcgaagcaggaatccaagcccagttttagtaggccaacatgcagctggagcaagactgcaagaggcggcatcccggtcgggtggcctgagatggatcagatggcgtcgcataggcactgtactgccgatgatggcgccggcgggctagggcgcatggtggtggcaacgaattgcattcggcggagcgatggttgctaggagaagtcagggagaggagagcgctatttcggggagggggggcgcagcgtggcaggttggtaacgatcgctatttttgtttttaatcggtggttacgtgttgcagagcaggagattgctaattgtagggacagatttaactcgccacataagccattggatga

SEQ ID NO: 15585 - DNA, 1886 bp, Oryza sativa
  unsure (1)..(1886): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacaatgaaagagagaaaagtgagtttgtgtatcttgtggatcatagttaaccttgaaaactctatggagcaatcaaataacatattggtaaagaatcattcgaagaacttacgaagcactctacaatatgcatcgacacaccgtgcagtatagctaaatccaatgtataaattgaactctaagaagctagcattcatagagaattatctgtaaggagtttatacaaactatgatgatgttctctaaatccactgagatgagaaaccgaatgtatggacatgaatgaatttgtgtcaagaaaaagagaagtccactatgctcaccagattcatcaatgcatacacaatcataattaggaaactatgtacaaacataccttatttccttttgctagctctaaatcctcaaatttatagcagcataaactgatctgtaaacccgtgcaccctagaaacttgataaattctcagtcaagcacctgtagcaagcctcatttgccctgataaccactcaatttatattagcccactgctcactgaagcactgaatgtacgtacattgtttcatctttctaccagaaattaaggccgatcaaaataattagttactctctccgtttctaaatatttgacaccgttaactttttagcacatgtttgaccgttcgtcttattgaaaaacttttgtgaaatatgtaaaactatatgtatacatataagtatatttaacaatgaatcaaatgataggaaaagaattaataattacttaaattttttgaataagacgaacggtcaaacatatttaaaaaagtcaacggcatcaaatatttagaaacagagggagtatattgttaacgaccaaatttcataaattctatcattattggcatcggagatgaagatcagatcgaagtggaatccaagatgaagatcgttgcggaaacagagtaagaatcggctgcagtccaaatcggctaaggtcaggtcgacagagttcgagtcggacggggctagccgatacagccgattagccgatatagccgattccgataatatgactcggtgtacgtcatcgggttcaagttgatgtgtttcaagataattgccacgcatggatagagtcctgggaaggcaattgtatctattaattagggtattctatgtaatttctttagagatatgtttgggcaaaagtctgccgtaaagacttatggtatcttagagtttgttagagataatagtcgtgtctattatggacgtatcttgtaattctcgggtataaatagacccgagccctatgtaaaaaagaacaacacatccaatacaatctcggcgcatcgccaccctttatgctttacttttatttcgacgagttcgtgctctcgggttgagctgcatcggtttctgtcggtgacatgggatcaggagtatcatgactagaggtttgaggcagacacaatcgcccacgtcgcgcctgcttccggcggaagtggaggtaggtatgggccgtcctatcagaaggtcattcggacggcaaccatacaagtctccatctgtttatgaaaaggtggggtaagtccccacaaaaaaagagagaaatggtgcatgtggtatccccttaagatataaaaggaggaccttgcccactgagaggggggactagacttttccagattagaaacccagaacaagggagaggctggctgatactttgtagctccttcatacacagatctcccaaaacataggagtgaggtattacgcttctcagtggccccaacctgtatacatcgcct

SEQ ID NO: 15586 - DNA, 3452 bp, Oryza sativa
  unsure (1)..(3452): unsure at all n locations
nnnnnnnnnnnnnnnnnnnnnnnnnnnnnnnnnnnnnnnnnnnnnnnnnnnnnnnnnnnnnnnnntttcctgtctcgcgagccttccacatacagagagcttagaatctctccctgagtccccggccgaaccggcaaaggggggcctgcgcggtctcccggtgtggagccccacgcttcgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacagggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacatcacccgcccgtcgcccatgacccggagtctccagcccaacgttagctggacgatgtggccaaattggtcatgactgcacggcagcgcctagatgctggtgggcggtcctccgccaccaaggcctctggtgctgctaccaccggctccgcatcgtcaagacggaaggcgcggcgagcggcagccgctgttcgccattcggccgccactctttcgtcaacgcctccgacccgggaagatctgcgtggggaaccggatgctcgcatcagtatcgagcgccggcgtaatggccgacgtgctccccacgcaacgtagggcgcctcctcgtccggagtgtcacctcaccacggacgcggggatcagccctccgtgcccccggttggtggtgtcggtagtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgctaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctagtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggaccgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcttggggccaccattgccaccgtcgatgggggagcgtgtgctcacgtttctcgccggagcttcaaggccatgaagcgagagcttctagccgcgacccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtaaagttggggcgtgtcctcattgatgggggagcggccctcaacatcctttcccctgcggcctttgacgccatcaaggccccggagatggtgctccgcccgtcccagccaattatcggtgtgacgccggggcacacgtggccgttaggtcacatcgacctaccggtcaccttcgggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgcctggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgtaaggccggtccggcagaaagtgcggcggcaggccccggaacgtcaagccttcatccgcgaggaggtggcgcgacttctggaagccggattcatccgtgaggtcatccatccggagtggctggcgaacccggtggttgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccactccgcccgcataaaactaaaccccataagtgtgtgttcggtgtacctgcgggcaagcttctagggttcttggtctctgcccgaggcattga

SEQ ID NO: 15587 - DNA, 764 bp, Oryza sativa
ctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccggggggggggggggggaatcggcaaaaacccacaatcgggtcacccataaccctcggtcaccacgttcccggcctggccagtctcgacatgtggatctccccaggcactagcccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcattccggacctgcgcgcgcgcgcggatctcggtcccaggagggaactcattcagcgccattcatg

SEQ ID NO: 15588 - DNA, 737 bp, Oryza sativa
ccacgcggggtcgagctccgcccgctctgcctgcaggacctccacctgggcacttaacccatccaacaccgtggtgtttgcggcggccaaggcctgcagaaggggctctgcgttcagtagggcgatagaaggcgtggggaagagtcaccttggagaggatgccacgcggctcgggccgccgatggaagtgccggactcggggatgtcccccggacccggttggtcctgagcgtcgcccgagggagtgtgcccaagcgacgcgcccgcagcctcgtcgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctgggccgccggatcctcggcctcagactggccggacttgggatggcgggagggacgcgacgggatctcgctgaaacaaaagaaaaaaccagaagacgaacaagatgggtgagtgaaaactcgcgttgagaaaatgaatacagccacgatgggtgagagacaaacctgcgagggggtcgg

SEQ ID NO: 15589 - DNA, 830 bp, Oryza sativa
  unsure (1)..(830): unsure at all n locations
agggcgaattcgagctcggtacccgtttcctgtattgtgtaaggagtattctgaaagatgttcctgagactatggtggctgtaaaatactgagagtgttccatcatactccctatataccaaaaagaatccaaccctagagataaatctggacatacactatatacagatttaacctcaggattaggttttttatgggacaaaggaagtaactttaagtagtgaaaaagtttggcaatcattcttggtttgataagaatcttaagcacatcagattttgcatttgggatgcaaaataatagatgaggacttactctagacattaatcattttcagggtcagggcatttgaattagcctgatgatcaacataagaaaatctgcatgagatgaacagaatgtactcgacaaagaactgggctcttcctgggaatacatctgttttgttattttgatattaacactagcctggagtttgtacttgtgaagagaagccagggagttgatatacgaacttatcatttaaagatgcactgttcatttggtccttgtttaccgaacattctgcagtaagcttcttttaccagggacttgattgatttgctcgagaaaatcaaccaagaattgctatgcttataagaccatgaatttgatcgttcgacaaactcaagtgttttacgagtgccaggcacatcttttggtcgaagaatacaactcggaaaattgatttgcagtcggcatatcgttcaattcaacatgcagtctcgcagttggcatnnnnnnnnnnnnnnnnnnnnnnnnnnnnnnnnnnnnnnnnnnnnnnnnnnnnnnn

SEQ ID NO: 15590 - DNA, 2600 bp, Oryza sativa
  unsure (1)..(2600): unsure at all n locations
nnnnnnnnnnnnnnnnnnnnnnnnnnnnnnnnnnnnnnnnnnnnnnnnnnnnnnnnnnnnnnntgaggtgagctaatttgtagcagtaataactaataagtagtagtaccaaaaatgaggaggctaccggggtcgatgggagtggggaaacccgggctgaggcgcctctcgttgatgtaggtgccattcgtgctctccaggtctgttaccaacaggctcccctctttcttctccagccgtgcgtgcgtcccaaaaactgctttttttcatgccattccattccatttcatttcatttgcagcaacttagtaagctacatatgtctgatggattatggagagagcaatgcaagtgaatgaatgtgctgcatatatatatgctactacctgttgcgacagacaggacgatgtcagcctgttcaggaacacgacccaccgtcaccgccgcctcctgcacacacaagacaacacattcattcatccaagagaacacccggctgcagctgagctagcacggttacagcatggatatccagagaatttctgggaaggtagaaacaaagagagacatacggatgctatctggaagccgccgggtcgtgcgacgcggtacccgatatgacgccaatcgccgtctcctgcaattcaacaacagcaggttctgtttgttcaggtggacagcaataaactcacgaatattgctgctgtgttctgttttgcaattttttcttcagaccagctagttaaagttggtaagatgacgatactatgattaagccggtaggcaggcacaagcatgagccagttcacaagggatatcgacattgcattacaagtatcattttcacaagtattgaaagcagactaacctgcaggctcaagaacccatctttctgaagtggcggaagaagacgcgctgtcagtgccactggaagagcacctcagcgacaaaatggaaatgcttcttctgccactcccgttgctgtttctgctggttagctgactgacgaactgcagccgcggctgctgcagcttcgccccattggaggcgtagctgctgctgcaaggaggcggcagtgacaagcagaggaaggcctcctgggtgttgggctagagaagagcaaggaaggagtagccactgctgcttccatttgtgtctgtgatttgtgctcactgctcagcagtggcagggaaatgcagtgccttgctttttttgttcgcttcttgatttctttgtggatcagtggagatagaattgaggttgtttgtcctgtgttcaatgctatctctggactcatggccaatcagttgctcttcaccttcatctgttggtggtcgaggttcactgcttggtcattgtcggattctcccgttgccctacggtcccactctgcttgtctgcttctgctgtactgtacacaaataaatgttttttctcaaacacatttttaagagtaattttagatgaaacaataacactcctccaaatttcacagaaaaaaaaaagagtactccaggattaacattgcaggtttcttttatcagtgcataaataggaaaaatgcataatgaataatttagcttgtttgagtctcaagagaagaaaaaaaaaacacacgatgaatattgtatctggttgagtctctagagaaatttagctcccttagttattctccgaagagggtttgtttggatgactcacctgcatagagaaaaacttgagaataaaggttagttaatcagtgagagaaagcgaaggtgtattcgaactcttcaagcaaaatttacacccattggctttggtgtgatgtaatgtaagcttcatccatagtatcagtatattcttttagcggttttacacatttttcttacaatatttgtttgtttctctagacgtgcaatgcaacacagtatacaacatagaagcgttagtatatttccatattattactccagcaggaaaatattcaatacaagcgacatctgattaagcagttcagcaacctacaaatttcaaaaacaaaattaaacatcctcgattctttcaataaataaataaatttcaaaaagaaaaattaaacaccctacatcaggccaggtcagctaaaagcccaacacgcttggggcctaatgctgtctgtgcttgggccggcccactcaggtccacttccggacccacacgccagactctctcgaggaaaaaaaaaaagaagtaatcgtggttagcaacctgccccttgttccacaacgacgaacaacatctcgccacgaggaggagggcgagagcttacacgagtccgaaatccccaatccgggatcccctgcttctcttcgcgccaaggtaagatctctcacggatctctgtgcttggcagcgcggatcgaatttttgtcattacttgtcctaatttttgttccggggtgtctaatttgggtccgatccgatcagatggcggctgcctgggcggcggcggtggccgtgatgctcctccttgcgcaggtgtcagcggcggctccggtgatggggcctgccttcctctnnnnnnnnnnnnnnnnnnnnnnnnnnnnnnnnnnnnnnnnnnnnnnnnnnnnnnnnnnnnnn

SEQ ID NO: 15591 - DNA, 3428 bp, Oryza sativa
cactggaatatcatggcttgcttcaaaaaacattaccttcttagatttttttagctcagctagggagcatttttatgtttttttttccatggggtttgtagtaatgctgcacacttatgtcttaagcatgctttccttagtagacaggtgcatccgtgcatgtggccgttagatatgctgtctttcttgcatggaaacttgcaatccaattgaaatcctgctaaaaattagtaatagagctccatggggctggctctaaaaaaatgattttgtgtttgcttcagctcttattttatatggacaatctttggcctctaattgaaaaagatcttgaaactatgagttccattaaataggctatggcgagttcctgagcaatatgttatccttatctgagataataagaacattaaagcaatggagtaatgcaacttcatcactgattcttgcctagagcatatgttgcacctggtctgtactgtagatggcaatgtcatgcatatgagggtcacccatttttgttggtgcctcacattttcagttacttgctggctagattgaaattaccagttcatatagaaaatatttgctgaccttcttgtggttattttaatcaaagtttagttgtataaattacattttatttaccttgctcgccagattctcttctgatgagactaaagaaatggtctactatcagacagtatccccaaagagcttagtgaaatctgttcttgaggaaggtggttggtcaaacttggtggtgagttgagttccccccacgtcaattcacaaacaactgaccaatttcaattgcagtatctgctcttattgtgcacaaactcaaacaattcataacattgtgattttattttagtgttcaagggaggatcatgcaaagagtgttgatgttgcagttctttttcttggctcgaaggtacttattgactcccattcatttggtactgtgaactagtgtttaggtcttcactggttgcaatgtttacataattattgattcagtccacattgatcaaaaaattggaatacattttcttcatagtgtttctgatagacgataataatcaatactaagaggccataacatttccaaattctcttgtttgaatctgtatgtcaaaattattgctagatcaagtaatttatattatgatgctgtttcaatttttcaatgcttcagttgaaactgactgataacttattgttcctgtagctacaatcatcagacatttctaaagaaaagcaagctgattcaactttagtagacatgctgaaggtattcataatcactcttcttttgtccatcccccttatttgtatttcccctagttgttatataactgaaaaattaaagatttttaaatgcttataatatctatgctctttactagaactcctttgcaagctccgagttttccatggcattcccctatgttgccatgtcagatgatgacaaattggagaagtcattgctatctggatttgctgagaattgcaacaatggtcttggaaataatcatatcacctacacagacacctgttctgtaagtgaagatctgaagaaacatcacgacatggattccattcatgtaagtttttatagttcttttggtacttcttgcaatttctcttttccatttattgaccacatgtacattccagggattggtggcatcacaaactaaaaagaacccaagtggacagactgatctggttgtcttctgtgatggtggtttcaaggataacacaaaatcagaaggttaggtcaaagatgctaggttggtcctttcacctcaaatatacaactgtaccttaatgttatgctaattttttctgtaggggagttactttctgagctggttactctgctgaagaagtctggagctaaatatacaattctttatgcttctcagccctatggtttgctagagagcccttcaaacctgccgttaggcaggtacctcgcagagaagactaatactactaaacccggccgtggaaaatgtgatggggagtgcttagtaaaatcaactctgctagaaggaagctttgttgtaagttgtcccatggactgttttttttattggttactttcattctgtcatgtagacttaagcctataatgttttccaacaaaaacagtataattttagaggtagttgacttctcttattgactttactgcaaaattttatttctatatcactatttgttatcctagaattattttctcacaatagttcgtttatgatatgcagggaatagtgctgctaatcatcttgatatcaggactcaaatgtatgatgggaattgataccccatcaaagttcgatgctcccccggaatcgtaagcccatttttaagcagatctgaatggaaactcaaggcaaacacgaggggaaaattgaatagctgatgtagcaggtctgtactgtgaatatagttagtttgctacttattgccttatgtattttaatgagccaactgcaatttgcagtcaatttttggtggaatattacatttcaaaacgtacacgtgcaaggcctgatttgtaccatataacactgcctctagtgtttgctgtgtgaataagctggaattaaaacctgttttggaataagatgtcacagttcatcgaataaaaccttgcgatatatttcattattttcatatataccgtgttattgcaattgaacaagtccctcaggaatatcttttctggaattgcattgcatttgattctctgtaggttaaatacagagtcttgtactcttttgccaggtgaagatgtttggttattaacggtcgtcgcttattctgtaggttattactattcgagactttgtggtgctagcctagcaccctatcatttatcattgcttgttcatcaatcaaccccgtaatatttcaatcatatttcacgatccattactagcctgattgggacactgattaaggtactttacgccggagggcttttcttcctttagctggtgatgttactgtcagggaaaccttattgctcaagtgatcacattactgagatagatagcgattgctatattaggacaaaacaaaaaaaaaaggactacacgactatgcactccctttctccctctggggtctttgtatatatcttggcttagcactgaagtatacctggaaatttatggcacctacataatttgcaggaaagtgatcacgaaattgcatggcgatgtcttcttcatgttatcctggccagtatagaaggaaaagagtgaatcgcaagataaatattatccctattgttttacttatacttatttgtatcacatagcaaataaaaaataatttaaggataaagcttttaatatgtgtgttctaactatgataaaaagggtaccgagctcgaattcgccctatag

SEQ ID NO: 15592 - DNA, 611 bp, Oryza sativa
  unsure (1)..(611): unsure at all n locations
nnnnnnnnnnnnnnnnnnnnnnnnnnnnnnnnnnnnnnnnnnnnnnnnnnnnnnnnnnnnnnnnnnnnacagctcttaatgatgcgtgcctgtccggcgatctagaggatccgattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcaaggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaaacacggcgattcatggatcgaggagttgccagcggtgctctgggcaaaccgaactacaccaagccgagc

SEQ ID NO: 15593 - DNA, 1155 bp, Oryza sativa
  unsure (1)..(1155): unsure at all n locations
tgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaggggggactggacttttctagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagtttcgatcttcaacaagaggtaaaacttgtcatgacgacttatgttctcaagattagtgcttccatctttatgacactctaatcttgtctatataattcgtcgagttatcatatatttcacataatctttgataatatcttcatctaacctataatcggctaacatctgttaatggaaggcagccgattaggttagataatgatgttaacttagactatgtgatatatctaccactctatgaaacttccagcggcttgattgtctagatattgtttttcttttcatacttaatgctgcatcagttgagtttgatctattaagtcgtgcttagaattgcaatctctagcctgctttctgattgctgattagggtagtatcggagtttcaaccgatcttatctgatttaactacttttattctatatgcttgattgacatgttaaatctgccctttatgttaagatattgtcgcatctaagtatattaagcttatgtttagtatattnnnnnnnnnnnnnnnnnnnnnnnnnnnnnnnnnnnnnnn

SEQ ID NO: 15594 - DNA, 908 bp, Oryza sativa
  unsure (1)..(908): unsure at all n locations
nnnnnnnnnnnnnnnnnnnnnnnnnnnnnnnnnnnnnnnnnnnnnnnnnnnnnnnnnnnnnnncaaattgctaggtgcatgtgagattttgtgtttgtgtgtggcttgcaattgaagggcctttcttttcggccagcttatcctccgcaccgcaaatctggttgctcgcttcaatgaatgtcccagcctgcatcaatgtctgtcaaactcacaattcacaactggattgttcaacaacttttcagcaaagattttaaagaacaagtttggtttgcgcagcaggttcagcggcatttagcacaattctgagcagaaagcaaaacgtcaagaaaccaaaactaactaaataacgctgatgcttatctgcagatgtcaataaaatcggtggataataggctaggtgagcgactggagaagcatgaagagggtgagtagggtcagtgtgcctgccactgtaacaccgtgaaatggatggtatctggttggcgtccaatcgggcgtcgcgagcaagcgacactctgaaacgggacggaaggagttggtctcggagacaagaggcatctttttatcttgcaatcgattgatctcctcctattctttttctgttgctagtgactagtgatggcgattgcaatagcaaaacgggatagctagcatctagtactacctctatattccttccccatatcgttcgccagttgttgcttctgggatcatcgcgtggcatctcacgtagtatggtgctactccatccgtgctagtataatataagagattttgggtggataagatatgatcttagtacaataaaatcgggatatacctgtctgttcacattcattgtaataggatggcggatccaaccaaaaatctcttatattatgggacggaggtaggaggtttcttct

SEQ ID NO: 15595 - DNA, 886 bp, Oryza sativa
  unsure (1)..(886): unsure at all n locations
nnnnnnnnnnnnnnnnnnnnnnnnnnnnnnnnnnnnnnnnnnnnnnnnnnnnnnnnnnnnnnnnnnatgacgctagctagctcgagccccataggtggaccatgacacaccatgaattggtaggggcagacaaatacacggactgctgcctccaatagggagacatggctaaacaagacgagagaatcaacttaagctcattagggcttatctagtgggaagatgtcatgctatttgcacgcttgatcaaccactccgttgtgcaacgtgctctgccgccgtctttccgttgtccttgaacgacataaccaatgctgttttgattgtttaattaggtcgctgatgacgcgtgttaattaagtaggcgccattgcgttttcggatataggtctagcaatctgaagcacagttcttcctcagtactgaattgtggacaagacgaccattaatttgtcattttggttggagtcgtagagattagttgatgaagcagctggtttgtcctgaagtatttgacaaattgagcaagaatttagtcagtattgttgtttgaaagtacaattgatcagcgtactatatgtacaagtggtgttatgcaagctactcctagctgcagggcactcgtttggcgccgatgatcagagccatctcaatctactcgaaaggaatcttgagcaggcaaaggtatattccgacctcaactgtaaagtttatctaatcctttcaaaatggataaggattgaaactttgaagatgcaaatgctagctagcccaccaactagtcctttgcatagtacaagaccaattatatatcagcacattcagacaagaacaaattgtttaatttgtaaggtccaatgaatcaacgacaaagtagcatgtttct

SEQ ID NO: 15596 - DNA, 712 bp, Oryza sativa
  unsure (1)..(712): unsure at all n locations
nnnnnnnnnnnnnnnnnnnnnnnnnnnnnnnnnnnnnnaaatcccacatgaaagtaacgcatagagcaataaaactaaaacttgggtcaagcattgaagagggagccaaaaaaaaggggaaaccgcccactttccctcttcccaaagccaagcgaaccatgctatttaatccactacactatttgtgagccttttacaactatgctcccactccgctccactccactggttttttccattccctttgtccccttttcagatctccctttccctctccaagaaaagaaaccatcaaagaagacacaacgagataggggggagtggctactatcaatctccatgggcgcctatgaggccaccaaggtggtttttgcccggttgcaagcgcttgagcccaatcttgctccaaacatcattggcatgctcctcaccaaggataacaatgagatggacatgattcgtctcgcatgtggccctgacaacctcctccaatctatcattgccaaggtgcgcaccgacctcacaaacaagccttcccctcctatggcctcctggggcttcccgtccgatataggtgaggaagcatctttctccgttgacaaggtggggtgtgatggaggtgaagagttctcctctaaggagtatgattggaggttacccatcggtggcaatcaccatcggagctttttgtcaagcaccgtcgacacccttg

SEQ ID NO: 15597 - DNA, 1643 bp, Oryza sativa
  unsure (1)..(1643): unsure at all n locations
nnnnnnnnnnnnnnnnnnnnnnnnnnnnnnnnnnnnnnnnnnnnnnnnnnnnnnnnnnnnnnnnctcctagatggctagccatttcaagcgaacaattgaacatacacaaagccagcacaacaaactttttaaatttcaagttttgtatgcatgacttccatattgtgttggacttatgagtgatcagtgcaacctgctcgtgtggaagcatctttattgaatgttgatccttaatgaagtttaggttcaatttagaacgaaaaacacttacgagttgtgtattcttaggttcattatgggactctatgcagataagtatttagggagtagacacatactcacatcacaaaatagtaagcacgttactagatgcatacacaccatcatactctagttatgtgaagcaagcaatcaaacgttcataaaccaaagtaatcaaggctcgaatttagatgtcatatgtgccattgggttgtattcttttcttaagggttcaaatttggaaacacgtacgttcaatgcatatgcgttgtttcgattttagttcaaattgcagggaaacaaaatgtgtgccaactgtcttcttggttgattatgttatgccactcttttcttggttgtgcatggacaactaagcaattacttaaatcaaactatatgtgtcatacttttgttgttatgtaattaatgagcaaatatattattttaattattcaattccaagcatcacacctataaatgtccattcttaattcaaaatccagactcataaataatgatggaagacactattactttaacgagtagaatgcactgctctatgtggaaaccttaggtgtaatcaataaatcactaaacaatactaacgcattgtttttttacacacaactaaactcccaattcatgttgaatagtccactaactttgtgtagaaaagtctaaaaatatagggaaataacaaaagtcaaatcccacatgaaagtaacgcatagagcaataaaactaaaacttgggtcaagcattgaagagggagccaaaaaaaaggggaaaccgcccactttccctcttcccaaagccaagcgaaccatgctatttaatccactacactatttgtgagccttttacaactatgctcccactccgctccactccactggttttttccattccctttgtccccttttcagatctccctttccctctccaagaaaagaaaccatcaaagaagacacaacgagataggggggagtggctactatcaatctccatgggcgcctatgaggccaccaaggtggtttttgcccggttgcaagcgcttgagcccaatcttgctccaaacatcattggcatgctcctcaccaaggataacaatgagatggacatgattcgtctcgcatgtggccctgacaacctcctccaatctatcattgccaaggtgcgcaccgacctcacaaacaagccttcccctcctatggcctcctggggcttcccgtccgatataggtgaggaagcatctttctccgttgacaaggtggggtgtgatggaggtgaagagttctcctctaaggagtatgattggannnnnnnnnnnnnnnnnnnnnnnnnnnnnnnnnnnnnnnnnnnnnnnnnnnnnnnnnnnnnn

SEQ ID NO: 15598 - DNA, 714 bp, Oryza sativa
cactgaggaagggatctgtttccttcctttcgccattattccccttgccttcgctgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccatcttctttctcccctttgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagcccggggggccggtgctgaaccgctacatcccttgcgccctccgcaagaagtgggacgactggaagagcgactggttctacactcccctcgccgacgaagcgcgcctccgacttccgagccagcccccggtgcaggcctccagctggcgggcgccggtagatctg

SEQ ID NO: 15599 - DNA, 643 bp, Oryza sativa
aaaaatgaaatgggttgaatcttaagcctcggggagtaaccggaaacataacaaaggcacagtgccatggtaacagggatatagattagctgtgaagaaatagataatcctcctataagtatgactgaaataggtaactacactaatttggcacactagtctaagatactaagggaacagctttaaggttcaaaccttgtggcttgaaaaatgaaagacacgcaaagataagtatacagtttaagctttgtgtacgtaccttcacaaggcttggtttcaactcccttgattgatacccccgatcgttggaaactttattacttgtatctacagagaaattcctggtagaatggtttctacaccagccggctatgaactaaaagcaggggcatgaatggaacggtgaatttgtaaaaggggtgtaaaatgttgtggtgaaggaaaggacaaaggagagtacctcaatatgtgaactctggatcctgcacaatgtagagaacagtaacataagtaacattagtcacttttgactagcaagaagcaacctcgttaaaaactactctcagtaacaagaacaacaacgctaaaagctcctgatttaagaatgcatgttggatcaataacaagttttgttatctatcat

SEQ ID NO: 15600 - DNA, 1069 bp, Oryza sativa
agcggtgttctctttttccaccctatcaatggagctacttggcttgttctacatctatctagctactgcattactttcaagtttagtcttttaaaacttagccctgaaccttgcctttttgacattgtgaaatggatgtgattgaaatgtttaagactctactctagtctctggaatatggttttgcctgttacctatgttgagttatatttatgttgttaagatgatccatactgcaagtgttatgctatgttaagatgattctgcgagtagtgttgctgtctgctttggtaccgctactgttatgttgtgattgtgacatgctcatttcaggtagttagggttttcaaatttcaattaattcccatggaaatgcttgttcagctccttagggttgcaaatttcaagtaattccaatggaaatgctcgtttgctgtattgttgcttattgtcagtttgagttttaatactattgatacatgtatgtgtctagtgcatatgttttaagttagcggatgcaattcatatatcgagtaataattatgcggaatatgtcatcaacacttgcacatatgtggtctgttgatcaacagttgcacttctataaatttaattagtcttatctaataacaatcatgcaagttgcaattctatctggtatatgcgtatgaacacttaattctgaattcagtgcccattcctgaagttaatctttatggtttgcttagattaggagcttagattatgatgcttaatttgatttaaacaaatggcctgctactttttgatatttttacttatttggtctggtagttgtacacatattgatgtgataatcttgtacagatgatttgcgaagagtttgtgtgctattttcattgtagcctatgtcagctctcttttaaaatgcttttttcgatcacatttactgtttgaggttttcaaccatccttgtatacctccccataaaaggaagtaccaaaactaaccttataggttgaaatagaattggaaattttcattataaatttctgtggcatttattgcattcttagaggtatgtatattt

SEQ ID NO: 15601 - DNA, 10132 bp, Oryza sativa
  unsure (1)..(10132): unsure at all n locations
nnnnnnnnnnnnnnnnnnnnnnnnnnnnnnnnnnnnnnnnnnnnnnnnnnnnnnnnnnnnatatcgagtaataattatgcggaatatgtcatcaacacttgcacatatgtggtctgttgatcaacagttgcacttctataaatttaattagtcttatctaataacaatcatgcaagttgcaattctatctggtatatgcgtatgaacacttaattctgaattcagtgcccattcctgaagttaatctttatggtttgcttagattaggagcttagattatgatgcttaatttgatttaaacaaatggcctgctactttttgatatttttacttatttggtctggtagttgtacacatattgatgtgataatcttgtacagatgatttgcgaagagtttgtgtgctattttcattgtagcctatgtcagctctcttttaaaatgcttttttcgatcacatttactgtttgaggttttcaaccatccttgtatacctccccataaaaggaagtaccaaaactaaccttataggttgaaatagaattggaaattttcattataaatttctgtggcatttattgcattcttagaggtatgtatatttgtctcaattagaggcatatacttgcaccgtggataactctggactaacaatatacctcgcaactaccagaatggccgtgccattcataatcataaacttgtttttgaataataaacttttttaccactcaagtagtgggagttgtgtgtctcttaaggattgggaaaaaaaacctctgtttaggtaggctatagggctatagcctactgaaaggtttgttccgctggatgtagttgtttgctaacttgtccttgttctatgaaaatgctagttggtgttctatcatggtaatatggtattgatgcagaaatttatattgatatacatatggcacaattgttaggcttgcatggactatttttttcctcctgtgttgcttgatctcatctagtaatgccaccacaattttgttctggcaagtttttgagcactgcagcaattttcatggtgttcaaatattgttcttttctgtcatatatgacgtttgtatatctaatatggttttgcagcagctattcatggtctcacttcctgtatattgagaaatctatggtccattgtttgtcttcattcatttaagggcccctttgaatcgcaggaatggaaaaatagaggaatacgaaaaaacgcaggattctgacaggaatgtaaaacagaggattggaaaatacaagaaaaacacaggaatgaccgtttgattggaccacaggaatcggatgagagagatagactcaaaaagaatttttccaaggacctcttgctaactttcctccaaaatctctataggattacccatctcataggaattttaaaggatagtataggattcaatccttcgttttaaagggtttcgtaggaaattttttcataggattgaaatccttcaaatttcctacacttatcctacaaatcaaagggggccttagcatgaaaagaaaaatcgttgctattactgttaagtcaggaaaatcgttgtgaagtgctaatagtacttcgaattgaggtttggtgggtgtgttgtgtttgtcgtgcggcttctaagaaacgattacgagcgtagtttggacggctagcttgcctttccagaaatacgagctgtttaccaaagaaacggttatgagcacaagctagtttggatatcagtgatacgaggccactagcaaaactatccaatggtccatcgatgagcagcaatgatgcatttctgtcaggcatgctcttcaggcaccaacctaacatgctcttgtactctaatttgcactgttgtgtaggtgcaagcctcatctagagcaaaagaaagctaagctattctagccagtattaatgtaatcctaacgcatattcattttgtttcttgcacttgctatatgcttttttgttttcatgtgtcatctgatttccattctaatcatttttgaaaataggtttttcttgtgtcatctagatttccgttctataaccatttctgaaaatagtgggagccggcgacctaccactctataccgaggccttgaggccccacatgacatagaacctaaggtatgactaaagagaaaaattgatgagggcaaatgccactgctctatacattagattagttcttgtctgcttacaactctttctaagaagggctaataataattttctaccaacactcagcacaagttttttctattatttcatttgagaggctagtgtgcttatcttttgtttcaaaaaaaaacaagttgctaattatagttcatgaccataaaaaacacgatcgatttcatgcgttagaaattgttagttattgaggttcgtacccatcacgttgatcgatttcatgtgttagaaattgttagttatggaggttcctgcccatcacgtggatgatgagacaaaggagtggcacgttggatgacggtacatctccatttcctaacctagttgaattgcatatgaggaatctaccgaaagtatgtggagtggcacgtgagatgacggtacatctccatttcctggttaaattgtgcatttctcgttgtagtaatatgagggagggagttgaaggcattgaacacctcacctccctccaaagggaaatttaactatttgtcactcttgtgacatggcaattaacgatttgccacaccatgtctataacatgtgggccctcatgtgtctatgacatgtgaacctagtggcaaatcgttaagcaccactcataagagtggcaaatagttaaaagccccccctccaaaacccgtggatacaagaaagccgtgccctcgagatgctctctaaaatacatcgtgctccatcatgggctcacctcgctccaacacctccaacttttgtttcctacccgtgtgctcatcatgctactagaatcacttgggcaaactctctacacaaccgctttctagccaaagataccttggcctttagtccttgactcctctcccaactccatacaatgccttacttctttatatgatttgctgattagttacatccttgctttgagtaggtgttacaaggtcaggggaaggactagcacatcctctcccacatttgtcagatgtagatattaggtaattggaaattaggatatatattagagataagacaatgaggtcacaacattccgctgatcgtggtcgtattaaggtgtccatacatgtatgttattttattacattgttatcactaatgtcatctttcattgcatgtatgtcaggcccaaacttcatctcattttccaccctcctggtggaacagagcacacatgcatatggtgaccggtgaaatcaatgaagcagctaatttgctgctactcattattttgaccgctgatacatgataagtggacgagattgtcactcacctgattttgaagttagttacttcctctgttaaaaaaatataagcgcatatgtgacttaaaatttgtactacaataaaaacacttaattgtataccaattgagatttcccgcagtaccactcattgacatatgggcttgagggtctgtaaggcccacatgtcagtgtgtaatactatactgcagatgatctgtatccattgtatacaagttgcgtcattttgggccttgcatgagtttgattgaccctatggtctgcgcatgaaggctgcactatagcaataaaaagaggtcaggaaagttgcactacaatcaccaaacatggcaagcccgctccattgataaatagtctattggtgcaagcctatttatgttaaaaaccgatttgaagaaagaatatttacattttaacctcttttaaaaaatttattttataaataggtcctcgatgataatctctttagtggcactgatcctctacatcttgactgttggggggtgggggggataagggtgtcaatactaatatcgttggtgttgagacattgtacgttggcgagggtcactaacatcgagataatggtctaattctgaaataattttatatagggttaatttacaaagtaagttctctaaaactatgctagtagaatgtaaaataacccagattccaatgttaatcgttcggccaccgcttgcgcgaccgttgctgccggttgccgccgccaggactcacggcttgctcccctcccttcgcctccggctcctatcccatccgcatactgccgcggacgcatggcccaacgatgcagccgcgcggtcgtcgtcttccatctccacgacgaggttaggtatcgcatccctgatcccccacgcctacctttctctctctctctccctggcccgcccagactagatctattaggggggagctcaacttgttcgatacttcgatctgcaacttgcaactacagccccaaactagaaatcgctgtcctcatacagcccccatctgactaccaacagctaagcaaaactagattattactatgatttttgtgaggatcgtccttctttgactggcttgccatagagtggtttcgaaagtgacatttccacaccagctttctgtatttaaactgcaattggtggatattcgatttatattatatgttgtgggcatgtgtttccaactcacccagcactacaccaacccaaattggtggatactaatcacattttaaggtgacaagggagctctaatgaatggagctgccagaaccaccaccactctgcaactaaatcccaagaaacaggtgttatttgtgttgcttgggacagtgaggggatactgcaggatcaagtcagacgacctgagatcaggtgtttaattacctcagcttttgtatccttcaaaactaaatttctcgcgtttttatgttaagataatgtgttctccaaaatctactccaccactaatctcttttgcaaatggtttgtcttttgttcagcttttctcaggggattgttctgcctcttctcagggagctagtactctactacagtactactaagtacggatatttacaattcaatagaaacacaacttactgatggttcttgtgtgctagaagctttcatgggcatctatcttccgttatttactagtttgctttcttgtatatacatcagaacctgtcctcaatatatcacatacatgtacctcttggttcatcatgatgttatgaacaattgaacaaaacaagtgcatcttcaaagagatcgaagaagcacaacttcaacgaagagaaggcaaaggcttaacacctatttttccatatcaggtaccattaaccgggcgtcatctgttacgcttttatatgtctatcttgctctgcacgtgtaaaacatggttgaacttagaaagaaaataacaatcaggcatacaaacatatactagcgttagttttcattgcataaaaaataattacgaatattgcacctgaatcatttgaaattcagtatgtagcatctcattctgaaatttaatatgtaggatttgggccaaagagaagcttccaagtttcaaacatatgggcatggaagctgctgtatggattatttaagattgtgggagacaagttagcaccacttgtaataagagagtatagttctcttatgggtgttacgaaagatctccaggagcttcaagatttagttgaggagatcaaaagcgggctacaggtagcaggtgataatgcaattggtaataaaccaccatctaattggctaaaaaaattgaaagattttgcttacgatcttgaagatttggtacatgaatttcatcttcagtctgagaaacatgacacagataatgatcgtgacaagtatgctgtgctcaaatacatgcgcacaaaaccaaaactagccatgtttcaactcaaaatggccaacaagataaagacaatcaaaaacagatttgctgcaattgtcgagcaaagaggcgatgtcaatactatattgaatgctataccaatcgatcataatgttcataaaaacaagattatcagtgagccatccttattgggcaatgttgatgactcaaaaatacatgtgagatgaggagaagcacaagatcatatgtaagttaatagatgaccaacagaaaatctcaatagtttcaattgttggacttggtggaaccggtaaaactactatggccacacacatctgtcatgacaacaaaataaaagagcattttgaaggctcaatattttgggttcacgtgtcacaagaatttgataataacaaactcgtcggcaagctgtatgaagccattttaaagaaaacatcatatcttcgtaccgaccaacagatggttgaagcaatttcaaacgagttgaatgggaataagtttctacttgtcttggatgatgcttggcacaagaatcaatatgactgggaacgattcatgctatatcttaagagtggatcacctggaagccggattttgctcacaactcgtgatcagggagttgcggaggcagtggaatctacatgtacatataagttggctttcttgtcagatgaggacagctggaatttatttcaacaaagtttaaggttagctgcaaaaggtctgccctctgaatttgtagaaattggaagagagattattaaaaaatgtggtggggtgccactggcaattaaaattcttgcaggtgtcctccgtaacaagaaaacagtagatgcatggtgtgccttacgtgatagtaacatgtggaatgttgatgatatagaagatagagtgtttgcgtcattaaggctgagctattttcatctgcctgatcatctgaagcaatgttttgtatattgctctatatttcctaaaggctacaagatctacaaacaccagttgatcggagagtggatagcaaatggcttcatcaatccaatgaatgagattgaacaagtagaggatgttgcaaatgactgctttgattctcttctgaaagtgcactttctccaagatctagaggtagatgagtatgatgaaatggaaatatgcaagatgcatgacctggttcttgaccttactcggcaaattttacagggtgaaatggtgtctcattctcagaatgcaactattggtaattcccaaaaatgcagatatttatctttggcttcgtgcaatgagaatattgaagtgaagttatttagcaaggtccatgctatctatatttctggtgacaacttcgcactcaacaagccaatcaagaaaaggtgccatgttcgttctattattttggagagtatgggcgctactaatttgttgcttccattgataccaaagttcgaatatcttagctattttcgtatctcacacgctagctgtcgagcctttccagaagaaatctcacattgctggaacttgcaggcccttcatgttacatattgcagggcacttaccacattacctgagtctattggtaagcttaagaagctgagaaccctagagttgtcatgtcttttggatcttgaaagtttgcctcagtccattggtgactgtcataatcttcaaagctttctcctgcgtggcagtggtatcagggagataccaaactccatatgtaaaattaaaaaactaagagtgcttaacattatgcattgtcgctctttgaggcaacaatggtcagaattctttgggacgctttgcaacttacagtccatcaacttagcacagattgagggtatccacaacttgttcagttcatttgcttgtcataaactacgcactttgacacttagtggaaccgaaattaccagactaccgcaatgcctcacattggtgagcaccctggaatacatagaccttcaaaactgctgggggctgctagagttatcggagggcatagggaacctagagaggcttgaagttttgaacctaaaaggatgctcgaatttgggtggcctgccagtagggattggacagctaactcatcttcaaaggctgcatttgtttgttataggtggcagtagcgagcatgcaacaatatcagggcttcgaaacctcaacttgttaaccgacaatgatctggaaataaaaattattaaatatgtagaggatccagatgatgcagaaaaagcctccctgaaggaaaagagtggtatactcaatttgacattggattggtcttcaaatggtgcagaagggtgctcggatagtctggaagaagagccattattagatatggaaaaggagctgcgtgtgctcaatggtcttgatccaccatcacaaattaagaagctgaatatctataattacaaaggtaagcatttctcacgttggatgatgaagcaaagagaatcctcttgttcagatagcttgttagagcaaattgatccacctcatttcactcaactgactaaacttgtattggaacaatttccaaacttggagaatctgcaaggacttgcacggttgccttcattgaatacttttgtattgaaaggaatgcctaatttggtggagttgtggacaagctcacctgcattagtaagtggggaggaaggaaagccctgttgtattgatcacgaacaagttgagcactgcttccctttcctatccactctagtcatgagtgattgtcctaagctgaagtaatgcccatgtttcccaccatatttggatagcttgacactggaacgaagcaacgagcagctgctgtctcaagttagcttctctcatccgctccatcctcttgacaaggaatcctcatccatctgctttagtgtggattcccctcacctcaagaaattagaactaggaggaatggctggatcatcgtcaggttgggaagtgctgcagaacctcaccgggctcgaatccttgtcaatttattccagtgacctaaggcaattaggggagatcatccggagcctcacctccctccagtatctttgtatctcgggttgcccagttcttgccatgctgccagagtggctggggggattccgctctctgcaaactctagttctgaaagaaatcccactattggctagcctccccaagtcgatcatgctccttacatccctggagaagttggctattgttgaatgcgacaatctaaggggagttgcctgaggtggtaaatcatctcacctccctcaaggaattggatatttctagttgcagaaatctgagccagttgcctgagggaattcagcatcttaccaaccttgaagacctaagtatacaggactgtcttgccctccacaagctgccagaaggactggggatgttaggttctctagaggaccttatgatcaatatcttgcctgtccttacgacccttcttggagtccatgcaggggctcacctcactccggcacatcaacttgatgagctgccctatgctcaccgtgctgccagagtcactcagacaactctccgcgctccgatcgctttatatgcaaagctgcactggccttcgatccttgcccagctccatacaacaccttacttctcttcagcatttggtgattagttacaaccctaccttgagtaggcattacaaaaatagggtcgggaaggactggcacatcatctcccatattcctgttgtggagatacgagattagggagcatgctgggcactaacaacaaataaacgagcatggcaaggtggtgacatactacttctgtggctctgtgcgactatgccttattattgcacgtctcttttgtatcctcaatacttgttactaatttcccaacccatcttttttctataattgttccagaaccccctgctggtggagtcgtggagcagagcatatgtgttcatgaaccagctttggagatgatcactctcaagttttgaatcttgacatgcaaggaaagatggataaggtacacactcttttgttttagttatcttacaagtgagaatctcagggcacaaatttgctgtttgagaaaaatgctcatttggtacttccactatcttttccaggactgcaatctttttttcttgccattcgaatttactgaacaaattaattaagcatgcttgcgcaagcaaacaccattctattttattctcatggatttccttgggaatattccattgaaaaaaaaactcttttccttggtccacaaaa

SEQ ID NO: 15602 - DNA, 1190 bp, Oryza sativa
taagaaactaattagcacaataaatgcctattattaagtagtttttgtgcaagtcatgctagttgccgaaggactttctggtattgatatgtttgttgatgtttgtttttctggtattgacatgtttgttgatgtttgttttgtagtggaatggagtacaatttgcctcatagccccttctcatctcccaccaaggcttccaatgttgcagcaacagctcacactagtaacatcagcagcagtagtagccctcataaggtggcctcatctctattccccccaacatgcacccttgagctgccccctacaactcatgcttccttcaagcgccaaggtaaaatcccaaaccaaatctcttccctaaatcactgtacatttgcaattccatgttagcatgtaattccatgttgcatttgcaattactgcagttatataagatagactattttgttgtatgtcttcagattctccccttgctgaggagtagttggtctatgagactacacatagtaaaggagagggggcttcatctttgctgagtaagtatcaggggaattccaacctttttggagtgaaacaggaatcaactagtcaatattatgtactatatataatctgcctcctgtcaagtcttgatgatcgtgttattggtttctttgtgttgtgtacagggaaagcattaacagatcatacataacgagaggaatgccgacaaagaaaggaaataaatttagcttgttttagctctagttcttgggtatatggtattactatagtaccagtcttttagctcagtgtcaagacaaagtatcaacttgtatgctcttttaaagtatgagtcaatataataaaaatatatcgtagctcatgtagtagtaacaaatactagcagtctagcagtgtgaagtggaactgctacatatacaaacattgaagagagcagtatatcagcatctgctactaaccaactgcttctatttagataaaaatgcttcgcgaattgcttgatacctgggccgtagcttgtccagaggcagcagatgttccttcacgagtggcaagcccagaaaaccctccatccatgcagacagccaagggaacttgtcgctggtgatcagcctgacaccggtgatgtcctcatatatcggaatcacatacgacagggagcccagagacaagtcgacgaaccc

SEQ ID NO: 15603 - DNA, 706 bp, Oryza sativa
cgaattcgagctcggtaccccttgacaaggaatcctcatccatctgctttagtgtggattcccctcacctcaagaaattagaactaggaggaatggctggatcatcgtcaggttgggaagtgctgcagaacctcaccgggctcgaatccttgtcaatttattccagtgacctaaggcaattaggggagatcatccggagcctcacctccctccagtatctttgtatctcgggttgcccagttcttgccatgctgccagagtggctggggggattccgctctctgcaaactctagttctgaaagaaatcccactattggctagcctccccaagtcgatcatgctccttacatccctggagaagttggctattgttgaatgcgacaatctaaaggagttgcctgaggtggtaaatcatctcacctgcctcaaggaattggatatttctagttgcagaaatctgagccagttgcctgagggaattcagcatcttaccaaccttgaagacctaagtatacaggactgtcttgccctccacaagctgccagaaggactggggatgttaggttctctagaggaccttatgatcaatatcttgcctgtccttacgacccttctggagtccatgcaggggctcacctgactccggcacaataacttgatgagctgtcctatgctcaccgtgctgccagagtcactcagacaact

SEQ ID NO: 15604 - DNA, 556 bp, Oryza sativa
  unsure (1)..(556): unsure at all n locations
nnnnnnnnnnnnnnnnnnnnnnnnnnnnnnnnnnnataactagttagctagtagccagtctttagcatgcctgagaagttaaataatttagtgggctaattaattaagtaatcacgacgtacatgggaggctatgtagtagaaggcggacgcaacgtaaaggtcatcctgccctgctccgccaccaccgttccagacgccattgaagctgcagttcttggtttcgcagggcgcattcaccttcagtaacttcactacttcttctctgcacttggggtagtctgcaccttgtggtgcggccgctgcgtcctactgcttgccggtgtaggtgaaattaccttgtttttgccaaatcaacaaaacaaattaaatctcacttggttcattaaacactaaacgttaattgattatatgaatcttaaaggattaaaggggcgatgcgtatagtaaacagaacaaggaataaaccagtatctaagtaccactgaatccgcgcagaatgcaagtgctaaatgggccatcctttctctttaagatgtgcgccccagaagaaaaac

SEQ ID NO: 15605 - DNA, 684 bp, Oryza sativa
  unsure (1)..(684): unsure at all n locations
nnnnnnnnnnnnnnnnnnnnnnnnnnnnnnnnnnnnnnnatggtttatctgacgaaatagtttcttaaaactactgacaaaatgttaacgatgatatgtttcctctgaaacaaaatggcctgacttcttgtactctctaaattttgttctttgttaattcaatcaaacatgtactaggcaactgccggactcagacttattggagatgaaaaggcgaaccagattcttgaagcggtacgtgcaattccacaatgatatacatcatatcatacaaaatttttaactcaaaaccatttcttgctttgattcttaataactttttgttcttaataatccctttaattagtactctgggtcttaatacaggttagggatgtagtccacaccaagagcaaatatcagtataacccgaactggatcaacgttcttgagggatcccaggaagggtcatacatatgggttgctctgaattatctcctggataaattgggaggagactactctaaaaccgtaggggtggttgatcttggaggtggatccgtacaaatggcatacgccatctcatcaaacaccgctgctaccgctccaaaggtgcccgaaggaaaagatccctatgttgtgaaggagtatctaggggaaaagatattacatttatgtgcacaggtcaattaataagttcacgct

SEQ ID NO: 15606 - DNA, 4850 bp, Oryza sativa
tatgaagctcgtgttcatgcagccaccaggaaaccataccgggggatatttggtgtttgcggctgaaggcggaggcggagtcgcagttgcgcccaaacctgtttggagaaagggcaattgacaaacaggtggttcccggtttctggcccagacgaacagagagggcaggaaggccacctgcgtttgtccaaattgtcggaggtcaagcagctgccccgagccgtcaggtacatgaacattttacagcgaggagtgaccttagccccccagactaactccacccataccacctttgttttccccatgaaaaacatggagtaagctgaggaggagtagtagtttccgtcggccgaaagcttccacacaaagctgtccctggaatccggctgtagctgaattgcctcaagccgatcccacaagtgcagcgcctgcatcgaaagggcccccttgatgtcatggacggacggacccaaccgtgtgagaggaagctaagatgttaggggtctaatctgacggtgacggaaatggaatcctatattttacaattaactgattttctttcttttacaatcaactgattttctttcttttacaatcaactgattttctttccaagaaaatatttatgatttaaacttgttatgtaaggagagttggagacagatagaatcatcgtgtttcacgctgggcaccaagaatcagttcttctgatcaatcaaaatcaataaagctagcgcactaggattacacacgtgaatccacagtgaaacctttgcaacacggccccgtctaaaagctgtttattacagtaaatacaattaatacggattgagtattgtactgtgctaatgggtggacactgtgattagggactgaattatgcagagtaaactctacgttagtaatccattaattcccctctccctttaaaacctgccccttgcattctgttgatgagcacctgcgcctcaccttgtctagttagcaatggcggctgatcaccttgtcgtggccatgcttctcctgctggctttgtcgccgccggccgttgctgacgacacggcggtgctcggccggaaaggcggcgtcgtggaagggcaggcggcggggccggggaggtacgccgtgatattggacgccggcagcaccggcacacgggtgcacgtcttcaggttcgacaacaagctggacctcctcaaggtcggcgacaacatcgagctcttcgctaaggtaaccacattaatctaatctactacctccgtttcaggttataagactttttagcattgtccatattcatatatatgctaatgaatctagacacacatataagtctagattcattaacatatatatgaatgcgggcaatgctagaaagttttataatatgaaacggaggaagtacttattaatatatgatgattcgttagtacctacttaattgagctattttaatcctactactgactgactaattaatttgtgtgttgttgtaggtggatcctgggctgagctcctacgctggacgtcctcaggatgccgcaaactccatattgcctctgcttgacaaggccaacaccgttgttcctgccagacttatgaacaaaactccccttaaacttggggtacgtacacaactaaattgatttgctctttatctaattattaaacgaaacctgcatcgggaacttaatttaaaattactaatacgtacggatgtttccgtatgatggtttatctgacgaaatagtttcttaaaactactgacaaaatgttaacgatgatatgtttcctctgaaacaaaatggcctgacttcttgtactctctaaattttgttctttgttaattcaatcaaacatgtactaggcaactgccggactcagacttattggagatgaaaaggcgaaccagattcttgaagcggtacgtgcaattccacaatgatatacatcatatcatacaaaatttttaactcaaaaccatttcttgctttgattcttaataactttttgttcttaataatccctttaattagtactctgggtcttaatacaggttagggatgtagtccacaccaagagcaaatatcagtataacccgaactggatcaacgttcttgagggatcccaggaagggtcatacatatgggttgctctgaattatctcctggataaattgggaggagactactctaaaaccgtaggggtggttgatcttggaggtggatccgtacaaatggcatacgccatctcatcaaacaccgctgctaccgctccaaaggtgcccgaaggaaaagatccctatgttgtgaaggagtatctcaagggaaaagattataacatttatgtgcacaggtcaattaataagttcacgctcttgttaagtataatttgatctttgtttaattttatatctggatccactgcaagctggtgaataatatactacttagaaagtgcaacattaattcatttgttgcacacactgtactagtgaatactgaataaactgaactattgaagcctgtaggctttagcctgttaatatctgaacttactgtagaaaatatgaaaaataatgcatatatagtcttttgaaccgtagtttactaagatcaatcaacaatttgcagctatttgcactatggcggttttgcttctcgcgcgcacatcctagagagaaaggatggaccatttagcaactgcatgctgcgcggattcagtggtacctagatactagcttattacttgttctgtttactatacgcatcgaccctttaatcctttaagattcatataatcaattaacgtttagtgcttaatgaaccaagtgagatttaatttgttttgttgatttggcaaaaacaaggtaacttcacctacaacggcaagcagtacgacgcaacggccgcaccacaaggtgcagactaccacaagtgcagagaagaagtagtgaagttactgaaggtgaatgcgccctgcgaaaccaagaactgcagcttcaatggcgtctggaacggtggtgccggagcagggcaggatgacctctacgttgcgtccgccttctactacatagcctcccatgtacgtcgtgattacttaattaattagccaactaaattatttaacttctcaggcatgcttcagactggctactagctaactagttatgtaaatatatacccctaaatatgtgcatttaattgtttgtgtaattatgttacatatacaaattaatacttttacctgataattttatctccaatgcatacattttgatcggaccgggataaaggttgggttcatcaacagcgatgcacccagtgcgaagtcaacccctgcaacgtttaaggctgttgcagaaaaggtttgtaaactgagtgtcaaagaagcaaaagtagaataccccaacgttcgtgatcatgcctacttatgcatggatcttatctacgaatactccttgctcgttgacggcttcggtacgtacactagcttctaataatggagatacaatatatatccatggataagaaattaactctaaagaaaaagaactcatatataggtgtgtaaattgttgaacaatttatctaacatgcagtttactaattaatatatatataattggatgtcaggtctacatccaagtaaggagataacgctggtagacaaggtgaagcatggggagtactacattgacgcggcttggccattgggtacagctattgaagctgtgtcacccaaaaaacggcttcgagaaatatacaaatgatcttgagatcgatgtactagctactttggaagttaggatatcgattgttgtatgatcgatgtctgtgtgctggttattacagtataactgagtatcatgatatataagtagtatgttaataatgggtcgagctatcaatagatcgaggcggccatgctctttgtcctagactccaagttgtgtatgtttgaatatatagcagctttctatatataattacgtactatcacagaaatcatcggttgtgtttgtgtgtcatgagcacgcatgtcttgtatgtaaaagactgaacatctggtgcacatttgagtatttgacctgacacaatcgtagcataatcatttttttctaagagttcagatagtgtagaaagtagaataaaagaagcatatattactacaagctaaatgtattgcgcgttcagagttaagagacaaagcgaatcatagcgtttcacgcttggcacaaaaccttgcaccaaagaatcagttttatatctatatgtatactagcaaaaaatactgcaacaggtgaagataattttcatgattgataaaaactccactaatttaaacgacaaaccgaaataagacaaacaaaacaaaattaggaatcatatatagcattgaacctagttgcgctcgtttcatgcatcacacaaagaatctcttttgtacacatttccatagccttacaaatcgttgggtggctattccataagttgacgcatgcgtatttctctatacctcattgaccaaagtttgaaattttgattattcaatcagtggaagttttttttaatatagatgaaaaacatttctaaagtaacaaacttgccacatataccttaaatattcataatatcaaaacaaaaatatttatgataacagaaatttgaaagagaaaactaagaggaaagaagagaacatggagagaaaagagaggagattggaaggatagggagaggatcaggatgatcaagagaaaaaagacactgatatggggagttgcacctgcggctccgagtggaggcacgcaggatgggctgataggatggtgtgggccagttgggatgggg

SEQ ID NO: 15607 - DNA, 1541 bp, Oryza sativa
gtacatttaaatttactaactgtggaattagactgcttcagtcataaatcaccatacaacactgctcggcaaatgtcaggcagtatttcatctaaaaaaaatcataaatcaccatattacgatttcgattgttcactcttactggtgaggatgcaattaacaattgctagatgcaatttaatttcatgattatgtagtctgtctacgtacctccagccataaaattttttgcactcatttttatagcttgctctttgaaggtgtcatacatattgctagtgtatgatataacagggccattaataatacagttaggtggtttcacatatgagcatgtttcacatatgagcatgctgaaaagagggtgcactgcattcagagatatgaccatgttgggtagttcatcattctctgattcattgaactgattggtctgaaaaattaggtcttgttagcttatgggagcgatggccgtatgcgatattaatgaaaaattgggcactgcagctgacttccttaaaaatagggaaaattgcaaaaaccactccaaatatcactctaagtttgagatgcccccctataaaaagatttgttgcaaatccccacctcctaattcaccttggtttgatttggacaccttctctctacacatgcgtttttcctggagcatctcgtggcgaaattagccaagtcccgcttgacgggagcgagagacgccgagacctagttaatcacaccgttccctccgagtcagtttgagtcgggagtggagattgaggcggcggtagcgggcggaacagctgcgaagatcgccgccgattgtgatgctttctcttgtccaagcgactagaaagggtttcacttcgacgatcgcggaacggacatacagtaagttcttgggtgttggtaaaatttgagatttcgttggcattacaatttacagagagttggtttttcatatgtagcactatcagattacatcctcgttagggtagaaattcatggtagcaagtggttatttttttggttttggcaatgtaatcaatggaaattttgttttagggtgttgttaatttcttggtactgcacaaagatcgtcttatacagaacaaataacataacctcttgttcctgccgagtgggactcgattgatttcaccatgagattctctaggaaacatgcatgtatagagaaaaggtgcctaaatcaaatcaaggtgaattaggaggtggggatttgcaacaaatcttcttatgagggaacatctcaaacccagagtgatatgtgagggtggtttttgcaattttcccttaaaaataaaacacagtgttgcccatatgacaggcagcaagctagcagtaaccaaatgatatatatgtgtggcataagactgttaagtatgtgcgtcatttagcgactccaatataatgcttttgctatcactatgctcagtaaatatatgttgtcagaaaacgcaagggttgggtgatctgcttaactccagtgaaggtcccaagctcgtcttcggatgtatgagcgt

SEQ ID NO: 15608 - DNA, 1035 bp, Oryza sativa
agaggtcgtgcgcctttgctggctcgcccattgggctgaacagaaaaagcttggcgcacacgaaagagtgcgagagctcagaaaatccctcgcagagccccctacctggcgcgccagatgacgaagcgtggggctccacaccggaagaccgcgcaggcccccctttgccggttcggccggggactcagggagagattctaagctctctgtatgtgaaaggctcgcgagacaggaaacacacaagacacaggcgatgtatacaggttcgggccactgagaagcgtaataccctactcctatgttttgggagatctgtgtatgaaggagctacaaagtatcagccagcctctcccttgttctgggtttctaatctagaaaagtccagtcccccctctcagtgggcaaggtcctccttttatatcttaaggggataccacatgcaccatttctctctttttttgtggggacttaccccaccttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccaggactaacgtgccatctctgggaggtaacacgctagctccagctggggacgagcgcctagaagcccttgtcctgacaaataggggcgaggtctgtgtcagatggcctgtctccacctaacccgcgatctgaccggtctgtgactggtcacagaccggataaacgagtgcactgcgctgcgttacatcccgcgtgtcatgctcagccaaacaacaataaatgtggttaggtgagccccactgtgctcacctaacccatacacgcggagcaaaaacccacgaggggggtaccgagct

SEQ ID NO: 15609 - DNA, 671 bp, Oryza sativa
  unsure (1)..(671): unsure at all n locations
tgnnnnnnnnnnnnnnnnnnnnnnnnnnnnnnnnnnnnnnttttgcggggacttaccccacctttttataaacagatggaaacttgtatggatgccgtccgaatgacctcctgataggacggcccatacctaccttcacttccgccggaagcatacgccacgtgggccattgtgtctgcctcaaacctctaatcatagatactcctgatcccatgtcacccacaaaaacctatacaactcaaccatagagcactaactctccaaaataaaaacaaagcataaagggtgaccatgccccaaaattgtattgcatgtgtcactcttttttacatacggctcgattctattcataccccagaattacaaaatacctccataatacacacaactattatctctaacaaactctaatataccataaatctttacagcaaacttttgcccaaacatatctctaaaaaaattacatacaataccctaattaatagatacaattgccttcccaaaactctatccatgcatgacaattatcttgaaacacatcaacttgaaccctatgacttacacccagtcatattaataaaaattggctatattaaactaatcggctgtatcagctaaccccctccaactcaaactatatcaacctgaccttaacccatttggactgc

SEQ ID NO: 15610 - DNA, 6512 bp, Oryza sativa
  unsure (1)..(6512): unsure at all n locations
gcatgcaagcttcacccaccgaaacttctttgcactccgaatgaacccggtcttggtaatcgctgagcttccttgcctcagtattgccctctgtatctcaattgcagactgcatccctttccgcagctgatcgacattgctcagcgacaatgcagagtatgcaacccagaattgctcagcagcagaagaccccttggagtccttggactcagcattcagtgattcaagcaaagctgtgacgccataaacaacatctgcagcagaaaccttggagcggtacccatgcaccctcaagaaactccgataatagaactcggtgagcccatactcaggcaagaaccgatcaaactcatcacgcatcttccgcttgacctccatgctcatgtactggaacctcttctggcagtcggcgagcgggaatcccatccttgccagaagcagcttcagcttcttgaggccattgtcgctccaggtcttgagcttcgtcgcgacatacgacgagcagagcatggagtcgaacagactccactcccggagcagcatcagccgcggctcgtcttcataggcgatgcgtgaggcctccggcgcccggatcttggtgccatccttgagcgtcaccaccgcgcccacgccagatggatcgagattgccagatccattgatgtgctggtcgagctccatgacagcggcctgggaacgctcgtttgtgatgcgctcctgggcacaatcttgtttgggggggacacacaggcaaaccagaggagctcgtgggtgttcttccgcagcgcgtgggcgagctcgtacatgaggcaccccgacggcttcccgtggaaggtgccgagccggtagtactccctcctcagtttcccgaacagcctctccgggtcgccatccgctccgcatcgtcggagagccgccgtcttttccttctcccacccttgccgtnggaatccgagtcgaaagcatcggaatcttcgtcctcctcggcgacgcgaaggtggtcgtcgccccccccctgagcggagaggtcggaggcatcggctagggaggagacgtcgaagtcgtagaagagatcggcggtgtgctcgtcgtcagtggtgaagagcacgacgacgcggtcgttggccgccgaaaggttgtggaggtggatggggcggtgcgaatccacgacgaacgcggtggcggcggggggcagcacggcgcggaggtcgcggtgggcgccccagttgatgaggaggaggcagagcggctgggatgcggagaaggaggcgaggagggaggcggcggcggcggcggacgcgacggggtagatggagaagcggatggagtcggcggagaggacgtgggtgagcaccttgagcgcgcagagggcgtcggcgtcggcggcggaggggaggatcaggagcggcgaggatgcgtcggcggcggacgcggcggcggcggcgtggaggcgcgcgtagaaggagtcgaggcggagctctcgcaccattggcgcatcaatcgaagtggtgaattggaggattggggatctgggaggaatgggttggaatttggagatggagaaggggacgaagaagaagaggatgaaatggggaaattgaattgaagggatttgggttggagaggggcagcgcggggaggaattcggaaattttgggtttgggagggaaaccactcgatcgaaatttggggatctcacgattcgaacccccgcgaagtttcagtgactgacatatggagccgattgctcgtaggccgtcttagaagaattgctcttgggccgcacgtaaaccgcatctccgttccggtccaattaacatgggccgcacgtaagtcgctgcgccgttccggcccagttccgcctgcgttggtccggcggatcgtcacctgcgtcgtaggcctgcacttgttcccccaacgtcgccgcgtgctggtccatccgtcctccctcctcccgcgccacaccgccgctccgcatacccacttggccggccactccgccgccaacgccggcgcggaaggggttagagcatctccaacagagtggccatttcactatctaagttaaattttggtaattttaagtaaaaaaacgggctctaacagacttgctaaacggctgaccatgccatatggctggctaaactcctccctacgctggccaactgtggccagccagagttgccttgcaaaatcgtgggccccacgcattttttcccatctcctctcatattctctctccgcagtcgcaagcgcgccgctggcgccagcgccatccctgctgtcgtccgccgtcatccctaccgctgtccgatgccaccaccgcaatccctaccgccgctccccttctccttttgcatcggcctcagaggatttggtggtgctgctgctccgccgttcgtcgtcactcacagcggcgccgccggtcctccggtccgccgctccgctctctccggtctccgccgcccgcgctgctcccgccggccttcaccgccccgcctctcccgccggcgtccatcgcctccaccgccccgtcgtttccatcggcctctgccactcgcgccgctgccgccggcgtccatcgtctccacccccgcgccattgcaatgcagagaagagaggagaagacgagagagaagtggatgaaaaagatcacaaataaaaagtgtgactgacatatgggacccactgttaaattggagatttgaatggagagactgttggagtgaaattcaaatttggctctctaaatttttggcaatttgctaaataggacatttggagaggcaaaaatagccatgttgttagagatgctcttaggatgagagaaagaggagagccccgccgctgctcttcgtggtcgtcccggcgccctgctgcgcttgcaccgaaaaaaagaaagggagagacagattagtagagagaagggatggcatgcgcgttccattttattttttttaaaatttattttatgactggactatcacgtagttctcgcgtcaacgtaaaccgctcttaaaacatttgagagagtttgttttggactgttttacttgttttgcaattaaggaatataaattagatccatccactagttaacggagttaaagtgaactttttctatggctgaatggccaaggattatctgcatgtaggcccagtaagtgatgagatcaaatactactagctttgcatgttgtatgtgcatgagttgattcgaaaattacaaatattatctatatctacatacctgaatatatgcacaaaccagtcatgcatgttcaaagtctgagacattagttgattggatatatatgttgagctgcaatcaaaactgttgctattgctagctccaagatgtttttggcatacctgcatgccgcctcctattagttggtacgaatgggcccaagctaagctagcaggagtagcgctgaatccaagattgtagctctagtttcacacgctaggtcctcctcgtaaaattggatggaactatggaactcatgtgagttgtgtgagctttaggtttggagccacatcatccgagagaacgatttaccccttctatttacatgctgaacggactatgcttaaattaattatagtgaagagtaaattgcacttgcagtaaattaacctgtcaggttcctatcttgaatgtatatatagtcttagtagttaattgttctcacatattgtccttgtccatattcatatctaaaaatacactcttaaagaaaggatgttgtagatgaaaaaaatactagatagacacacatcaattcaataaaaaaagtatagtataagacataataataatcgtaaacaaaaagatatgaaaaaccaaaacaaaatgatgcaaggagtagaaacatagaaagagaaaatagagactaagatttcaaatataacatgtctcatgcatgccacctcaagtcctaatcaacgacaacttagtaaaattagcctttcggtgtcattttaactttggttcacacgcgtcaaacaagttcatatatcaaatgagtgttttacaagttcatatatactaacttttaactaatataatttagagatgatgtttttccccgaatcatgtcaattagagatggatgcttcattacttcataagcatggatcaatataatatcatgatgatattgtgtaaagtacaccaatttttgcatggtttcgtaaataattgtggtctcaatcactataaaaagatgatttttcatagcatcaccctataattttcgttggcggctatacgcgaaaaccgccaacaaaaacgtaacgaggggtggagcctatggactgacaacgaaaactggccgcgctaaaagatctgccataaaaaactctatttttcgacgcgaaacttcttaagtgtccgccaacgaaaatcacgttttcgctggcagtagataaagaggaccgctggaaaaaaaatccaccgcgcacctcaccgcccaccaaacgccaaataaaatccctctctccgcctctctccattctccctcgcatctctccttctccctcccatctccaccaccgccggctaccatcgccaccccacccacccccagtaccgccgccatcatgccttgggagcggcgcagggaaggggggtgccgtctctcgtcatcagcggcgcgcgggagggggcggcgggagcggatccggcacctcctcctctctccccaccgacggtggcggcaaagaggagggatggcggctcgcgcaggcagcagcgatgcttgggagaggcgaatctggcgccgacatgcctcaagagggtggattaggcaccggtgggcctccagagggcggatccgccgccgccaggcctcgagagcggcgtggggaaggaggaggcggcgggagtggatctggcgtctcctcctccctccccaccggcggcggcagcaaataggagggatggcggctcgcgcaggcggcggcgatgctcgggggaggtggatccaacgccaatggtgcttgagtccaaccatgacaacctcgagtgcgacgatgctggtggcgggtttgcttgggccaacgatggccagcggatttttgtgatgatgatatcttgttaatatgttatgttgctgttaatatgttgatatttgtgatgctctgtatttggattgtgcttgaatgatgttcatgtccattttcaatttttttttggcaacttcctggatgagatggtagaaagggattctggggatttattttttttcctgaaaatcattttcactagcttttggcataatcttgctgactgcagaagtttatttttgctgggagttcacttaatcttgctgccaacgaaaatagattattttcacttacctacgttgacggttagcctagccgctagaaaaagcatattttagcagtcaggaaaaaccatttttttcccgtagtgattatgcctgcatcaaaactcaactattaaaagccatacatgcagctaaagcatcggcacgcatgaagcacgcgcagttcaccatccatatatatccttttaaataataagtttgcagctgacatgtcaatttaaatggccgcgctctgcagctgtactgtacttatctcgctcgtgcgtgcacaccaactacactgtaactttctgtacgtgatggatagatatcagccccgtttagttcctaaatttttttcccaaaaacaatcttttaagcctaatttgtctcgcggtttccaggcgagttataaaattagtctttttatttgcgtctaaaaatcttttttaacatccggtcaaacgttctatgtgaaacaaaaattttcatttcaccaactaaagacctgatatactcttatcctgcgtacgacaggtcgacagctttcctagctatccgcctgacgccactatctgactatctccaatactcctcattcacaaaaaaaatgtggactctttagttagctacccgcgactgatcagctcaacagcatgatgtgcatgaattttgctgttgcctgcatgcctacgtgtcgtgcatatgcatgcttcaaattaaagggagcatgtataatataattgccaacaattaaaagagattctaaagagcttacaaattattggacactcgatccttattagctagtactatataagttgcaattagcatgcatgttcttgcttatgaaggtgtgaattgtctttatttaggcctatatgtactgccttatttctcaaattaatggatgatgttttgaatatcgacatgcatgatccttaatgcacatctttaatttattattattattttaagctagacatttataaaaacttatataaaactataactatagaatttgtttgtaaaaaatctcctaggataacattcagactttaaaattccactatttttgtattaatggtttaaggtttagatcaggcttgactacacatattctagattctaggatatcatnnnnnnnnnnnnnnnnnnnnnnnnnnnnnnnnnnnnnnn

SEQ ID NO: 15611 - DNA, 3207 bp, Oryza sativa
  unsure (1)..(3207): unsure at all n locations
nnnnnnnnnnnnnnnnnnnnnnnnnnnnnnnnnnnntgcccctatctcacataagtatggtcgtgtttttatttttagtttttcttcaaactttcaacttttccatcacatcaaaacttttctacacatacaaacttccaacttttctgtcacatcgtttcaatttcaaccaaacttctaattttggtgtgaactaaacacagcctatagagagagtttgcttgtatattcaacttccactgcatgtcaattatatatgcacgaagcctagaatggataggatagagaatatacattaagttgactcaatgactccaaacttatccatttcaataaaaatccaatattaaacgctattccatgcatgctcataaaagtagaccaaccaaagcagcaagacgccatcagggtttcccaaactgccgggaccggggttaccacgcggtaaccgtgaaaaactgtacaaaaccgtataaaatttattaaaaattcaaattattttttaaatttatttaaatttaaggaggttaccgcggtatttatattaccgtacccccgcggtaagcccggtaaccgcggtaaccagcggtaagggaaaccctggtcgccatcaccggccacaaaaacatataataaaactaacaatagttgtctgcgcaatgcatggcctttcttctatttttgtttctttttttttctaaattcacttaattctggatggttaagattgctacaggatccattcaaaatttctccatgttttcccattgtatgtcttcatgaggtatttctctattgttgtatttattctacttgctcagttttgataagccattttcattcccatctgtaatggattggttccatgagatccgagatgctaccacttcactcccacttccccatagccatggctaggccccaccaccccctccaaatctctctttccttgttaataacttatcctcttcctccgattctcaccctacagtacactcttccaccccacccatccttattggaatgatctaataaactaggggtgcttgttgcatccgccatcaaatatatcctcccacattatctctcttccttaatcaccagacttgctttggttggaggttaaaaaatggagacaattcaagaaatgccattttgacaagcattcaaattcaaaaaaataccatcgacgagtgtgagttccaaaaaatttcagagtacaaacgactttatcccaaaaatgtcatcgccgttagggttccgtctatcccgcgccattaagtgctataggatgaataatgtatttaacggcacggaatggacggagccctaacgacgatggtatttttgggacaaaatgattttggggcgatgtcatttcttgaaactcacacttatcgatgatattttttggatttggacatttgtcaatggcctttcttgaattatctctaaaaatgtggaggttcgatcttgaatcaaccgatgtacatatgtagtacaactaagaagaataaaagataaactaaatgaaataaatattttattagggagcgccaaaaagtagttgcatagatatatatcaagagatagactcatataatgcacaaaaaccaaaatgtgatatccaaatcacattgcatatgcatcaaaaagctgccaacgacccaatcatacactgggacacatgcaagaggatcgatcgtgtggttgtttctgcatgatatgtgtctatgaaagcgaactagagctacatatcatgatttatatacctggcatgcataaattaaagttttgttttgatagatggatgttggccaaagaacaagtcacatggacttcgcccgtgcttgctcactcacctaaaaatggacctgacctttttggagggtcaagtatagtaggtgaagaatatatgggcatgtgtatatatatactttgttaattagttagctgagaagaagaaaaatgagaaatacaccaactttgtaataagtacagtaagttaaagaaaattaaatatagttgcatgaccatgtaatccagttgatcactactcatgggtataattaaatttatccttaatcaaagtcaaaaaaattatccttaatccactcgatctgaaaagcatatataagagaaaatcctctgaaaagtatcaacaaacattatggtttcggcagtgacagtcagatacagagatgacagctctgaaaatgatgcaaaaattgacatttgacaactaaatctcttgcatgctccagaatagacagtacactgaatagatttaatctgaagcagctaaattgtatacctaaactctgaagaattgactagtaaacagtacctctcaatcttctagagcctatacaccaaactagaggccagcttcctttctgcatgttgattttttgattccttgttttttagtacacaatatttcttttcatgaagacaaacgattttatttacccatgatgcaggaacctagtctctgttgtagtgttattgccattagcctagctttattttaacactcaagctatgctaggtaatcactttaacgacagaaacaacaaaaaggagttgatgtttaaacggctaacagttgacctgcagacttagagtatatatatagctctaatacttttcaggcatgaagatccaaatgatgaaccctcacacatgctagtgacaaaataacatactataataaccgcacccacaccttaattttttcttttagtaaaatgaaagccatcaagtaaatttgtgctacggcagctcagaagtcagaagaagagaacaacagtgtactaagcagatgataaccaccaagaaagtaccaactgctgcaaaaatctgttcccagcatatgaaagttaagtgacaattaattcagatatacaactactaatagtcaaacagaaaagcacagttattttagagaatataattaagatgttcatctgaatataatctgtacatggacacagcagttacatgaacgcttcttatgcgtatgctttttaacatatattatgttacattacacaccatcgattcaccaaaaatcaaaatatgaaagaaaaaaaggaagagaactttttaatcggttcatacacaatcagattcattcatccannnnnnnnnnnnnnnnnnnnnnnnnnnnnnnnnnnnnnnnnnnnnnnnnnnnnnnnnnnnnnn

SEQ ID NO: 15612 - DNA, 2679 bp, Oryza sativa
cggcgcccgacgccatgaactcccggcagccgtcgacggcgtgcccgccgatgctggcggcgtggttgcgctggcactccctgtaccgcaccaccttgttgttctccttcctccccgccgccgccgccgccgccgtgctgccgttcgcgtacggcttggccgccgaccggtcttgctgaggccccatcgatgatcggtcacagatcacacctcgccgccggcgagcgtcgacgacgttaggtggcgaggaggagaaagggaggaagaagagaggaatggaaaagctttggtatcacggctttggatggtacgtacttatatggaggagaggagatgagcaaaagtttatctttttctttttttccttttttttttgttgagaggaagtttctcttttttattttgtcttgttaattactttacatgtactttgctttcttgatctcaaatatattactagggcgtgtactcttttgcttgtttatgcatattgttcacttgcaaacaatttaccttttttgttaaacaagtcatgcacatgagcgaaagagtatttggtctagtggtttgcagcgacctagtatcccaaagttctgagtttctatctctatagaagtgaattttagattgggttatctgagggactaaattcttgacttaaaatgttgtatatatccggttggatatagagacgtgataaaaaaaataccattcttgaagaaaaacgtcatgcacaggaactagcgcggcactggtataataaattaatatctttgagaaattgaaatattggtaccactttctattctgtacagcaattgtaccttttttgcatgatgattaaattagcaagcaattaactttggttgaacatattagtggcatgagaggactacattgaattgttaatcagtagatactctcagtgatttttgcttatcatttttcaggtaagtagataaatttgcactcgtagttaagttggtttctcagagaagcattgagccttttgaacttattatttattatattattatttccatagaaatggtcatgttgagcacgttggcacattaagcatgatctagtagctagttttggttgttatttctgttgctagtgctggaatattttcacttggaaaaagccatatcttatcttgtcctcttgtgctatttgccagtaccaaaaggcaactgcagagcattcagtttggtgactcgtgtgtgccatttagttaaggaccaccatgaccaactaactaagcattttaagtaggtcctttagtggacaggattagatatgaattgacttgacaaaacgtcttatgcgtctcttaggttgatggagattcgtctaattgctaagatggtgaccggtttttgttcactgacatggacatcttgaagaaaaggtgaagtagtgtgggggagaaagtcaaaattcagagattcagtgacttgtgcacaacacaaagcacagaagaagaaggaaatttagggatgagaggaagtttcttggatctacatgggaggttggattgagaagcactcttctccaattgactcttctgttcatcatctgtctgctacttgcttgtgccaccttctcctccatttttcaggaacaagtctgtccacttgatcaatggtgccaagctgtattctctgttgtgtagagaattatggtatgggaccttcctgtacgtcttcagaacatacctaattccaatgatgcatatatgtcctactgcccacatttgagcatgatgaaatcatgccaattttttccttgaaactaaatcattaggagaactaccaattatatttcaataaatataagtaaaaaatccaacagattaaaagaaaaagagaaaaaacaacatctcgacaaggacaaaaccttgccgaaagcttcaaacggtgggcggctagagaactaaacttacaacaccagctcgctaacaactaaacaatgacggagcacaacacaaggcatcgttgccgagctcattgcaaaagcaacacagctttggctttgttgcgaaatcatgccactttttcatgaattacctttaatctcactatcaatcaaccacatttgatctgtgtgtgactgctagctcttgtcacaaacctaagactttaagctagttcttccatgcttggtaaaacgacatctaatctactgaatgcaatgaacgtggatattgtcccaggttgaggtttggtgatatatatgaaagattccatgacatctgctttatcaagttgagatctctcctcaggaaatggaaaatgatgggctgtagaaacgataaaagtagatcactgatcgccgcgacaaagatacagaaaggtcgtattcagcaaccaaacttgtcttctgtagtggaactggtcatcaaataatttatgtctgatctatcaaaaataaagaaaagattaggtgccctagtgacaaaaacagcacacattctttgctttgcttaacttttaattattcaagtgaaaaagaagagcatgttctgaccaaagaataccattctgagccttgtcaagttaatttgtcaaagactagtaaaataggtgtccctacaaagaaaagaaaaaagaggacatgttttcatgaaccgtcgagtagactcgttcgattattagcacctaaaagtctaagaaa

SEQ ID NO: 15613 - DNA, 6746 bp, Oryza sativa
aatgacggagcacaacacaaggcatcgtggccgagctcattgcaaaagcaacacagctttggctttgttgcgaaatcatgcaactttttcatgaattacctttaatctcactatcaatcaaccacatttgatctgtgtgtgactgctagctcttgtcacaaacctaagactttaagctagttcttccatgcttggtaaaacgacatctaatctactgaatgcaatgaacgtggatattgtcccaggttgaggtttggtgatatatatgaaagattccatgacatctgctttatcaagttgagatctctcctcaggaaatggaaaatgatgggctgtagaaacgataaaagtagatcactgatcgccgcgacaaagatacagaaaggtcgtattcagcaaccaaacttgtcttctgtagtggaactggtcatcaaataatttatgtctgatctatcaaaaataaggaaagaattaggtgccctagtgacaaaaacagcacacattctttgctttgcttaacttttaattattcaggtgaaaaagaggagcatgttctgaccagggaataccattctgagccttgtcaagttaatttgtcaaagactagtaaattaggtgtccttacaaagaaaagaaaaaagaggacatgttagcatgaaccgtgaagtagacttgttagattattaccacctaaaagtctaagaaatcaatcaagtaactcgatcgaattctgctcctgatcttgctggcattatcgatggaccagttatttgttttctctcaggattctagaaaacatcactgcaaaaatgaaaggaatctctcaaactagtaccacacctgaagtccttttcattaaaacataatctcttaagaccctatgattagtacaacgatgtttttaatatctccatcaactttaaataacttataatatatcgttgtacatgtgccattgtctcttcagtttaaaaattaaaatatgcacttgatgaaaagtactattagttttctctacagggggttatgcactaaagttctaaacagtccatgctcatatttacttacacccaaacaatgaacttgagtaaaatgcaagaactaacttatcatcataagttgaaagaataaacataatgatacagttagttataccccacgggatgcatctcatcagtcagtcagtcatgacaaccaaatctttgaaaagttaaccaagtacaccggattaaatggatttgcaaagtactgaagtactcttgaatctccatgcttgagtaaggaaatatggggctcaattttgaccttatgaagtactagtagcaacaacattagggcctactggctggtggataacgtggaatttggctccaccaatcaaatcattacagaaatattaggacaaagctggggcacacctcactttaaggttcatcaactctggtgtcttctaatgctatcctctggcgattagaatgtttgttattatcaaagccattgcccatgaagagcaatcaaggatcagatgtacacgaatggtttgagtcgccatcactggaataataattcagctcatcatactaatttattttttcagcaaatgacatgtacagtagtgttggatagaagctgagaaggatgtgaaggtgcagggtcccccacgagagctgtttatgctttgatgtggcgatccaacaacatacagtggttgttgcaaattggctggcgtccattgcaatattgcattgcattgcaatgcgacgtatgtgaaattggcaaattgctaggtgcatgtgagattttgtgtttgtgtgtggcttgcaattgaagggcctttcttttcggccagcttatcctccgcaccgcaaatctggttgctcgcttcaatgaatgtcccagcctgcatcaatgtctgtcaaactcacaattcacaactggattgttcaacaacttttcagcaaagattttaaagaacaagtttggtttgcgcagcaggttcatcccccatttagcacaattctgagcagaaagcaaaacgtcaagaaaccaaaactaactaaataacgctgatgcttatctgcagatgtcaataaaatcggtggataataggctaggtgagcgactggagaagcatgaagagggtgagtagggtcagtgtgcctgccactgtaacaccgtgaaatggatggtatctggttggcgtccaatcgggcgtcgcgagcaagcgacactctgaaacgggacggaaggagttggtctcggagacaagaggcatctttttatcttgcaatcgattgatctcctcctattctttttctgttgctagtgactagtgatggcgattgcaatagcaaaacgggatagctagcatctagtactacctctatattccttccccatatcgttcgccagttgttgcttctgggatcatcgcgtggcatctcacgtagtatggtgctactccatccgtgctagtataatataagagattttggttggataagatatgatcttagtacaataaaatcgggatatacctgtctgttcacattcattgtaataggatgtcgtatccaactaaaatctcttatattatgggacggaggtagtagttttcttcttccatcttggagcatcaaagcttggtcgctgacgccagcctgacagtgaagcagtgatgcatgcgtgacaaagattgagatttgataagagaggcctaaactgaactgagatgcagcccacgagggaattaacgggcctcctagtacttatggccctcggcctataaatatatgggccgaatgcttatgggccttcacacggcccatgagtctgctctcgtcgcaaccaaaagtcttcttcttcttccccttcctttcccttctcatccatggctactccagcctagggagtagggagatcgatccacctccgccatgctccttcctactccaccaatccggccatgaccggagctcgccgccatgccgccgcgcgcccgcaccctcctcatgccgcttgcggcggcgacgctcctcgtcgcctccaccatcttcctcttcgccgccaccggcgctcgatggcgacccgccgacaccggcctcccggtccccgccgccgacttctctgcggccgtcctagagagcgcagtgaccgacaccaccgccgccgcgaaggagctctcgttcgttgacgagaatggccgccccgacgatcccgcctccagctcggcggccgccgcgagatgcgacccgacccacgccgccgtcagggtattcatgtacgacttgccgccggagttccacttcggcatcctcggctggtcgccgccgacagatggagccgccgacgccgccatgtggccggatgtcggcagcggcgccctcgccccgcggtacccggtggggctcaaccagcagcacagcgtcgagtactggctcacgctcgatctcctctcctcctcgtcgccgccgtgcggtgccgccgtcagggtcgccgactcccgcgacgccgacgtggtgttcgtgccgttcttcgcgtccctcagctacaatcgccactccagggttgtgcctccggagaaggtgagcagggacaaggaattgcaggagaagctggtcaggtacctgatggcgcagccggagtggaagaggtcgggtggcgccgaccatgtcattgtcgcacaccacccgaatagtttgctccatgcccggtcagtgctgttccccgtggtgttcgtgctgtctgacttcgggagataccatcctagagtagccagcttggagaaggatgtcattgccccttacaagcatatggctaagacgtttgtgaatgactccgccgggtttgatgaccggccgacattgttatacttccggggagcaattttcaggaaggaggtaacacgattaataactatgcttgctcattcaatctctacaaatgaagttcatactctctgaggtgttaatataacataatgttgacagcgatgtagtgtttagtttctttgctttccttaagtattatattttcattgcaactgctatctaaagtaacaagaactcatcttttgtgccaaggaaaggcttgtagccaaattagacaacaaaccttgagaacttccagggtatagaatgtgtgtttgcaattagttgtttatggtaaattgttgataaagtgtttgtttagctccttttttcccttcaatgatactcttgtgtatgttgttggtcactggggtagtaactgatcaagcacacgtcgtgtctacctgtatcttcctaaattgtatcaaaggcatgcatccctcctgcatgttccctcaaaaagaaaaaaagaatgagaatttgggcaggataggttaatagagggtgggctaactgcttcaagtcaaatggagcttgttggaactgcaagcttttgtctagggctcaaggtagacaagagtagttctgtttgctcaaagtgcagaaatcatgacccattaatgactttggaataaccgaataaatattgctttgactgcaccggtgcagaactcatgattatcaacttcttattgagtatatgactacactagtactctctgatattccaaagatcagcaaattaacaggtgttccaaataaatgatttgtcaaaagtttctgtcaagttagacaagagtagttctgtttgttcaaagttcagtgcttatgatcctttcataaatttggactaagatacgttttgactgcactggtacagaactcatgatctatgatccatttatgaacttcttactgagtatgtctacatgtcaatctccaaaatttcaaagtccatcaaattaacagatgttacaacatatgaatcatcaaaagtttgaatgccgacatatcagcagatgttccctgtttcagccatctggcatcaaataaatttactgtgtcaaaactttttttttgtcagctggatgtgtatccttctttaaaagttaatgttgatacatgtagactttaggttattagtttatctatattatctatatgctacaaaactagcgattcatggactaataaattgcatcatttttgttcagggagggaacattaggcaggagctatattatatgctcaaagatgaaaaggatgtttattttgcctttggaagtgtccaggaccatggggccagtaaagccagtaagggaatgcacgcatcaaaattttgcctaaacattgcaggggacaccccttcttccaatcgcctgtttgacgctatagtaagtcattgcgtccctgttatcatcagtgacgacatcgagcttccttatgaagatgcattggactattcgaagttttctatctttgttcgctcatctgatgctgtaaaaaagggttacttgatgaggctgattagaggagtaagcaagcatcaatggacaaggatgtggaataggctgaaagaagtggataaacattttgagtatcaatacccatcacagaaggatgatgcggtccaaatgatctggcaagcattggctagaaaggtgccagcaatccgcctgaagtcacataggtctagaagattttctagatatgatagaggaaaataaacatggagaagatccattagtctagaagattttcaagatctggcacaggaagaaaataaacaggaaggcggtgtatgcatgttatctagggccttggctaatctaactagcatttcactggcacatccgttgcacacgtctcatggtttcatgaacataatcggacagattagcaaggaacagtgagatgtaaagatatcaggttaattgttggctcatagcttaggttaggctgtccaaccgaagtgtatactggcaggcaaaagattgttgattttgtaacatatactcttaaaagtaaattaaaagagggtggcaaagttctttttctgaacatgatgttgtgaacagcattagacttggtcatatgcgaggttaagccgtcttatgtattgatgagtaatttttgcatttgctgttccttggttagttggtttgatcagctcttgggcatcagttatcgtaccctaggcttacaatagagcacaccgttcggggacgctattgttgaacagaaataaggtccaagaaaagctcagaattcacgggcaaactcttgaacggcattactttcctcctatattctgatagcagcgaaatctgtattacagctctattctaatgagctatctgcaattctgcatgcattaagcatttaagctacctgaatctgcagtttgccgctggcaatcatcaggaaaataagaaccacatgacagttcattaatctcttttaacagggtaaccatttatacatttgatatgaagagaaataacatagttcttattttcagagtacatttgggaacagggaaagcaaagcaggtgatcatacagacaaaatacccaagcttaagctagccttagtcaacctaaaactaaaagggaagtatcgagtcggtgacaaacctagccttagtcaacctaaaactaaaagggaagtatcgagtcggtgacaaacagcgatagatcagcaacaaagaatgaagaagccatcgacaacaactggtagtagaaaagattaaatatgatcttcatgactgcatcagttttcttcaacatactcgccatcttcccgttgttgcaacttcacaccaacgttcagagtcatattcagaagttaccctcctttgcttacacagcagcagct

SEQ ID NO: 15614 - DNA, 995 bp, Oryza sativa
ttttcaaaaggttcttgcaattagagtccgcatcaaaagttcaaaaccgaggagaaattagagtccacatcagccatgcatagcaaaaaagacatggattttaacagtgcgtcttccaaatttctcaaggacacaagaaaatatttgatttgtatatcattgaagggactgtcctcaaaccatcaaggttccgtttggtccacagaatagaattctgtatatcatcctctttaagctaataattgattgatataaacctacaacatcatcgaaaacatggcatgctaatatacatgacattgaactgaagtggagtgatactgtaatatggacatatttaaaaactaaactacaaaactaggatgaaaacaaggtttcaatgataattaagcaaaattcgatatgcccaaacttacaaagtaagctcaacaagtacaatgctaacatatctatgcacatgttcaattacaaaacatttgtatactatcctaacacattctacacaaacaaaaagcgcttttacatccactattgccaaacaggatctacgaaaccactaacaacccaacgcacattgactaatacgagaacaactaaatgaatagaactccgaataaaaaaatcatcaataaaacaatggcagaaaaaacgcaaaacattgtgatctgtttgttgttttggtgaacccgcgcggccatcatcgcacgcgctccgaccgcgggcagtcgtcatcgctcaccgccggcgagcgccacggataccaaacccgcctctttccccgaacaaagcgcgccaccttcccgccaaccgtacgaggacagcggtggcggcgcgaatgccggagaggcgactccggcagccgcggcgccgccggacggcaagctcagataagatcaagtagtgttcgtgagggtcgaaaccctagctcgccgcctcctcccccacggcctttttacaagcgaaaaacgcgcccaccaaatgggctcgcgaaggcc

SEQ ID NO: 15615 - DNA, 714 bp, Oryza sativa
  unsure (1)..(714): unsure at all n locations
nnnnnnnnnnnnnnnnnnnnnnnnnnnnnnnnnnnnnnnnnnntatactacatagaagcgttagtatatttccatattattactccagcaggaaaatattcaatacaagcgacatctgattaagcagttcagcaacctacaaatttcaaaaacaaaattaaacatcctcgattctttcaataaataaataaatttcaaaaagaaaaattaaacaccctacatcaggccaggtcagctaaaagcccaacacgcttggggcctaatgctgtctgtgcttgggccggcccactcaggtccacttccggacccacacgccagactctctcgaggaaaaaaaaaaagaagtaatcgtggttagcaacctgccccttgttccacaacgacgaacaacatctcgccacgaggaggagggcgagagcttacacgagtccgaaatccccaatccgggatcccctgcttctcttcgcgccaaggtaagatctctcacggatctctgtgcttggcagcgcggatcgaatttttgtcattacttgtcctaatttttgttccggggtgtctaatttgggtccgatccgatcagatggcggctgcctgggcggcggcggtggccgtgatgctcctccttgcgcaggtgtcagcggcggctccggtgatggggcctgccttcctctgggcgcccaataactacgggtaacttgttgccacagcgtttct

SEQ ID NO: 15616 - DNA, 712 bp, Oryza sativa
  unsure (1)..(712): unsure at all n locations
gtacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctgctctgttgtccttctcaagcgcacacactaattgctcatatgttctgatagtcttcccttgtcctttactcagcatccattttatcacctaaccatgtagttagccaattatttaattttgggtttacaaacgataaaacacaattaaaatcaagtaaattataatatccaaaacctggacgattctatgccactgttcctccttttcaagagctacaagtgcttgctttaacgaggccacaggaaactcctgtcaaaggcaacccaagcattcagagtgctgtaaacaccttcttttgaatcttccaggtcaagcagctacaagttataaaaattattgattggtctttaccaggaagcaattataaacaaaacctaattatcatagagactccatgctgtcaaatagtaaactagacaatacgaaaactag

SEQ ID NO: 15617 - DNA, 485 bp, Oryza sativa
accttaattttttcttttagtaaaatgaaagccatcaagtaaatttgtgctacggcagctcagaagtcagaagaagagaacaacagtgtactaagcagatgataaccaccaagaaagtaccaactgctgcaaaaatgtgttcccagcatatgaaagttaagtgacaattaattcagatatacaactactaatagtcaaacagaaaagcacagttattttagagaatataattaagatgttcatctgaatataatctgtacatggacacagcagttacatgaacgcttcttatgcgtatgctttttaacatatattatgttacattacacaccatcgattcaccaaaaatcaaaatatgaaagaaaaaaaggaagagaactttttaatcggttcatacacaatcagattcattcatccaccgaatcctttgaatgccaaatcgccaataccaccttacctactgatgatgctgatctactcgcacg

SEQ ID NO: 15618 - DNA, 718 bp, Oryza sativa
ttagtatataatagatcagatgatgtaaagtgaagtacactgttattcctacaggccaaagctgacctaaccaattcaaaacgctcaaattttaaacccaaaccttcgaatttcaaagaaaagcaacggctccaccaccgtcgccgttgctgcgccccgcacaaggtgggggcacgagcccagccgcccaacgacttcccctccactccactccacctcccacgattccccacgtccaatcacaacccacctcgctccccgagcagcagctgagctcccaatccggcaatccgccatgcccgccgccgagagctgccactcccgcagcctctcgtggctcgtcaagtcctgcatccccgccgaccccgcccgccacatcgctgtccccgttctttgccccaccccgcaaccgccgcctccctcgtcgccgccggcacccccaatctccgccctccccgacgacctcctcctcgagtgcctcgcccgcgtcccccgcgcctccatccctccgctccccgccgtctcccgccgcttcgccacgctcctcgcctccgacgccttcctccacctccgccgcgcccacgcccacctccgcccctccctcctcggcctctccgtctccgacaacggctgcatcgcgcaggcgctgctccggtttgaatcctccgtgcccgtgctcgaggtcgccgcgctgccgttgcccccgaccctgctgcat

SEQ ID NO: 15619 - DNA, 642 bp, Oryza sativa
aatattaaatagtactgattaacactataaacaaatcatgtctactttataccacaaatctactcaaaacgtaaataaaactatttctgtgagaaaaactatttttatcatctccatcatctctcttgtccttagttgaaggacatcaaacatggatgagaaaactttctacgttgttgtaagcgttagcaaaggcttacatttggttgagttgaggtggccctattggaggctactgttggtaatagtgctcaactttctacttaccattgtaatcctctatgagcatgccgatagtgatttaagcgttaaattgccctcaacgccaggtttaagtgacatggctacatggatgtgtgagaaagaaagcttggcggctacggcaagcttcatccgttagaggggttttacgtcaaaatttaacggtgttattccattaaccagtagaagtggtattcttacaataaatatacatggatttggaaataagtgagacctgaacactcagattaagggaaaacctttaggatataaaaaaggattaggcttaattttggggatggacatatgccatttcatccattaaataaggccaaggtttaaaacaatgataataaaaagcctgataatatgggaatttat

SEQ ID NO: 15620 - DNA, 781 bp, Oryza sativa
  unsure (1)..(781): unsure at all n locations
nnnnnnnnnnnnnnnnnnnnnnnnnnnnnnnnnnnnnnnnnnnnnnnnnnnnnnnnnnnnnnnnnncttcttaaatgtaaaagtggggtaattatgtatttattcatgatctactagtaatgcaaaatggaatataattctgtagttgtgtccttcaaaagaagcaatcttgtaaaaaagttctgtacataatggttgacagattagaaatggggacctcactgaccatactagtatcagtacactggtaatagacagtttctgcttaattagatatgcagatgcagatgattcaacagaatgatacactcatctgcattcagcaagacaataatcaattacatgatcttgtttatcaggacaagaattttgcacatcttcagtgtacaacattatattcagttaatgtacatatactattattctcatcatcgcatttcattttaaattctaattgaccgcccttgccgcccgacgccgccccggctccgacgacggcgtccgcagcccgcccgacgatggcttgacaggtgctccgacgacggacgatgagagtgaagatgcagagaatgatgataccatgaatactatttgtactaggatagctgatgcattgagtagtgcatgaggaggatagttattttgagatatggcatcattgtatgaaccatttatcttttgctctgtttatgtggaccatatcactttgatatatgaaaaactaatatattttgatgaaaaactttgatggatgaaaaagttataaatttttttctttcca

SEQ ID NO: 15621 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnnnnatttgattgcaaaagacctgcacgttgcaattaattatctgtatgaatagtaataatttttttactaccttttacaaaggaaacactgaaaatccatatttgttaattgatagcattcgctacaatttcactgtcttggttcaaagagcttgaaatcacatttgttgggcatgcttctttcagagaatatagcacatcaaatttaccttatcatccatttaatattcttttgtaagatattgttctaaacttcttgccacaattctgtcatgtgctttgcacagttccaattcctcagaaacattcgtgttctttcttttttaaaaaaaggaaggatctctaaaaaaatataagccattccttctttaaaaaatctgccttttatactttattttttttggattaacgccttgcgctaacatttgccatttgcttggtagtggtgcatttctactgggtggaggggtttataccctactggacaggctgtttcctgcaacatcaatggtgatgtagaatgcatatcatagtcgaacaagagctgcagtacgaggatcggcattggtgaacatgcgaattatgtcagaattgaaattgtaagtaggtaatgataaaatgcctacgaactatcattagctcttcgtagcttacataggtatatatgatatct

SEQ ID NO: 15622 - DNA, 884 bp, Oryza sativa
aatcccttatatttagggacagagtgagtatattgtgtcgactagtgtgttattttgtcctcccattagtgcaccactaacctcctctggaaaccatacgccaggctgtgtgctgccctcaagaactgctaaaacaaatgctgctgttgcatagcccaccgatctgaaaatccaataaaaattaatgctaagatgcaatgcagatagttgtaccaaatgattttgtttgttcttaaaatttaaaactgcaaagtaaatcggaacttctcaaaacaaccatgtagtaagatcgctccaagttttgagtatgaattcctaggatttagggtgttagcattacaaaaatgctggatcattcaaatgctaaggaataatcactctgggaagtagataccctgttagcttttaaatgaggacagatttacatggttttctcaggaatccctttttgaataaaaggaaactcttatacataggatgtaagtttttgaaactggggtctcatttagagagcacttatgtgaagcttcctgcgatctagggcaaaaaatgtgatagttatttttttaaaaaagtcttgatatttgatgactaatatggtaaatatcaattaggtaatggaccttgagaatgctcaactgcttgtgcagaagtgcgtacttacacagatagctttctatgagaaaataatccaatagtattctttccatttgaacaatctaagtctacctgcatataaatgaaataaatttgatcaaaaggtagtgatcagtagctacatatacaactttggacaaagtttgagtataattaatttactcttactccaggtatggcttgaggaaatactagaagtagtatgcttctaggctgctaacctggac

SEQ ID NO: 15623 - DNA, 611 bp, Oryza sativa
cttcagaacaaaaggatgtatcaactatcaagcatgacttgaccagatagagcatacataacagttcgtatataaataaagatcagcatcatgaacctaacatgtttcagggaaatcagacacctagcatcattgatgatcatgttaactgtagcacttcgcgtacaatattgggcaggcaaaatatcaatgaatatagaacggtacagcatagccggatagcccaaccctgagtaactatgactctatgagcaacctaaagataattaactaggagttatttcattagaatgaagtaaatggataaatatgatctgtcatttttgtcatgcgcaaaagcatcataaatttagaagttggccaatccggcgcctagaagtccaatacaacatgtacaatcaccatatggccggaaattttgatgcacaaattagaaaaagaatttgcaagttaattgcaaagggaattaaccaatcattctaggcggagaaagcacgcacctttcacctgctggcaggaccgccggatagcaatgtcgtcgcccgcgtccgatgcttcgtggacctcgccgcgacccgaatatggagctgttgcccgcgccgcctgtacga

SEQ ID NO: 15624 - DNA, 672 bp, Oryza sativa
  unsure (1)..(672): unsure at all n locations
nnnnnnnnnnnnnnnnnnnnnnnnnnnnnnnnnnnnnnnnnnnnnnnnnnnnnnnnccgagatccccactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcaattcgccttcatggatatcggcaagaagctcgacgccttgttcccgaggaatgcacttcaggaggattccgttagccgcgcgccgatagaaggtcccttttaccagcacgtagcatttggagatgcgctggacgcgttcactcccttcgagggcctgggtagagtcttatctgagagggatgcctggatctcagcgatccaagcaa

SEQ ID NO: 15625 - DNA, 12025 bp, Oryza sativa
  unsure (1)..(12025): unsure at all n locations
nnnnnnnnnnnnnnnnnnnnnnnnnnnnnnnnnnnnnnnnnnnnnnnnnnnnnnnnnnnnnnnnnnnnnnnnnnnnnnnacattattgtctctgttgaactgtaggtgacggagcgtggggctcctcaccgggagaccgcgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtgaatctatgtacgaagaagctacaaaagagctggagaaccagagagctcttactctctccctctctaatcgttctggatccccccaaaaaatcaatcccccttctaagtgggcaaggtcctccttttatacctcaaggggataccacatgcaccatctctctcttttttgtggggacttatcctatcttttcttaaacagacggagacttgtatggttgccgtccgaatgaccttctgatgggacggcccatacctacctccacttccgccggaagcaggcgcgacgtgggaacacagctgtttgccgacgacatgaccagtgtcagaccggtcacaaatcggtcattcttgtccaccacgcgtcagtttagcaatctgcatgtccacccttcttcatacaatttcttgcttgtaatggttgggatgaagcctggcatatacctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccggtctgtgaccagtcacagaccggataaacgagcgcgctgtactgcattacgtgcggcgtgacgtgctcacccaaaccgcaataaatgcggttaggtgagccccgctgcgctcacctaacccatacacgcggcgcaaaacccacaaggggtcggggcgccttggccctcggggccgaggcgggagcggtccgacccctcggggagacaaagagaagggcggccgtatcaccctcgggcccgaccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctgatgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcatgggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggtgggcctgcgatcccaggggctcacaggggccatggtgttcggcgactatcttcgtcgccggatcgcgccactccagcggcgcgcccggggcgcctgggagtacaccgggtccgaagacttcatgaggacccaccagggggtcagatgggactgggctcctgaggacttcaagatagtggtccaacgggtgctgaatctcagctccgtggaggcacccctcattcctcaaggagtcctccccctctgcagcgatccagaccgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcggccgccctgccgacgcctgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacagaggcccggaggcgggaatctgatcggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcggcaggccgaggcgacgacgacttccgaggcaactcgcgacgaggccgcgggcgcatcgcttgggcccactccctcgtgcgacgctcaggacaaaccaggtccgggggacatccccgagtccggcacgtccatcggcgggccaagccgcgcggcatcctcttcgaggcggctcttccccacgccttccgttgctccactgagcgcagaaccccttctgcaggccttggccgtcgcaaacaccacggtgttggacgggttaagtgcccagatggaggccttgcaagcagagcgggtggagctcgacaccgcatgggcacgtgtcgaagaggggcgtcgctcggtggaggccatggtggaggtgggccgcaaggcacatcgccggcacgtctcagagctcgaagcccgtcggaagatgctgggggagatcgccaaggaggtggaggaggagcggggggctgccctcattgccaccaccgtgatgaacgaggcgcaggacaccctccgccttcaatacgggagctaggaggcggagctagggaagaagctcgacgccgcccggggggtccttgacgttgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcacgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagtgcgggaggagcaggcgcgtcgtaatctggaaggtgcccgcgccgagagggccgcgctgaaccagcgggccgctgagctcgaggcgcgggagaagggctggacgcgagggtgcgcagtggcggggcggccgcgggcgaaagcgacttaaccgcccgcctcgcagctgccgaacacaccatcgccgatctgcagggcgcgctagactcgtccgctggggaggtcgaggccctccgcttggcaggcgaggtagggcccggcatgcttcgggacgccgtctcccgtctagaccgcgccggccggcaggcgggcctctggggcgggcggactgcgaagtacgccgccaaccaggggggcctcgcccagcgcctcttggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggatggcgcgcgcgcgcaggtccgggacgccgccgaccatatcgtccacagcttcgagggttcggcccctcggctcgcgttcgccctcaactccgacgaggaggacgatgacggcggagtgggcgacagtggcgacgacgctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccacggtccttttgtgtcttggcttgaacaagggctcgtgcccaggtcctagtcctcaaatggctcgggtcggggctagtgcctggggagatccacatgtcgagactggccaagccgggagcgtggtgaccgagggttatgggtgacccgattgtgggtttttgccgattcccccccggagttcactacgccccggggcacggctcggttctgggccccgtttagcgattttagccgacccgagcccccgagggcaggattgaacacgagtgacttatttcaagtcaagatccttcaaaaggaaacaacagcacagatacagcctttaggaaatcgaaaatgcttttattgaaatatagatataagagaaataagaatatgcatatgtggtagcccccggccaaccctgcacgcccgaggggggtgcggggttggcccgagccggaaacctgtcacccgatccccctttaggggtagaagcgacgaaggtgttcgatgttccacgggttaggcagctctgtgccgtcgcccgtggccagccgaacagagcccgcccgggggacgccgatcactcgatacggaccctcccacattggtgagagcttgctcaatccagcacgcgtttggacgcggcgtaggacgaggtcatcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcaattcgccttcatggatatcggcaagaagctcgacgccttgttcccgaggaatgcacttcaggaggattccgttagccgcgcgccgatagagggtcccttctaccagcacgtagcatttggagatgcgctggacgcgttcactcccttcgcggtcctgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtggggtcgcgccgacggctgggcaagcctttcttcaaaggcgcccggtggggtctgggcccgcgaggaagcgagccgtgagagttcgtcggcaaccgtgttatcccgtctgggcacgtgccgaagctctatcccgtcaaaatggcgctccatacaccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtaaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccattaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcatcccggagggcctcactaacaaagtagacgggccgctgcacctttcggtggggccgatcctcttcgccaggggccacatccccggggcgctctttgtccaagcggcctcacggggtgcactcgtcttctgtgccgacgacctcgaggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccaggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccgatgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccgagagtaaggtctcttggctgcgcgtctttacaaccaagtcatcgacataagcctcaacattacgtccaatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaactagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggtcgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggaggtaggcgtaatggaccgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgacccggcgtcacaccgataatcggctgggacggccggggcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgggcccggcgcgtcgcctcatgagtaggggccgcggccagaagctctcgcttcatggccttgaggctccggtgagaaacgtgagcacacgctcccccatcgacagtggcaatggtggccccaggctcttggaaacctaggtcatcatcgccgtcatcgatgtcctcggcggggtccttctgcttggcctcacttcgccgattgccggaaggaaccgccggggacttgccctctcggcgctcctgcctcctctcctcccacttcctcgtccgctcagccaaacttttgactgcgcggcagtccgcgaggtcatgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcatcggaatgggctgacctcttcttcctcctcctgtcacgccgccctgtccgagcagcggatccgggggcggccgaagctgccacatcggaaccggaggggttccagttccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatagtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaaaaaattcgccatgaccctgtcgtcacccccggcggcctcaatcccggtcgtgtagacctggagaaactcggcggggttgacgctcccgtcatatttttcggcgctggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgggccctccgccttgacgatacggagccggtggtagcagcgccagaggtcttggtggcggaggaccgcccaccagcacctaggcgctgccgtgccgtcatgaccaagttggccacgtcgtccagccaacgttgggctggagactccgggtcagggacaataggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatcctttgaccctctcgagcgcctcctcctgcctaggactttggcgtggagggtggagtacgagctcgacggcgtgggttcggctccccgtcgtcaccgctaacactcggagagaggttgtgcgcctttgcttgttcggccattgggctgaacaggaaaagcttggcgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctctcggtgtgtggaaggttcgcgataatggaaacacacaagacacgggcgatgtatacaggttcgggccgctgagaagcgtaataccctactcctgtgttttggtgaat

SEQ ID NO: 15626 - DNA, 13796 bp, Oryza sativa
ccccccccgagggggttaggccacgtgggtgatcgtgtctgcctcaagtctctaagtcatgatactcccggtcccatgtcaccgacagtaggtattcagcatttgatgcactgcaacttgtaagcgatatggatgactattttcactgtgagcattgcaaagaacaacttcttccagaaagtgaaaagcttactttggatgaagttgtgtgtggtggtgacaatgcaataaagcataagcacgataaactaaaggatatgcagcaaagaatggaggttattactttttattcagttagaaatttgtttccaaatttgggagcatagatcaaacataaatgatgttagaattgttcagtttttagtacagcttacatactataactattggaaaacaattaaatttgtttcgcctttgtcagaaagactaaattagtgtatctgcattttggccaataatcagattgttatccagtaaattgtgcataaactttctataattttttacattgcacttagataatacataatttaacatctatttaaccattattgcatttgtgataatagcacgataacaatatagcatttcattgttgtgagaaggactttctttgacatgaaccatatatatagtttcaatatctatagcagagatggaaatatttctatagattggttatgtcatctatgaagcatcacttcgctgatcacttgtatatgtttatatctcgtatataaaataaatataacggtgtatgttctcccatattggctaagcgtgcccctcaagatgctgactgcaaggtagtttttagcttaaacatggatggcaaagtgcatgttctggaatcttgatgatagtgtggattgtgatgctttcgttttgtagatttctgctctaacattgaacatacatgaatgcaggagcaattgaagccattaatagcagtacttgacagggtaaaggatcttccttttccatcttttatgagtttgcaagattgggaaagagcaactatggaggcatctgcaaatggtgcagttggttcatctcagaattcagaagggcgatacagcagtaaaccaatgcccttccttggggaaacagaggtaagcctggtatatgcattgagttgtatacgttagtagttaaaggtgcaaatttagataaatgtgaagccaataaaggcaacattgatgaggcatataacatgaccatggtgttatgctgggaatactgttagaacttctatacttcctgaaacatctcatgcctttctagattggaatcaaatggtttgattattaggatttgcccctgtaagtactaattacttcatttaaactagatattgcactgcctgattaatccaattctcctttccaggttgaagttaatttcttaggaagtactggagcacaggaaggtgttgaatctggtatggaaagtataaagccacagccctcatggatgaatcgtaagagtacagtcctcacaggggaacataaaggagaaatcagcaacactgcagatctggatcaaagttcagaagccaagagtgacaagaaacagctctcagagaaagatgagatgaagagcatacaggtgagctgataaaatttgcatttcaatatcaattataagtttcacaatcaagaactagctagttgagtgaatgttaaatataaattcaccttttatttaatggtgtaggaggcatatgcaaaagcttattatgaggctatccagaaaaggcaggaagatgaggacaaaaggatgatacaagaagaaagccttacatgtatttctgaccagccatttgcttctgatgcacagtttgagaggcggttgggtgccaaatcaaaacgtgatgatggtggtgactctggtgatgatggcattgaaatgaaagtggagcaaccaacaggtatttcttgatcaaaacttgtgttcctatctataatttcacataggagccaaaaaattttctgtaaaatattgtttttttcttgaatacgcatgagagttgcgtgtcatttcattagtaagggagaaaaataggaacggggaagggagcagcacccaccatcacccgaaccaccaactggcattagccttcacatgaaaaaacacacacaacaaaaaaaaacaaccttctgtaaaatattaatcattaaccattctagctgtagtctagctttttattgacccttctactaatctaattacataccccttgacttcgttttataaaaaggtaattgtttattatcattgtttgaaatgtatatgatattaccgccattttttagtttcttatacttgttgttgagttagataatgatatggcctggtttatgtgattgcgatgatagttctcaaaaatgttagtcatataatattttgaacggaaagctcactggtgcagtgtttttttaacatgtcaaccttcaccttatcttttaatgtgttggctttgtatctaatgtgtttgtagggaatataggagaggtatataagttggctgatctggatgtggagacccaagaatcaattgatgatgatgatgatgatgatcttgtttgggtagagggctgaagacttgctacttccttaatgtagaatgtgctaaggttcaagtttgaaacactaggacagtaggactgatggctccaagtttgatacatcatcaccaattgagtgggaagtgcaaaatgtgtggaaggtttagcatagtattcctgcactgcgcatgaaactagtttgactagaatcaagtgaagatgcattctgccatactacattttccatttcaagcttttggagatttttgagaaacaaaagcattttgagatgtatatcctgctaaagtagtaaaatactacagttgctgatgatcaatattgaatgatagactgtactaaactttgcttgtgcatagcaatagtaaagtgaacaccagaaattgatgatggcgatgatgtggtatattgtgatgactagttttaaaactggtacatggtgattgacaaaactgcagtttcagatatatgtggtcctttgacttgatagcctgtttaattacttactatcgccctgtagacgctgcgcatgcgtacgtacatttcatggaacttaattgtatagcatatttgtgtacattaaaccaaaaggcaggagacaatcataacttgaatcttcattgatccatgcataacgcgttcttgttcaacgcttcaatccatgaatacatttttacattgttgggaagacaaatgctgttgaaaacaaagcaatcaagaagctgctgcccactgcaaaagattgatttgttggtgagctgagagcctgagaccccccccaaaaaaatcatcatttgagcagtggttcatcagccgttggccgtggcttgcaggtaggcattgacttgctactttttcaatttttgttagcatttttttaaactgctaaatagtatattttatgcaaattttctctctatataaactgtttttaaaaaataaacaaattcattttaaaattttaataattaatacttattttttttagaaacacagtacaaatgcagacgctcacaatgcgcgcacactcaccaattgaatatacacatcctatccctataaccaccttcagaagactaggccgatatattttgagatttatgaagtcaccacgagcgtctcgttgttgacagttaaatcatctaacactaaaaatacttaattaattatatgttaatcatgtttttcgtttttatgtgtgtgggtaataaactgttttcaacctctatttagagcatgatcatcctgctgctgattgggcatcagagcccgcgaaacatgcagcggtcgtcgtctggtactagtgttgacaaaataaaaaaacagtgttagcaatacccatcattgacaaaaataagaagtgagctgaaataaacatggcaatgtacacactccactacactacaaattatacacattgaagagaaaaataaacactaaacacatcgacatggcaatgtgcttcttttcttctcattgctgaggattaatttatcagtcaattttaacataaatatcatcgttgtcatcatattacggcttgggcagaacatggcggtaaattgggcagaggctgctatccttgagcctacggaagatgcagcgctcatggaagctgtggaagcagggcgtcgtcctcagcaagtctctctccttgaagtccctcaggcacacggcgcacgtctcctccctcgcgtcggccgccctcgtagggaccaggctcaggaggagatcgagcgacaccgtgcctactcgtcgagcgcgcttgcacggcggcggcggcggctgatcggcgtcgttcgccggccctgatcggcgcggccgtatgcgtgtcggccaacgaggccgatctggtcgtcccacacagtacacctggttgaagggagccacccagaatagctggccgcgatgcaactttaggcggaagcctggtggtggcaagccgctgattcttctctcggttaagttaactaggaagagatggtcccagtgccatcgcctccgtggacgatgccggtgaatccatcaattaatcttgttactagctgtgagttgggaaagatagatagatcatagatgcttgtacaatttatagacgacgggtgtgagtgaagcacaactagaatgtcgatcgtgatggattcggattcggattcaattacgctgattacttctaagataaccttttctttatttacgcacgcacacattcgttaattgcagcagtatacttgagtagtatacatgagtagtaatcagataggttgttattattacatgcgtgattaggcagctacatcttggttagtgtttcactaatccatggtgtaagcgatgctggtgagctcattcgcgtgcttctcccacagcgccacgaacacctccaccccaccacttttcctcaggctcggcatcaccaccaccaccccgtcctctggcaccttcgccggcaggatcccggcgagccgcccgccgagccccatgtccagccggtgcagctccaggtgcagccagctgtccgagtccacgtccggcgacagcacgccgggctcgtccacgttcgccggctgaagcggctcctcctcgtccctgccgccgtcgacgtggagcgccccgaagtcgatgaacgactggaagtagcgccggtcgacggcgcggatccccgcgcggatcagcgccgccgcgtccgcgagagtaccggtggtcagctccctcgctgtcgggccggagctcgcgttgatgatgaggttgccgaagaagccgtttggcacggttcctgtcccgagccgggcgcggccgttcacggagacgttcaccgacgtgcgcgcgccggcgtcgagcccgcgcacggcggtgatcttcttccagacgtgcgccgacacggtctcgaacgtggtgtacttgccctgcgcgcgccgcttgagctcggcgacgaactcgctcgggtagtgcagcagcacgttggcgacctcggaagggtcgatgcggacggcgccggtgtcggcgccttgtccttgcctgctcgtgacgccgtcgtgcggcaagaactccttgccgcggtgctcgaactcgcaccgcggcggccggcgcggcgagagcgcgccggggccgtacggtacaggtcggtcaagcagcggagctccgttgcgacggacggcgtcggtccaggcgtgaaagaaggtgctcatggagaacccgtcggcggcctggtggtgagccgacgagacgaccacgaggccgccgcacgcgaagcggttgatctgcaccagcagcacatgcggcgtcggcgcgtccgtgttgaccggcgggtggaggcgcgcgagctccggcgacggcgcgagcgggaggtggtcagcgaggtcggacgacacctcggcctccacgacgagtgcgccggcgccacctctgcccgtgacgaagaacgggcggcgacgggcgccgcggcggtcgaggcgcgcggtgaggagcggaaagtgcgggagcgtggcggagagagcgtcgagaagggcgcgggtggtcgggttgggcggcgagaaggcgaagaggacggtgacgtggtacgtcggcgcgacgagttcgaacacggtgagcggcgtctcctccgtctcgcgcggcggcggcggcacgaccgaactcctcttcacctgcacctccattttatcactctggttagatagatagatgatgcttttgtgtgatggatagatggtggcagtggttcatgtatatatagcacggcagccgccacttgcgtatatatatgtcagtatgtcactagctcagctgtgttgctattaacatttgaagtgtgcgtacgcgtgccaatctgttgaggcatgcaatgcttgatttgttgagctgccagaaattcaaccgtgcatacgtgcgaggggtctcagttgtacgggagacaaaaatacctactacgagtactaggaaccggacgtatatacgttcagatgaagcaggtatacgtagacagtggtcgagattgcgtggcacgcgccgcgctgtgctgcgcgcgggaatggattactccgactccgatcgattccgagtcctaatcaatctcgttgtgcctcacatcgtccactataataaaatctggtactcatccagttgttgcaacaacgcaaaagctggtctgactgctgcaggcgatggatccgccggctcgcagattgatggattctcgggcggcggcgcagttggcggcgccactttctgatccatacgcggcagaaaaattcgaagacctactccgagaattgggggtcgaccctagtatccacactgtagtccgtagcgccgggagatggatggatccggcagcggcggcagcgcgagttccgatgagattccaccgcacgctccaacgcctaggaatcgaccccaacagcgatgcccggagcatccgcgacatgctacaagagttccgtcgaggggtgtaccagggagaggtgtactgggctggccgagtgatcaggcctcgtccttcgcccatgctaggacgacgtcgccgcgccgccgacggggatgccccgatgcaagatgtcgcgagatgtcctcctgggcctcgcgctgacgaaggcgtgcgacgcgaggcaggaggagtgcgccgtgtgcctcagggacttcgaggagaaagacatgctgaggacgatgccgtgtaaccactccttccacgagatctgcctcttccgttggctcagcgaaagctgcctctgtcctctctgccgctacgcgctgcccaagcagcagcaggttcaaagctgctgatgatgctatttatgtttcggttcaccaacagatccgtttgtaacttgtaagcatattgccatcgatatagaagtagaatcatgttctcatcgatgtatagcagggcagttcatcatcagaaggttcctaattaaaacatttcttatcctccactggatttaactagtattgcctgcaacgcaaggccctgtcttggctaacaagccgaaacaacttgccactcatgtgcctatccctatcatggtcaggcacacggttcttcacaatatacgtataatttaagaattgcattgatcttcaaagtaattaattagtggattgatagaagtttaatcgacttgacattgcaattataaattgctttggagatccagtgtcccagtatataatgccaggtgaacactcctcttccatcaaccagcttgctaccaagtcgatcaatggcaatggactcttactactgttccatgctcttcttcctccctccgatactctacgtctcctaccacctcacaagaatcctcgccgacaagaagaagcccaccacccatggcctcaaggcgcacccgctgctcggccacctcccggcgttcgtcaacaacagccaccgcttcctcgactggacgacggagctcatcgtcggcagcccggagatgaggatgggcttctggatccccgggatgcgcaccggcatcatcaccggcaaccccggccgacgtcgagcacattctgcgcaccaacttcgccaactatcccaagggggagcacgccattggcatgctcgaggacttcctcggacatggcctcttcaactccgacggcgagcagtggctctggcagcgcaagaacgccagctacgagttcagcaagcgctccctgcgcaagttcgtcgtcgacgtcgtgcaggccgaggtcggcgaccgctttctcccgctgctccgccgcgccgccggtgatggtcgtggtggtgatatcgtcgtcctcgacttgcaggaagtgctccagcgattcgggtttgataccatctgtatggtggcgttcgggcacgacccgcgctgcctcgccgacggcagtgtcatggaggatgccaggtcggagtacatgcacacctttggcgaggcgcaggacctcgtcgtcggccgcttctttgatcccatcgaggtcttctggaagatcaagaagtggctcaacgtcggcaccgagcaccggctgaggaaggccatcgccgacgtccatgccttcgccatggacattgtccgcacacggcgccagagcgcgtccgtgcaagacagaaacaacgtcttgtcgaggttcgtggcgagcgacgagcacagcgacgaggtcctccgcgacatcgtcctcagcttcctcatcgccggccgcgagacgacagcgtcggggctgagctggttcttctggttcttgtcgtcccggcccgacgtcgtggcgcgcatcgccaacgaggtccgtccggtgagggaggcgaccggcacgcgccccggcgagccgttcgggttcgacgcgctccgggagatgcactaccttcacgccgcgctcaccgagtcaatgcggctgtacccgccggcgccgatcgactcgcagtcgtgcgcggcggacgacacgctccccgacggcacgctcctccgcgccggctggtcggtgacgtacagcgcgtacgccatggggcgtctcgccgccatctggggcgaggactgcttggagtacaggccggagcggtggctcggcgacgacggcgcgttccagccggcgagcccgttccggttcacggtgttccatgcggggccgaggatgtgcctcgggaaggagatggcgtacgtgcagatgaagtccatagttgcaaacgtgcttgaggagttcgaggtcgacgtcgtcaaggagatcgccggcggcggcgtgccggagcacgtgctctcggtgacgctgaggatgaagggtggactacctgtgaagattaggagaaagactgaagcttactagagaaggccacaagggtactttgccgctgaatggtactataattagttaagcttcaagttttgctcttttcgttttgagcttatgggttaagaataacgtttgtgatttggttgtttttggccgttttccatttcctactggactacagcggcagaaaaatgatttgccctgggttgaattgatgccaattaatcaataaaaggatggcgtatcactgtattgtacaaatttaacaagttgaaatcagccatgtaagacacaaatagacctgtttaagcaactatttgaccaactttcaggtgttgttcttactgccaaatgaatactgtaagtacattactgatgaactaatgataaatttgagcagatttctgcggaaaactaatgatacatttgagcagatttgtgcagaaaactaatgacacatttgagcagatttgtgcagaaaatacacaaaatactgagacatgggactcctatagtggatagtgatgatgcagcacccaaaatgtcggtcatggccataaaaaaaactttgtaatggcattgttctagatgagcaagacggcaagatttccagatttgtcatgataccaacgagtgtttgtacatgtaaaattacgtgtaagctatacaatgtcctgcactcctacacctaaagctaaaagaaactacctgcatacttactgagtgatggtctgacggagggtgttgtgatctgcaagtctgcaaccgtcgcctataccgaatgatagaaggacaacaaaattctaaatcgcgtacccataaaaaaccaatctagtactggacgttgacacatcctaatactacgtatctggatagcgatatgtctagattcgtaatactatgatgtgtcaacatcaagtattaggttggttttttatgggatggagggagtatgatctagctgcagttgctacgacggtcctgcgcttaagcgacattgcagtctgatttacacctgcgcatcctgccaaataatcttgcttgcagtgtcacaatagcatcaactgtagttgagtggccattggagacactaaccatggaaaagtcatagggttaaataaattcacctgaaaagcagcaagaagttatttatttttcagtaagaatctcataagcattgcttctgcttgacaggcaactaaagtgcaagcacgaaagctctataccagtacgaattcgaagtttcataagtcttacatttattgatatgttactgaagaattgaacagagtaaaatgaaaaaaaaaatcaatgtcgactgatgacttcagttacaggttaatgattactgcaacataaaaacatactataatttagttactaacgaccttgagaacaacagcaaatattaattcagacacagcatcaacatggacaagaaactaatgcaacattttcctttcacatgtaattccaaacgaatgatgccaatgaattgtgaatgagaagataactatgtttacagaaacaggacaccagtagtatgttttttttgtttcctctagcaagtctagttgagtaaacaatttaaagaaggggaactagcacatggaattttagaagttctaatgttcaattttcctgtagttgagttgtcagaaaaacttttgagtcttcaaccatcaaagattcaagcataatctaaaatcacatatgaccagtcatagcaagattaatacctttgggtggagatctctgggggagatttggtcatattaataccactcctccagttagatggtactatgaacgttcctgatctttcaacctccagttgctgaagtaaaaaaatcaaataagccgtaacaacaaccttgttgcagtaactttgtaccctacactctcctttctttcataatgaatttggctggtgatttttctggccaaacaaaagaataaatgatctccctcatttacaagagccaggtagacgggcatcaagaattagcaaatttctgctccacacgctgcaaggatttacaccctgcaagatgctgtaaaaccctggagacttcacagcaaactgactcagttgcatattggtcaaacaaaaacttgtatctaaatattatctcgaactcctcttgctgaaattcattaggaaggatggtcctccaattcactgattttccaacagaacaaaagccataaagaagtgaaaggaaggtgataggattcggcacatagccctttttagccatcctatttttaaaatccaatgcttccctgagcatattatgtctacacaggctgaagatgatggcattgtatgctgaattccttggatcccctatgtcaaaaaccaatttcttgaatacgactaaaagggcatccttgccatgcacctcactagtgttacagcagatagagttgatgacacaaggagtacaactagtgagcccattgactagataatgtaaggtaacatcattaggagaacaatggttaagcaacatggtttcaaagtacaaaccagctctgagtactttgtcttttttaaacagactaccaattaggatggtataagttaccacattaggagatagagcttcagcctgcatatttgcaaacaagccttctgcagagtctgtatcacctgtcttacagtatccatttattaatgaagagtatgtaacaacatttggcttgcatttccgcttgatcatatcacataaccaccttagagctccattaaggttaccttgtttagcatagccactaataactgtagtatatgtaaactcgtccgggatgcacccaacctttctcatgttgctcatgcatagaattgcctcgctcatcattccaaactgacaataaccttttatcatggcattgcagctaacaatgtcagggcagacacccttgtgttccatgaattcgaatattttccttgcatcaccaagattctcactcctaatgaatccatcaattaatgtggcgtaaacaaactcatcaggttggacatttttctcaagcatctcttcaagaatgttcttagctgcaggaagcatgcgtttcttgcacaaaccactaatcaatacattgtatatgttaacatccgggaatacctgtctttctgtcatcttctcacgaacaatcaaagcctcactgactttgccagcaactacaagaccatgaattagtgctccaaatgtgacaacatcaggagtatgccctctgcccatcatttccacaagcaaatctgatgcaaccatcaactcccctctcatgcagaacccatgaatcaatggagtgtagctaagctgatttgggttcaactccctcctgatggcctccctcaaaaaatgctcagcctttcgaacatgcccttcgtggcacagcccagttatcaaagtattaaatgtgatgatatctgggtcacatccacttgcaaacatctgcttcaagatcaccatagcctgtgttgcagaccggcaattgcacaaagcatctatgacactgttataaatctggacattgggggaaaatccccttttcctcatctccaaaaataaactcccaatcttctctagatcacccttctttccaagccaatttataagagaaccatatgtcacaagggttggcaagaatccatttgtctccatttcccccaacagcaacaatcctctacccatatctccacgccggcaatacccatcgatcaagacgttatagaacactacatgtggaatgcacccagctccccaccttgcttcaatcaatttcaacccctcttccactcgcctttccaggcacagtccccggacaagcacacaagtactgtagttatccgcaccactatccttgccaagcatttcatcatacagcttacgggcgtcatcccagcgccgctgctccactaggagcttgagcaggcggttgcaatgggtcacctccgggagcgagccgtactgctcccttacgcgctcgcacatctcggtggcctttccaagcatgccagcgtcggcgtaggcggcgacgagcgcgccgaggcaggcgcgcgtgggcgcggcgcccgcgagagacatagactggagcgtgtcgtccacggcgtcgaagcggcgggagcgggcgaggaggcggagcagcgtggagtgggcgagaggagtagggtcctggagggcgacatggtggtcgggggactgtgaccaggagaggagagcgacggcgaggtcggggtcgggcagggaggagacggcggcggcgaggtgggcgtcggagagcggggaggggagcagcgccgcgagggaccgtgcccaggtggggttcgtggagcgggtggcgaggacgccggcgagggaagcagcgacggcgggggagattagtgggtttgggttgtggctgcgacggaggcggcggcgcgggaggggggtgatgcggggcaggagcctgaacatgaaa

SEQ ID NO: 15627 - DNA, 9542 bp, Oryza sativa
  unsure (1)..(9542): unsure at all n locations
nnnnnnnnnnnnnnnnnnnnnnnnnnnnnnnnnnnnnnnnnnnnnnnnnnnttttgcagattgatatacagctaacacgacgaaacaacgagtagtttatgatcaattcatcatgattatcacaccgaagaaaatagcaatcagaaaaacgaaaaatgtttcagacttcaagtcatgggtgattgaatcactgaatacactgacaagatgagtcgctgaatgtgttaggcagaggctccatcaccgccaaatgcgttctccagaaagccattttcactgagatggccgacgtctccacacctctcaaggatccaccggccggtgacgccggaaatgcggaaaatgttcagtgaagtattgggaattttcctacgaatcgagctgttgggtggatcagtgtgccggcagagttctagtatggcagcaccatggccgacaacaatcacccgctcccctgtcaatgcaacattagcaaaacatctttaaggttccaggatagcagcttgtcaggataaggtgtacaatggcatacacaaatgaaatggagtaaaagttcgatttttttttatgatagtttgatacttaccgatatgattctgagcaactttgttcaggtaggagatgccctgctcacttaactgattaagactttctccaccatcctaaacatcatttgaaacaatgataaacttttcaaaagttatatagtactagtgctacaaaatggtatacactcactccacttctgatttaacagacctagacaaagttacatttctcgggttataagtgttccaaagaaaaaatacggtttggaacttaccggaaattcgtggtttctgccatcaaagtccaaaccatttttgacttcaaaattagcaaagcctttgaaaacgcctgggcttttattcatagcatcatcccacgtcaaaccttgcagatatcccatgtgcctttctcttagtgcttcaatcaacactaactggaacaaattattggtgttactcatggaggagaaagcaggaaaaggtaggctagaagaactcacgtttgatacatcacagacttttgctatgatttttacagtctcagcagcacgcttcaaatcagacgagtatatagcagctggcctagcttttcttgcaagacgacgagccaccttgtaagttcgcatcagatcgattcattcagacagaaaatatcaaattaaactaccaatgctggtaataccataaatccacatattggtggttctgcttcgaaattttgagctagtgtgtatcgtaccacaacagcctgctgttttccaatctcgttcagctctggatccatttgcccctattgcagaagttcagtgttctatcaggagtatgtattttcatttttccaacacaacgaatcgtcagaaggataaagcaacagatgcttggtgttggctaccgacctgaacgatgcgggaggagttccacgacgtctcgccgtgccggacaaccaccagctccacgaaccgatcgacctccttcgccatggtgacagctgacacctgatggccgcaggcgagagggaacagaggatacctgacagccgccgtcgccggcgagatggggcggagggtggctgctagcctcagccaccggggaccaggtgctgcggcctgaatgcttggacgaacagtgcctcgcatatgtcctgccggaccacacgtaacatcagctattgggtcatttcagtatttgtaaccactatccaaggatggcgacgcagtacgaataaacaaaatctgatgagtgaaaagcaagagaccacgttttcctcgtgcacaaacccggtaaaatccactgctgaacacaaccgtataaggaaagtggtactcgttccgttccattttaaatacagttgtgagtttttatgtctaatattgaccgtcaatcctatttaaaatttttcttattagatgataaaatataaataatattttatgtgtgacttattttaaaaaaatatataaatttttaaataagacgtgcggtcaaagattgaaaaaaaaaatcagaactacatttaaaatgagagagggagtaagtggtaacacgctaccgatagaagttttttcgaaacgaccggcacaagcgttcatctttcaacaacaggtgttcaagtaagaaacacagcgctaagatatatagttctcctgttaattcagttgcaagaatcaccaaaccatcccctaaaaagattcaccctttctccttatcttcacaggtaagccacccttcatcctcagcgatatagagaacacatgctccggaacgcccccgccggcgacctccttgacgacgtcgaccaccaactcctcgatcacgttagcaactatggacttcatctgcacgtacgccatctccttcccgaggcacatcctcggccccgcgtggaacaccgtgaaccggaacgggctcgccggctggaacgcgccgtcgtcaccgagccatcgctccggcctgtactccatgcagtcctcgccccatatggcggcgagcctccccatggcgtacgcgctgtagttcacgaaccagccggcgcggacgaacgtgccgtcggggagtgtgtcgtccgccgcgcacgactgcgggtcggtcggcaccggcgggtacagccgcatcgactccgtgagcgcggcgtggaggtagtgcatctcccggagcgcgtcgaacccgaatggctcgccggggcgcgtgccggtcgccttcctcacagcgcggacctcgtcggcgatccgcgccacgacgtcgggccgggatgacaacagccagaagaaccacgtcagccccgacgacgtcgtctcacggccggcgacgaggaagctgaggacgatgtcgcggaggacctcgtcgctgtactcgtcgctcgccacgaaccttgacaagacgtcgtctctgtctttcacggacgcgctctggcgccgggcgcggacaatgtccatggcgaaggcatggacgtcggcgatggctttcttcaggcggcgctcggtgccgatgttgagccatttcttgatcttccaggagacctcgatggggtccatgaagcggccgatgacgaggtccagtgcctcgccgaagttgtgcatgaactccgacttggcctcctccaggaccccgccgtcggcgaggcagcgcgggtcatgcccgaacgccaccatacagatggtgtcgaacccgaatcgctggagcacgtcctgcaagtcgaggacgacggcatcaccaccgacaccatcaccggcagcgcggcggagcagcgggagcaggcggttggcgacctcggcctgcacgacgtcgacgacgaacttgcgcagggagcgcttgctgaactcgtagctggcgttcttgcgctgccagagccactgctcgccgtcggagttgaagaggccatggccgaggaaatcctcgagcgtgccaatggcgtgctggcccttgggatagtttgcgaagttggtgcgcaggatgtgctcgacgtcggccgggttgccggtgacgatgccgctccgcatcccggggatccacaatccaatcctcatctccgggctgccggcgatgagctccgtcgaccaatcaaggaagcggtggctgttcttgacgaaggccggtaggtggccgagcagcgggtgtgccttgaggccatgggtggtgggcttcttctcggctagggttcttgtgaggtggtaggacatgtacagtatcagaggcaggatgaggagcatggaataggcgtagaactccatttcaactgactgaattaattgctactttcgctgttggttgacatatatggacatgcatttgctactgcttttatatgttgagctatctgcctatctacgcttcagagttcagagatgttgagctgtttaattgaaagtcctactctgagatgaatgctaaaatattgtgaactgtactaaagagtgtgtaaggccatggattggcacatgtatgccaaattgtttgttcttgttgcccaagatagggacttgcgttgcagacttcagaagaccaactcgaagatcaattatttaatccaatggaggttaattgagaaatgtttgagtaggaagcttcggacgatatggacatgtatctatagagcggggagcgggagagaccttggtcaatgttttatagcaactctattgatttcattttctgctagtacacagtagtactgtgctgccgtaccgacaaatttgtatttgtactgcaaaagagaaagataatcggatggtttgatcatgtctgaaatcacgaaatggatcaagaatagtagaccagacggttgcttggtcgtagagtggagctgagggggtgcctaacaacccggttcaaaatatttttaatctatacttcatatatttccatcctatttgcaccctctgtccaaacttaaatacttacatcagccttaactcgatccaaattaaagtaaaataaaggagtgatacccttttattttgtactaactctgccccttcatttcgtactaactccgtctagtggcggagcttagtgaaggttatcctgggtggtgaaccccagctcattaagcagctaattctgtttaggcgcacacatgcaggagaatgttttttgaaactcatgccgatatgcggatgtgacatcacatattcagggtattaagacatccaaattagcaataaaagcatttggtacttcggcccttatcagtattctttctcatgtctgcattcctgctgttttttacttcagcccctatcaattttctttttcttacttctctggtaaataaatatcccatgttctgttctaattaagcttgaaattttttcaaggacttttagttttatgaatgattccacaatcggagttaatgcttcggtccttgcctgggttggattctgaacgtgattattttttttccactaactgaggtgcttgactaatccccagatcaaagccaccagcaaatcgaataatcatatacaagggaccgtgtttctattgtcatactttggaaaccaaaagtttggttgattatcatctagcagagcaggaggttatagtcacacgaatgtgtgactatttaactagtactaaatatgaaaagtccagtagctagtttcaatcaagcaattacaatttgtgaattcgtgagttatgcgatgtgactcagttagcacgaaagttctacaattgtcaaattgagagaaaagagagacaaacagataacagttcatgcccggattcatgaaatggcccaagaagccggttggttggttggttggaggcactacgtagaggcctcatcgccaccaaatgcattctacgggaagtcgtcttcgttgagatgggcgacatctccaaacctctcgagaatccaatggccggtggagccagaaatgttgaagacgcagatcgaagtgtttgggattctcctgcgaactgagctggttggatcggcgtgtctgcagagttcctcgatgctcgctccatgggagaccacaatcactcgctcccctgccaatgcagcatacataataacttcattttctgtgtattatgagcaactgcttgaatgactcggcataagaatgtgcaggtgcattctgaattttctttgcaccgctagctttcactttactaatagcatgcttaccagatttgaaatagctaactcaacaagcaaatttcactattctgtcaaccatacaaaaacttcagagtgagaatattacaatactgcctacccttgtgcttcccagctattgtgttcaagtacgaaacacaccgctcagatagttggtcaaggctctccccgccaccctgtcaaaacagaaaattgttcgaaacacatctactaatgttaggccaatcattatcaagcctaagaagttggtgagaaaattaaggatgaaagttacagggatttcttggcttctgtcttcagatgagaaagccttgtaagcgtcaggcttgcttctgacggcatcatcaaacttcaaaccatggagatctcccatgtgcctttctctcagtgcaggactcaacaccagctgaaagcaaatcaaatgagaaacatagcaagtttaccactggaaaatggaagcttcagcatataatgcatgtacttacgttggacacattgcaagctgtagctatagtttgagccgtttcggcagcacgcttcagatcagaggagtacacggcaactggcttagcttctttagccaaccgacgagcaaccttagacgttagcaccaattccaagttcaggtttttcgataatagaattccaagttcagacaaaaccccaaattacaatcctgtttcattatttgaaatgtattggtaaagctcaccataacagcttgctgtctgccagcctcattcaactctatatccatttgtccctgttaaaattgttctgatgatctgtcaactcgagaaaattgatggaatgacgacgaggggactgaagagctattgactgaagaaggccatcaaccaagtataattctcaagaaaaattgaaaaggacaagttattggtgacaggaacaaagggaagacaagaccgccgacctgaatgatgcacaaggcgttcgccgatgtctccccatggcgcaccaccacaacctcggcgaagtcctcgccatgcgacgacacaggaggaggaatcgtccgctcgctcattgagtcattgtggttggtactggcatctgcaatctgccaggctgctacggactacagagaggagaatatatgtatctgaaggaggctgcagctagttgagtttgcaggtgatttgcagcttcccggaaaccacacacgtgatgctttctttttttgaacgaatcatgtgatgctttctgatgccacttggtcttacattcttctattctttgcactcgtgttaaccataatcgttgtccttttttccttggcacaattgactgccaatctggtctgactttggtgatttgcatccatcaactttgatgatggccattaaccaccagctcaggacaatgcactttaccgtttactggtgcgctctatgtcccttccctttccataaaccataaagcactaacttgtcttgtgtatttgcatgttcaactttagggcatgaaaaaacgatggagtgctgatcgctgaatggcacacattggaactttggaagctactatgtgcgctagacggtgaatcgtttgtactgtacgtggtcaggttgatctgcctgtaaagtcttgtgtattcctcttcacgtgttggtcaagccaaacatttcagaatgggcaactaaattatgatcagataatctagtctaaccaattcaaaactatttttaaatgaaactagaaaggaagcccgcacaaatgcgcgggtgtcttatttactatttcatgaacacaacgctaaaaaaacatatttattataagatttcgttattaccttataataaaaaagtatctacgttgtcaaatagaccctagatatgttagatgataataatttctcccagattctaataaaaatgacgttcacccggttatgtataaattcccatattatcacgactatttattatcattgttttaaaacctgggcctatttaatggatgaaattgcatatgtcctatcaccaaaattaagcctaatacattattaatatactaaaaggtttaccattaatctgagtgttcaggtctcacttatttccaaatccatgtatatttattgtaagaataccacttctactggttaatggaataacaccgttaaaatttgacgtaaaacccctctaacggatgaagcttgccgtagccgccaagctttctttctcacacatccatgtagccatgtcacttaaacctggcgttgagggcaatttaacgcctaaatcactatcggcatgctcatagaggattacaatggtaagtagaaagttgagcactattaccaacagtagcctccaatagggccacctcaactcaaccaaatgtaagcctttgctaacgcttacaacaacgtagaaagttttctcatccatgtttgatgtccttcaactaaggacaagagagatgatggagatgataaaaatagtttttctcacagaaatagttttatttacgttttgagtagatttgtggtataaagtagacatgatttgtttatagtgttaatcagtactatttaatattttttatagatacaatattatgttttgaagataagcatgattgatcattcgactgtgcttaaaaaattatatataaagagacatatcacgatgataatctatagagcatcctatcattattatttatattttgacctagatcttttttttggcaaaatttgcttttaacacatgttgttcgtaattatatgaaaaacttttactaattccaagaatatatttattttctcaaacttatttacataattaatttgttcaagtgcacttatagtcaagttagcgggggatatggcatacatctagaaattatgcccgacatattagaattcatcaacaataataaaatatatcatgagtagtttaatgtgcatgttattggactgttcatttatagctaaaactattatgcataaaaaaaatcatacatataccatcataatccttgttatggattaaggtgcttgtgttatggaaagatcattgactcaaaatattttttatagtatttttcacattaccttgtagtaaagaaagaatttttccatgcgatagaaaacttgggagcaaagaaggaattgggtaaaactttagggacacatagaaaattttctctaaaatatgttgtgatattatctaaaaaaatatcatgaaattaattattttatgtcggtcttatgtgtcgtgatgtatttaacattataatatcattactataagtccacggtagttcatttaattagaggaatacaatatgatcacaaattgaatatctgatttaaaaaataattttaaacatgggtgtatgtttagaagtaatatgttttatttttatattatagaaaattatatagaccgtccttttttcccgatggcactaacgcacgtatacatgttttatttgggctttaactttttctactcgtacgtactacgtatggtttcttgggttttttggctggtgaacagttcgccagctttaattattttttatcgtacgtaaatacgtagttaaaatttcccagtgaaatagttacgtattttgtttgtatacacgcgagatttggtggaagggattaattttatccaatagatctaatctaatggtgtatactaatggatccaccaatttaaatgaaaattaatggtgagatgctttgtttttctataaattattagaaagtgccacgtggtggtctaggaatgtttgtaggagtccacgtggccgtttgaggacgtttgtagaaagtttaatagacttttagtatataatagatcagatgatgtaaagtgaagtactctgttattcctaca

SEQ ID NO: 15628 - DNA, 1393 bp, Oryza sativa
ggcgcacgtgtgcgccgggtcggtgaacgcgctgcacgtcgcgtccggcgcctgggcgcgcccccgtgcgctccccgccggcggctgcgtcgtgggggcgtccggcgtcggtgaccacctgtacatggtggcgagccacgcggtggagctctccttctgaaggtggtgcggcgccaccgcccgtgccggtgacggcagaggctggggcgggtgggtggcgcttaaggcgccgccgatgccgagggggtcggtggggctcggcatgccggtgcgcgtggcgatggccggcctaggaaccaacagggtggcggccgtggtgagcgctgcgcccgtgaggggtcacaatgccggcggcggcgcgttggaagggatggtgctggtgtacgacatcgccggcggcaagtggacccgcgcgccggacctgccgccagggttccaccgcgccgcgtgcgccggcgtcgagtgctgagaatgttggtagatgtggtccccgcagttcagtgagattcgcgctatttggtgggtggataggatagattgatgctaatgtcaagtaacatggcgccatcgtgggattgtttgttgaacagcaacttgatcggatgctattacaatttttttctccagttgttatttagcattggcacataacttggattcaaactggagtacagttcttattcattttctgcaaattatgggacgcaaatattatacgagtgattattcgactgatagcgatttatgatccgtttcctggagcattttttaggcagaaaacagcacgcggagggccgtggggcttgtggtcagattcatggtcccatagaagaactgattcgagttggttgtctacttctctgtggcttcctgtgatgccaacaacctactgtctcgactgtcgtcccgcctcgagtgattacttgtgcttacattcatttacgattgtactccatttacattgttcaagcttgcaatttgcaatgtggtcctcttcctgcttcataaatcacgatgaacgcgagccacgtgattgcacggtgagcatttgcgcaagaatatatcaactgttgctgtaaccctataagccctgtaatttagtaatctatgtggctgtgtgatccgagtaattcctggttcaccttcagtacttcactctcactgccactgcacgtacgcactctcgccatccaaattcagaatcgattcggatcagcttctaccaactccgccttaaattttgtcacgccattccgactcatacgccgctcgcatcgcagctcgttcgtgccactgtccagccgcaagccccacttccctgcagctgctgtctccatctcttccattttatttgcttcacactgaaatgcacgcgcgactgctgctacgaatg

SEQ ID NO: 15629 - DNA, 4204 bp, Oryza sativa
aatgtggtcctcttcctgcttcataaatcacgatgaacgcgagccacgtgattgcacggtgagcatttgcgcaagaatatatcaactgttgctgtaaccctataagccctgtaatttagtaatctatgtggctgtgtgatccgagtaattcctggttcaccttcagtacttcactctcactgccactgcacgtacgcactctcgccatccaaattcagaatcgattcggatcagcttctaccaactccgccttaaattttgtcacgccattccgactcatacgccgctcgcatcgcagctcgttcgtgccactgtccagccgcaagccccacttccctgcagctgctgtctccatctcttccattttatttgctcacactgaaatgcacgcgcgactgctgctacgaatgcacgcgcccatctccttcgcgcccgcatcttcgcccgacgccgccttcttcgcgcccgccgcagcggacgtcggcggcgccgtgtgcctcggctacggcatcgccatcgccgtcggcgtcctcgtcttcatctccaccgtcatgctcgccttctacatctgcgtccgcgccaaggccggcgcagctgccgtgctcctcgccgacgacgacgacgacggcggcgccccggcagcgtccgccgtcgtggtgctaggcctcgacggccctgccatcgacgcgctctaccccaagttcctacacgtcggcgtcggtgacgacgacaacgcgtgcgcgggggcgcagtgcgccatctgcctcggggagttcgtggccggcgacgcgctccggcgagggcccgggtgcgggcaccggttccacgcggagtgcgtggagcggtggctgcgggtgagcgccacctgcccggtgtgccgcgactcgccgctgccgtcgccgatggccacgccgctcgcggaggccgtgcccctcgctgcgcacgctcgatgacacagccacacaggttcacatgtcacatatgttactgtgctctgtagacaatttttgctctctcgaattttctttgcttcattcgaagcgtgaatgcgtgattgatgtactccatacatttcaatactcgcatagtactactccagagtccatatactaggatatagcttttctgacactggaagctttgggaaatggattagggtaagtgattagtgatagatggagtattatatttttcatagcacagatcatcaggacgatgtctgcggaacaagcaaagctagcgtggggtcgttttcatcaggcaacggacaatacaatacgtgcatcttattatgtgtgcccgttaactcgagagtggattctaatcacttgaggatatcccttatgtatatttttcttctaaatttgatacaaatagttgtacgatgatatctatcgatacatcaaaaatcaaattcaaattcaatgtacatctcaaggaaaaaaatgcatatgtgaatagtatgctactattcataagctgaatttgtttttttatatctcgacgtgtgagatgaattcaaacctgagattttgtggagttgtatagatatgttgtatgagtagcatcaaatttttttagaatttttcataacatgatttttaagaaaatgaggaaatattctctcgacaaatcaaaatagtttcccgttaagtctcgctcgtcctagctgcaacgcatgtggtcatgtggagttatcatcacgcaaccctgcacattatcacaaggttggctcgaccgattcatgggcctgtgcatgggcctggccaagacatgatattttggaaaaagtacaccgaaggtcctcaacttgtcatcgagttacaaaatcgtcccccaaatgcaaaaccagatatccggcgtcccttaactaatcaaaactagtcccaataggttcttcggtggttttggctctagttttgttctacgtgatggctaagtcggcgtgggccccacatgtcagtgtgtccatgtcatcactcactctttttcccatctctcctgatcctctcttctcccttactcggttactctctctctctctctctctcattcttctttgggtaggccggcccacgggcacaaggtgggagagagggagggcggccagcggtggccggcgatggccgacgcgggaaaaggcaagacgatggctcctcctaccgccggagaagacgaaagggagggtggccggtggcggccgatgctagggcggctgcggccggcgatggccgatgcgcaagaaggggagacgacggctcctcctaccgccacaatgacgccgtccattcctccctcctcgccgaggccttcgcctccgatttcaaccgctccctcctccgccgcatcctctcgttcgcctcctcaccttcctccctccatccaccttcccacgccggccctcccccgtgcagactggcttcccgacctcccttgctgacctcgtcatcaagaaccatgatcgcccaggcgtcgtcgcccgatgacggccaccgccccgccatctcccaccactgcgctcgttggcgttgggtcctcctcctgcctcctcccacggtggagaccggcagacgtcgctaagctaccaaatttgcacggccacatcttcgtctcgacgatccaggaggtagagttggaggtggcggcgacgcccaggttgaggtatgccgattccgtctcctccctttggaccgacggtgacctcctccaccttgccctcccagccacgagcgggacggccgctgaggggagtggggagtccagcggcgagcgcgcacggggagggaggaggtggggaggcctctttctccacgcggccaccgcccgtcggccctatgatcctaccgcccccgctcctccgtcgtcgccctaaccgacctcctccctaaccggcctcctcccgcgtcgcctgttgctagccgtcggtccttctcctctccctcctcgtcccggcgacctcctcacgacccgccggccagcctgctagaggagaaaagtgagatacagagagagaggaggaagggaaaggaggggaaggagagagaggatgatatgtggcatcctgataggtggggcccacgtgggttccatggtgattcagccaccacgtcgtataaaaacagggtcaaaaccactgaaggacctaaaatgaatggatttaaaatttgagggatgtcatatatctggttttgtggttgggggatgatttttgtaactcgatgataagttgagggacctccggtgtactttttccttactagaaatgcttacagcatatacactagcagactataaatcaactataaacagatttcgagaagataaaacatacagatttatagacagttatagtacggactccaagatgcatgcgtgtatgacaggtgagactagatattaattatgtagtatatgtttacaaatacctaatatataaattggctattaagttgactataaatgatttagagccagccgttggctatattattaaactgttcttaggccttatccgactaattaatgaattaattaggtgcttaaggtcaactttcggatcaagcgtgtagtgcagtgtcgttagtttaagatttgttcgaaataggaccagaccacgttattatctctgccaatggcgagctggcgtgcggaagtaaactccaaaatttaagagaagtggctttgaaaaatacaaaatttctaagataaatgtaactatatattatatctattttggacggagaaaataagaagttatatatagacatgtcttttgtgttatcggtcaaaccggtagaagagatctctaattaaatctgtagagctgagctagaaacatgcaacgcacgtgcacttgtacttttgtagttaaagagaataatatatataggaaaaagtacgaattaccccctcgaactatcacggtcgtccgaattacccccgaaccgcaaaacggaacattcttcaccctcaactatgaatacatgatgaattaccctcctggacccaatccgcggggattttggtctacgtggagtacacgtggcagtccagtcaacattctattttaaaaaaattataggacccacctgtcatacacaactctctcttctctctcacacacacactctctcactcttcctctctctccctctctctctcacggggtcagcggcggtgggcggcgccgtgggacaaccggacg

SEQ ID NO: 15630 - DNA, 1738 bp, Oryza sativa
ccgccttcttgtctcgcgccctcatcctccccacgcgcacgccaccgagagggaggggggaagccgcgccgagctcctcatcccccgccgccgccgcctctgcgtcacgcgccgccgctccatgtcccccgccgacgacgacgagagggagggggaagcggcgccgagctcctcatcccccaccaccgccgcctccacgtcacgcgccgcggccactgccgctccgtgtcccccgccgccgctgaccccgtgagagagagaggaagagtgagagtgagagagaagtgagagagagtgtgtgtgagagagaagagagagttgtgtatgacaggtgggtctcacaattttttttaaatagaatgctgactgaactgtcacgtgtagaccaaaaccaccgcggattgggtcgaggggggtaattcgtccggtattcatagttgggggtgaagaatgtccggttttgtggttaggggggtaattcggacagccgcgatagttcgagggtaattcggacagctgcaatagttcgggggtaattcgtacttattttccttctagtaaagtatgttagaaaaatcattctttgattatatcccattatttaattagttccgttagaaaattcattctttgattctatcccattatttaattagttcctggactttgtgtattactagtactactccagcacgttagccgatattaatcatatccttgttccaacaaccaacgatgtagctcgctgacctttaaataggcggttgaggtcttctttttttttaaaaaaaaaaacaatgaaacagatcatggggtctatttagagttctgaaaagcaactggttggtagctagcttctaaaaatatgaaaaatctgtgtttcccaacttttgttttctagtttattttttaaattttacaactatatcttcttaaaatctaaataaaaaactagaccgtttgagagagtttctaattctagaaggagctgcatcagctataacctccccaaacaagcccaatatatatgatccggctttcgagagaaagccaagatagcaagagagtccacggctgaaatagcgaaatgccctccacaaccacggcgccggagaccgatcctagcaagaccgtcgtcgaggagatcaccggctggctccgcctctactccgacggcacagtcgagcggctgacaccaccgggcgcggagcccttcaccgtcatcgtcccgccctacaccgagccgcgcaatggcgtcaccgtgcacgacgtcaccacggccaggggtgtagacgcccgcctctacctcccggccgagccggcaaccgcgcaccggccacggcggcgtcctctcctccttcacttccatggtggtggtttctgtctctccagtccatcgtgggctctttaccacaacttctacgcgcctctcttacgacgaagctcgacgtcgccggcatcgtctccgtcttcctcccccttgcgcccgagcaccgcctccctgccgccattgacgctggccatgccgcgcttctctggctgcgggacgtcgcttgcggcgaggacgagaacaacaacggcgccgcccaccaccttgatccggcggtggaacgcctacgtgacgaggccgacttcgcgcgcgtgttcctcatcgacgacagctccggcggcaacctcgtgcacctcgtcgcggcacacgcggcggcgaaggatgacggcgcggggggtaccgagctcg

SEQ ID NO: 15631 - DNA, 4622 bp, Oryza sativa
  unsure (1)..(4622): unsure at all n locations
tggcgcgcttgcatatgccgccgatgctgctgatggtggcggagaaggacttgctccatgatccgcaggtggagtacggcgaggccatggcgcgcgttgggaagacggtggagacggtggtgagccggggcgcggtggcgcacgttttctacctcaacttcttcgcggtggagtccgaccccctcacggcggagcggacaagggagctcatcgacaccatcaagacatttatcgacagatactgattctccctaatagcaatttgcaatgaagatcatgcatgtattgcatgcatgcatgtcctgtgagataattcgtatgtgcaggtgcatctatcttttagccatgcactggtccatctccatccgtgcatggatgtatgttgtgttcagtttctgcatgtttgttacacctagtttgatcggtttggtgaatgttttctagttgggttcaaacttccctgttaaatttcctgcgtgaataaaatagagcatactcagtatgcatgagcatattggcatccaattacatgcagcgtttttcccgattacaccgaagactgcacatataccaccatattcacaagtgtggccctcaacttacattcaaattagagaatgagaccaatgccatatccttggccccataaattcctatcgacaacacactggggtagtcgggtgtgtaatattcgtggacactaggattagatgcacattttattcgactggtaaatcacatatttcaccgcaagaatatgattgcttaacaatatagttttttttctactaataaagaaaccattcttatcgttcttaatggttcaaaagatatcttatcattcttttggaagccattaagtatgtggttccaatagtaacatattgatattactgacacacaaaaacattttttttcatatactatgatggtttttaaacccttatatgataaccctttgtatagttacatgttagtgtgcaccgaactacacgtactagttgtgtgtttacatgaaaaaaacttcgtcggggtggaaataaagaaaccctaagatatcttatagtatttgttggttgcttgatattttcaaacgctatatatcacttttgaatgatccatatactactctaaggttcgaatatatagccaggaagtaatcataacccaacaagtctctctagttctaaaaataaatacaagtattgtctctcaggcctacctcacaagcatccaccacctcatcgccctctaatggcctctcaaaaaatatgacactagatgactctcctatagagaaatacttttatctcttaaggaaatatcctttcatttttacatgacatctaaacagttacaaaaaaatataataagataattaaattattcatatgcgatatatatcatttcataaacatgcatgattattcatttgacctataaaatctgaaaaagaaagaacaaatatgacatgaatcaacgaggggaaatcgcacatcaaagtatgaaaaaaagaatgaagtgcataaacttgtgtgggtgggtcatttaggttattaggtccctgaacttgtcataggtgtaatataggtccaaacaagttctaacccgctccatgcgctgacatggcattgctatggtggcacctacgtgtcaattaatggaatccacatatcaagcatatataaaaaataaaattaaaaaccatattttctcctcttaagtagatagaaaaaagatttaaaaaaatctaaggtagagaggatagaatatgtttttttccctatatgactgacacataggtccgactaacacgtaggcactgccgtggcattgccatatcagcgcatggaacaagttaaagcttatttggaactatatatataacacctaagataagtttaggatcaaaaatgcatcttaagagacctagatgacacacccgtatggccgcataagttttagaaaccgctcgagcagttctctctatgaaaaactatctcctcctctcacaccgcactagtacagatccttctatctgtgacgggctctaatatgtttagaaatagcgggccgtcacaaggaagtcatctcaatcgggccgaaaagtgtccgattgagatatggtcgcacagacatattagatgggcataaaacttaagcccgtcacggatgacacctatcagtgacgagccacaactttaggcccaattgagataacattctatatctcaaacgggcttaaagttgtggcccgtcacagatgaccatcatctatgatgggccacaactttaggtccgtttgagataacattccatatctcaaacgggtctcaagttatggcccgtcacaaatgaccatcatctgtgacgtgcaccaacttgaggcccgtttgagataacaactaggcccgtcacagatgactcatcagtgacgggctatatacttaatctctatcgggcattaactaaagcccgttaccgatgactatttttccatttttcatatgaaatgtttatatttgtaagttgactatagcaaaataatttagtgcagtataataattcattttatgagtcaaaataattttacgggtagtaaatgatttcaaatagaaaaatgtcaataacaaagttgtataacttatgaatatttacaacttttagtttggtcatttttcaatataacatttttttgaacagtttgaatttgaatttaaaaatatgacaacttcaaacaacattttcaaatactaaatgatttcaattgaaaaagtcatcaacaacaaagttgaatcactcatcaagatctaaaactttaatttttgttatttcttcatccgactaaatgttagtaatattattcacaaattttacatatatgtgttatagtttataaaaccagataagagatatgtcaattttgtgaacaatgttattatcactttgtcgtatgaagaaatgaacaaaataaaagttttagatcttgatgagttattcaactttgttgttgatgactttttcagttgatatcatttagtatttaaaaatgatgtttgaagttgtcatattttcaaattcaaattcaaacggttcaaaaaatgttatataaaaaaatgaccaaaataaaagttatagattttgatgagttatacaactttgttgttgatgactttttcagttgaagtcgttcactgatctaaaattctatttgaacttttcaaactttgaatttcaaattttgaattgtttaaatagagtcagatggagaaatgaccaaaataaaaattttgcacctcgatgagttctacaactttgattttggtgacttttccatttgaaatcatttaataaccctaatttgatatcctggcctagggcataataggattaatagaatactcatacaacatgttacaactatttttccgaaagccaatctccatagaactttgacgttaagtgtgcttagtctggagcaatttcgggatgggtgaccgaccgggaagtttgaacttcccgcgtgggtgcacacgagtgagggctagccaaaaaataaagtttatttatttttggaatatactcatctgtgacgggcattaactctagcataagttaatgcccgtcacagatgactcatctgtgatgggctagtcatctgtgatgggctagtcatctgtgacgggccatagttaatgcccgtcacagataagggtcatctgtgacgggcactagttgtggcccgattgagataggtcatctgtgacgggctatagtttgactggtcgtctgggtcaaagctatcggtgacgggctttacttagggcccgattgagatagaatcatctgtaacggccgtttgttcgattgagatagctcttaacatcagtgacttctagcctgtgacggacgccatgcccgattgagatggggcttaccgcccgattgagatgaggatatccgttctagtgccgtgccatatcccgaacatccctcgatcgaatgacagctaactcactgaaaaactgcggcattggcgatgtggtttcgctgcttggtcatcactgctccgtcgtcggcttgccgggaaaggactccgtgttagtgatatttgaagggcaatttgatctatccaacggctattgttagtcaactgcatgggatttagggaattgcagttgactgactttagcaaatacgaactgaaactccaacgaagaagcaaattaacttaattaataagttgagcagcctgtaggcctgtagttggttttggacatggacattccaaccacattactatatatcaacctataagttattggagcaaaatagtaatcctccattccagagagatttgataggacacaccattttatcggaagtgttaggtgcgaagaaggccaccattttctgtcgatcgagctttattaaagctagaccgagacgaaacgactcaccaagactaagtgaaagactcaaattaacatactacaacaaattaaagacgacttgagccaatcaacgatggcgtcaagccagcgcgtccacacgacgtacgtatgcgcgcagagtttgcaannnnnnnnnnnnnnnnnnnnnnnnnnnnnnnnnnnnnnnnn

SEQ ID NO: 15632 - DNA, 21928 bp, Oryza sativa
  unsure (1)..(21928): unsure at all n locations
nnnnnnnnnnnnnnnnnnnnnnnnnnnnnnnnnnnnnnnnnnnnnnnnnnnnnnnnnnnatgggatttagggaattgcagttgactgactttagcaaatacgaactgaaactccaacgaagaagcaaattaacttaattaataagttgagcagcctgtaggcctgtagttggttttggacatggacattccaaccacattactatatatcaacctataagttattggagcaaaatagtaatcctccattccagagagatttgataggacacaccattttatcggaagtgttaggtgcgaagaaggccaccattttctgtcgatcgagctttattaaagctagaccgagacgaaacgactcaccaagactaagtgaaagactcaaattaacatactacaacaaattaaagacgacttgagccaatcaacgatggcgtcaagccagcgcgtccacacgacgtacgtatgcgcgcagagtttgcaaggccaggtcatccatgctcgccgtgaatccgtgctgcgtctataaaacacaaacgcagcatagccagttcatttcacattttcactgctacgtactcgatcatctggccagctgctgccatggcaacattgccacaaatggccgcgaccaaggagcgtcaagaggcggctaacccgaccacgacgaccaggacgctggtcgagtccgtcaccaactggatccgcgtctactccgacggctccgtcgaccgcctcggcccgccggaagccgccgcgttcatggtcctcgtcccgccgtacgacgacccacgggacggggtcaccgtccacgacgtcgccacggaccatggcgtcgacgtccgcctgtacctgacgacgacgacgccggccgggcgccgccctgttctcgtccatttccacggcggcggcttctgcttgtcccacgccgcgtggtcgctctaccaccgcttctacgcccgcctcgccgtggagctcgacgtcgcgggcatcgtctccgtcgtcctcccgctcgcgccggagcaccgcctccccgccgccatcgacgccggacacgccgcgctgctctggctccgtgacgtcgcgtgcggcaccagcgacaccatcgcgcaccatgcggtcgaacgccttcgcgacgccgccgacttctcccgcgtgttcctcatcggcgacagcgcgggcggcgtcctcgtgcacaacgtggcggcacgcgccggcgaggctggggccgaggctctcgacccgatacgcctcgccggcggtgtcctcctccacccgggcttcatcttgccggagaagagcccgtcggagctggagaaccctcccacgccgttcatgacgcaggagacggtggacaagttcgtcatgctcgcgttgccggtgggaaccaccagcagggaccacccgtacacgtctccggcggcggcggtgacggcggcggagggagcccagctgccgccgatgctggtgatggtcgcggaggaggacatgctccgcgacgcgcaggtggagtacggcgaggccatggcgcgcgcgggcaaggcagtggaaacggtggtcagccacggccgcgggatcggccacgtgttctacctcaactggttcgccgtggagtcccaccccgtcgcggcggcgcgggcgcgggagctcgtcgacgccgtcaagagcttcgtcgatagccactgaatcgattccaagtttgaatcggtgtctgcttctatgtctgaatttgtgtcgaaatcctgtatccatctcaccgtcacgtagtacatgtctacatcgcaatgtctctgtagttaaacaagtttcccgcgcaatgcatacgtgttttcgtttctccgatccgcttacgaaatttcgatttgatggagaaacacgtcgagaagatgctcagtttaggctttcgtttcaacccgtctgcagaggatctcatcaccttctacctgccacggctgatcgccggcaagccaatgaaagacaccgagaaattcatctgccgcgctgatgtttacggcagcgagcccagtgacctcgccggaaagttcgcgccggtgcccaggtgcgagaaaggcggcaggttcttcttcactagctgcaagcggcacaaggggagtagcaccaagaaagagcgaacggcgggggctggcacctgggtgaggcagaacagcaaggaggtgaagaacaaggcgggggtcaaggtcggcgagacgcagaacttccgtttcaagaaggacgggagctacaccgactggctgatggaggagcaccactgctgccggcagcaagccgtcgccggcgacgaggagcccgtcatctgccggatgtacgtgtccccgcgggcgcctccggattccgcggcgcgccaggaatccgctgctttcgtgcagcagcagccggcgccgcaggtttccgagccgccgtgcgacaagaagaagagagatgatgtggcagaagaagcccctgccgcggcttaggcgtcatcagaacagaatatatgatttgaactttttttaccaactgtatgtgcatttccagtgggataaagattctaaccaaagcagagactaaaaacatgtggggtaatgttttttcaatgaccataacaaaattatttcgagagcaatacaggtgcaaagttgaagaaagacttcctgctatctgaactggggtgttgccacacatacaatgaactctgcaacccagacagcactaacctatagatcaggcatcccaattccagccttggcatcataggttttctccagcacatgttcaattcgtgtatcctttgggccagctgcatgaatgaaacaaaatggccaaatttagtttcctcacaaaaaaaaaagaaaatatatacatcatatgccgagtaatatattgacactttgacaggaaatagaacgcatttgcttgcatgtcaattacatattagtcattcgataatagatagccaaaatacaaaggcatgtaacaaacatatttagtattttgactccaggtatgtaaaggtcatggatagatcagagtcatgatttttctttttcagtttgtattattagttaactgctattatcgttccaatgcagaacaattacaaaacaaacaatagtaccacaagccaaacagcaaacaccataagaaacatctactgtagtaaactagtaattatgcatgatgttacagtaccaaagattattataagcacttgatgctttcctttattagtatttattattattgtgatctcagttgaacatcaaactggtacagcttaatttctgatccaggaaaagaacagcatagacaccacaaaagtatatatgcacttgacaagggaaccatgcaatgaacagagacatacgtgatgtaggtcttggctttcttcgctccttcaaaatttctggcctgggtatcacagcaccagatgcattcattcctctagcaaacctgactttagttccatcttccaaatacttgtatccaatcttacatggtttcctgttgccagcgttgtgtggataaatttaccttttaccagtaaactgcagtagaaatggaagaaaaaaatattctatctagatgacaagatggatggttaagtatcatacccagtgactggatcaagtacttgaacatttgaaacatgaagtggagcttcaattgagaaaatcccacctgtatgtccttctccttgcttaatatgtttcttaacctgaaatgatattaaggcacaattattattatccaaactcttatgtacaagagaaaacactcacatacataagaacaagaaactgttgtctgtcgttagttgttacttcctccgtttcacaatataagtcattctagcattttccacattcatattgatgttaatgaatctagatagatatctatctagattcattaacatcaatatgaatgtgggaaatactaaatgctaaaatgacttacattgtgaaacagagggagtactgattacagctgcccagtagtcaaaaagaaaaatgtgacacgtaacaacaaacatgtgaagattttagaaggacaaggtttttacagtttcaccattcttctattgcacccattaaaatcaattcctcaagatccatctggatactggacgaaactaattcagtatttactcctctttgttatggcatacaaatgatacaaacacacatgatatgatccaaaatagatacagcatgtaccattatgcagtacatagaacacaaggatccagcaggcatctacaatttctgattattctatgcataaaggcagatgctaaattatttgaccactgcttttgttggatcacgcatagctaattgttgagcttatcataaacaccactctctatatacgatgatatgcacaggtatccaaatcctcttgataaaaactctcttcatattatgctatccttgtgccatgatggatatatagtccgcggaataatattacgttatgagtatttacaggttcaaattcgtatgaacaacactccaatggaaacaatggtcgagcttacatctgttacagcaagtcataagctatgtttgtgacagcagtcaaaaactatgtttgcagctcctacgactaatctgaactcaggacttgggagtttaaaaaaaaaacgagtgcaccatggagatcaggtcacatactgccatctgacagatacagcgttgtaagctcttttatctcattattaaatgaagcttttgtgcctctattctaaactttcaatagttgggcttaaaaccttttcaaaaaaaaaaaggaaaaaaatgcagtagtttgcatcaggctaaataataaacggtaattttctgaaccagttaaaccgatgacacaaaaccttgaaatctttcaaccaatcagcacaaaatctatgcagtatttgacaatttctggaggagggtgcgtcagtatagcaataacttaccaaattctttccctcgacgatgacacggttctgcgaccgaatgacccgcttgatgagcccgctctcccccttgtccttgcctcttatgatcatcacctggaaataaacagcgccgaaattggagattttgctagaaagaggagaggggcgaagaggaatgcgaggacggggaaagataattacgttgtcaccgcggaggatcttccagtgtctgatgagcttctccgcagccttccaccccatctctctcgactagatccctcctctctacccagccagcggctcgctcctgggctccccctccctcccagtaagcttcaaaccttggttgcggcggagatgggggtggcggcggcggcgagggagccggcgctagcggcgaatgtgatgctggacagatcagagtgggccgagaagaatgattcgggcatttaattgggccgtttccttcaaaaggtttcggattggaataagttcgggagtgactccctttactagtgaccttatctaattcgtatccctgaaccacagtacgaatatctcgacccctaactattaaaaccagtgcaatttaactttaactgttttgctgacgtggcggtgttgacccagtcttcatccaacatttatgtggtattagaattaaaaaatatatgtagtacccatttgtcactcacacaaaaataattgtgggacccacttattatacgggcccacatgtcatcccctctctctccttcccttctccctcctcccccctctctctcttatctctctttctccctcccccctcccatggggcctttctcttcacctgggtggagcggcggtgggagcggcggcggcggggtggggagcaacggcgccctgagggagctgcgttgcacacgtagccgaggaggaaaaggcggtggcgcagcggcgcgagggcggatggggagcacatggccggcctgcacgccatggcggcggcaaggacgggcgtcgatccagctgtagaagaagagcggtgggggtgtggctccacccgatgtggacgcggtcgacatggcaagggaggcgggtggtgacaccaaggaagacatctgtgcgcaccaccggatgcctccgtcttcgctacccaccacgccaatgtctccgcttgccactgtcgccgcccttcctctggccccaacacgctgctcccacctagcaagcggcaaccacccgcctctccccacctccgccgccgctgccaaccaccggacgccgccgccgtccccactgtcatatatagtcagataaagagagaagggagagagagaggaagaaggggaggagagggccccacatgtcatcctttgtgtaaattggtcctacacataccctttttaattctaattctacttaagcgctacatcaacgccacgtgaacgaagacccggtcaatattgccacattgatgtcacatcagcaaaaccaccctccaaaactactaagggagttaaattacaccagttttaatagtttggggtcaagatatccgtattgtggttagaattagattcggccactggttaaaggagtcaacgtaaacttattcctttcggatttgtttcgtttcgcaccaaaaacctatgggcttatggtgggttttgtgaaatcctctccggcctatatatagtcatctatctctcctctctcgatttggaaaaagaaaaaaacagtttctggtaggcattctcgaacgagatatgagtaatgaaatcgaagaggcgtgttgagtgagctcaaatcatcggagttcccattcaattgccttttgtttgtcaactgtgcaggttgatgctggcatgctgttagccagcttagcacacgttcttgtcaaatactcgagtgacaagaggtgttatgcagttgattctgtttctgattaatcttaaattgttaatcctcggatccaacgcacaagcagttgaccagttgagcaaagtagcaactgagtagtgtgtatcaacgacccttctcttcgcagcaaccagcaataccattaccagtacagttcagcaactaatcgtgagctgattagctgaagcacataacacgtaaagcgtccatgacgatggagaaacgcacgtcaccgcaacaaccgccaactttattacccaccaactgctcgacgcatttcctctacgcgcgcgcgcccaccaccgccggcgtcacacctcgccagccgcatcaaagcttccgctcctacctcgcccaaatgggcggcaccggcgacgatggcgccaaggcccctgcggccgccgcggccatggacgtcgtgtcgtcgtcgtcttcttctccggcgccagcgccgtcggtgctcaagtcggtgctactgtcctatgcgtacgtgagcgtgtggatcacactcagcttctcggtgatcgtgtacaacaagtacatccttgatcccaagatgtacaactggccattccccatctccctcaccatgatccacatggcgttctgcgcctccctcgccgtggtgctcgtccgcgtcctccgcgtcgtcgccgtgccggcgtcaccgcccatgacgcccagcctctacgccgcctccgtcgtgccgatcggcgcgctctacgcgctgtcgctctggttctccaactccgcgtacatctacctctccgtctccttcatccagatgctcaaggcgctcatgcccgtcgccgtctactccctcgccgtcgccttccgcaccgactccttccgccgtgcctccatgctcaacatgctcggcatctccgcgggcgtcgccgtggctgcctacggcgaggcgcggttcgacgcgttcggcgtcatgctgcagctcgccgccgtcgccgccgaggccacgcggctcgtgctcatccagatactgctcacctccaagggcatgtcgctgaaccccatcacctcgctctactacatcgcgccgtgctgcctcgtgttcttgacgctgccgtggtacttcgtcgagctgccgcggctgcgcgccgccgcgggcgccgccgtccggcccgacgtgttcgtgttcgggacgaactcgctgtgcgcgttcgcgctcaacctggcggtgttcctgctggtggggaagacgtcggcgctgaccatgaacgtggccggcgtcgtcaaggactggctgctcatcgccttctcctggacagtgatcaaggacaccgtcacgccggtcaacctcgtcggctatggcattgccttcctcggcgtcgcctactacaaccatgccaagctgcaggggctcaaggccagggaggcagagaggagggccgcgtcaatggcgacggcgaaggacggcgacgcagaagccggtgcgcggctgctgccggagaaagatgccggtgagcagaagaactgatcaaagtcgaacaccaagcatagtacattaatgaaggttgataaatcaacggcatttttttcatctttagatagcctgaagctgcttagtattatgtttgtaaacattcattattacagaggatacaaatgatcagtgattcgaaatatgcatgcttaaattgcagcattcattttttttctcattttaaagattcagtcatcgtgttaaaactccttgctccctgggcactagtgttcatctaacatcactgtcacatggttgttaatcgtagcatactagcattctgtttgttgattgtgctatatatgaatgatttggtgcacgatgcagtaatgcagagctccaaacctgataatccactggctaccaaatactaccttcagttttactcaaagtgcaacaagaaaggaccaaaagacaaacaaatgcagcaaggaaatgacgcaaagtgtcattacagtgaagatagtatattgagtgactagtaggtcagggtagtagaagagaaagggatttgctagcttcctactcgtacttagggcaagttttataatagggatagttgtcacatctaattttatccatgtaagataagaggtgatatatataatacaccatatctacaccacctctattattataacccaaataattttattttatttgtttgtccaatcccctctttctttcatcttctttttcttggggtttgtgtggaggttgccccttgcatgatagggggctcaccttctctttcctcaattattacttccacctcatcatccaatcatacatgatatttttagaggcaacacattaagcatcatagtacttgcccttactgctgcctacgatataggagtatcctcctaaaccctataaactctaatactaagggcttctttaaaacacaggattaaaaaaagatacatttaaaaaaaaacaaaggattttgatagaaatgcaaataccaaatagagaattataaaacacaggaaaaaaacacgaatgatcgtttgattaggctataagaatcaggataagagatagacttcaaagaaattttcaaagaggttagagctcttgttaactttcctctaaaaattttaaagaaaatgagagaaaaattcacaaaactacaaatattatgactaaagcactaaaaatttaattagtgtatcacaaaacagcagatttaacactaaatttatcacaaaactatacgtttaagatgaagtgtcacaaaactacatatttagtaacaaaattatcacaaaactatgggtttagaaccattttagtcacaaaattacaacacttattgctccaacataacaatggtgttagggatttaaattctaaaatatgtacttttgtgatgaattcaatattaaatatgttgttttattttttaaacacattaaatctgtagttctgtgagaaatttggtgccaaatttgttgttttgtgatagtttggtcaacatacatgtagtttgtgaaatttacacaaaatgatatgattcaatccttgtttcaaatgcttttataggaatttttataggaattttttcgatatgattaaaatctttcaaatttgaaatcaaagggggggggggggtaagtagtactatctttaggttcattaaaagctagcaacaagaataccgaagccatcatttcgcttatttgcgaactaagagaaacgacatatttgcaaataaaaagtaatttgtgaataaaactttttatatatatgttcttaaagatctaaaagcaaaggctaaaaaataaacttcgatgaaaaaaacctcaaaattagctccaaatttacggttgaaaattcaaaatttggctgataagtataagtataaacgaaaagcagctccaaatttaaggttgaaaatttaatttttgactgataagtataagtataagagaaaagatgaggccctacatgaagtcctgtccaatcatatatgcatcattgactctctctctcctttcaattgtattaatcgagtaatatttcgctgagtctgattaacctaggccgcgttttgttcgtgtgccaattttttttaagtatacggacacacatttaaagtattaaacgtagaataataacaaaacaaattacagattccgcctgtaaactgcgagacgaatttattaagcctaattaatccgtcattagcaaatgtttactgtagcatcacattgtcaaattattgtataattaggctcaaaagattcgtgtcgtaatttacatacaaactgtgcaattggttttttatctatatttaatgattcatacatgtgtctaaatatttgttgtgacgggaatttttggaagtttgaaagaaacaaaacactgccgtgcatttcgccgcacattggaggcccatcaagattttatatggccgccatggtccaaggcctcagggacatttcctgtattgggctgagccggactcttcgtcaaggatgaatttgtaatcagtgaaaaaatcgaggggctggatgcaaatctccattcccatcgtattcctctccttccagctcgagactagggctcgcaggtggcttattccccctaatttgctcgggaccagaccacacctccccaaggtgagaaccaaatctctgattccaatcttgttacgttcttggttgttctttgccttgcgatttgggagcggcagcagcagtaaggcgctcgtcaagatctcttcttttcaattgttggggtcgcgctagttcgtcgaaatttatcctttcccgattgctggattgcgtcatttcgttaatatttctccttcccaatacctatcttgtgctatttggaaacgagagcactaatctacttcttcgatctaatatgtttgtacaggcccttgtatataaacgaacaaactttactcatatattcagtccattaattttaggtcctaatagttgttttttaacttatgcgaaaattgcaatgtgctgaacagtgcaggtgatatctctttcttaacgaaaaatagagtcagcatgtaattatctatatggtacttaagatcctaaaaattaagcaagggctaggttgattgcttgctgtttgaaaattgttccagttagcattttgctccattctttgttattagtcagactctcaactgctgtcatgttatttactcaggaattagatttttacttcagatatcatattatgcaaattgtattctatttctcatcgtgcttttatctctgtgcctttttcttttcttttcctttcccttccatttcacggaatatattggcatcatcagcttgttgattattcttcgcattgcatcatctttgcttcccctcttttgcatgctcttgctgtccatgctgattggggattgtatcttgagaacctccccgtgtaatcctttgtaaccataccactgtttcctcatttgttccatatacattttctttctatccagttggatacccatggctgcatcctgtttgacattattgcataacaagtactcttgtttatttggttgtttttcttcctatccttgtatcatcactttgctctcccaatattgttggctcctttgctctttccaaagttgccttggaactttgagcttttcaagatgccaaggaggacagataatgctgcttctgccaattcagttgaaccagaaaaatcagaagaatgtttggagtttgatgatgatgaggaggaggaggtagaagaggaggaaattgaatatgaagaaattgaggaggagatagaagaggaggaggtagaggaggatgaagatgtcgtggaggaagttgaggaggtagatgaggaggaagatgaggaggaagaagaggaatctgatgaaactgaaggtgtaagtaaaactaaaggtgttcaccagaaggatgttactgaaaagggaaagcatgctgagcttcttgctcttcctccccatggttctgaagtatatgttggaggcatctccagtgatgtatcttctgaagatctgaagagactatgtgaaccagttggagaagttgtggaagtaagtactgcttacattgttcattttatgtttccatgtggcctgttttgttctgaattacatattctcccgttttatgcaggtgagaatgatgagaggaaaggacgatagcaggggatatgcttttgttaattttagaacaaaaggtttggcattaaaggctgtcaaagaattgaacaatgcaaaactgaaggtttgttttctgttgaacttgagaaatgtctatactgtcactccatcagtgccattgatttttaacctaagattggtaattgatcaagcaagttctggacatttttactacaccttttgcagtttccaaatgtgaactggtagagaacaaaatagtgatttcactcgaatattatcatgcaataagctttccttttttttaattttttttcagtcttattgcacttatatctgcagttgacttctgttgattttgacatagcacagtaatttcacacatcagctgtgctccctgtttccctggatatgtaggaagaaagagggaggggcacacacatatctactatacatgatctctagtaatatcatggttttgtaacgtgtaatatttggttaaaactactgattatgccattaacaggaaacacttgttcatgattgggagtagtggtagcttatgttctcttaccaataattttggaaaacatagctttgctgccttgatcacacacatgtgcagaatatctcctggttccctgttatagctgacaacttatctatcttgatcttttatacctactgaattttttcattatgcttctcgttacagggaaagcggataagggtttcttcctcgcaggctaagaacaagctttttattggaaatgtaccccatagttggacagatgatgatttcagaaaggttgtggaggaagttggtccaggagtattaaaagctgatctcatgaaggtatggatctgggtagttcaacaactttgttatgcaccctcgatcttgtttctcctaaaaatttctttgtacttgtaggtctcaagtgcaaatcgcaatcggggttatggttttgttgaatactacaaccatgcatgtgcagagtatgcaaggcaggagatgtcttccccaacattcaaactagattcaaatgctcctacagtcagctgggcagatcctaagaataacgactcggcctctacttctcaggttcgttcaagcataacatgaacaattttactttgtttgtgtataattcttataccatgatgttttatttgaacttgattattttgcgtgtgttttcaggttaaatctgtatatgtgaaaaatctgcccaagaatgttactcaagcacagctgaaaaggctgtttgagcaccatggtgaaattgaaaaggttgttcttcctccttcaagaggaggtcatgataataggtatggttttgttcactttaaggacagatccatggccatgagggctctgcagaacacagagagatatgagcttgatggtgagctttcctcttgcgctgtaatgtcccactatgcttgcgtattcccccaaaaaatgtcccactatgcttagtctggtttgtctggtgcattcaaggtctcacatatttctcttaacaggtcaggtcctggattgctcacttgcgaaacctcctgctgctgataagaaggatgatagagtaccactacctagttcaaatggagctccattgctcccgagttatcctccacttggatatggtatcatgtcagtaccaggtgcctatggtgctgctcctgctagtactgcacaggtacacgagtacatcatcatcatagacccctttgcccaatcaatgagtaaatacatgtagtaaaggatgattgatgcccttctaaccattgtatgctctgcattttgcagcctatgctgtatgctccaagagctcctccaggtgcagcaatggttccaatgatgttaccggatggtcgtctcgtatatgttgtgtaagcgctaccaaccatcttttcttcagaaaagctaataacatgttatcacctatcagcatgagatgagatgaaatgacttctgttcagttacatgtcattttggcatttccattgctgatgatatcttcattgcttctttgcagacaacagcctggtggacagttgccgctggcttcgccgccgccgcagcaagctggacatcgtagcggcagtggaggacgtcatggcggcagtggcggccgctatggcggtggtggtggcagctccggcagtagcaggccaggtgcaaagcggcagagaggagacgacaacagcagtagccgccacaaaggccggcgccgcccgtactgatctgatcagcatagctgtagctaccacttagaagatgtagtgtcgttgcagaaaattaccagaaaatctggtagaaataatttatactgtttgtactcgtcgatttattagaggaatgcgtttctgaaacaagactgtacatgcgtattttacctgtatcgcagagtgctgaatctgatggtgcactggtacagtataagccagtttcaggtctctttgtaagcctgttttacattatctttcgcttttgcagtaccgtcaattcacccctgtaagccacatggactatgagatttctgggccagaatctgaggtagacagtgaggtgtggcttggctgggtggcgcagcgacgtgtgtgctcaagactggagacacggttgatgctgcccgagctgaacacgtcgtgttgactctctcgagaggcggacgggtacgtgccgcccctccatccattctagccttctaatctaaaagcatccacgggctctctggtgcgctgcttctcgactagacgcctcctccggggaacctcgtacagggcggcgcgggccacagctccatattccggtcgacggcgagtccacgaagcatcggacgccggcgacgacactgcaatccggcggtcctggcagcaggtgaaaggtgcgtgctttctccgcctgagaatgattggttaattccctttgcaattaacttgcaaattctttttctaatttgtgcatcaaaatttccggccatatggtgattgtacatgttgtattggacttctaggcgccggattggccaacttctaaatttatgatgcttttgcgcatgacaaaaatgacagatcatatttatccatttacttcattctaatgaaataactcctagttaattatctttaggttgctcatagagtcatagttactcagggttgggctatccggctatgctgtaccgttctatattcattgatattttgcctgcccaatattgtacgcgaagtgctacagttaacatgatcatcaatgatgctaggtgtctgatttccctgaaacatgttaggttcatgatgctgatctttatttatatacgaactgttatgtatgctctatctggtcaagtcatgcttgatagttgatacatccttttgttctgaagaattctagtacaaatttaggtttttgaacaacagggcaatgtcaaaggttgcaattgttaggttagcttcaaatatacatttgcagcataaactgccatgtctctgtccagtagttatgccaatgtttaacctagattatttcatttacttgaggaaacattttttttgaatttagtttctctactctctgaacaatccaacctggtactgttatctgattctgtgaattttctgaactttatacagggcctatttggtgtaagaatttatatatccgcccactcatttagtcatctgcatcttctaagttgggtgaaaaaatatggatgacggggagatagagctttccagccaaatgatgtttccaaatccagagattccaaccagccttgatgacttcctgccaagcatcaggacaacatgcacacacactcatacttgcaacccgcctggtccatcggcaacagagcacacccatacatgctaccacactcacacccgtgtcttcagctcagatgatgatagttgtggaggtgacaaagccaagccaaagaagagccgcaagccattgggcaaccgcgaggctgtccgcaaataccggcagaagaagaaggctcatacagcacacttggaagaggaagtgaagaggctccgtgtcattaaccagcagctggtgaagaggctgcaagggcaggctgcacttgaggtggaggtggtacggttgaggtcgttactggtggatgtgcgatcgaggatcaatggtgcattgggtagttgcccgatccaagcacaatgtggagttgataatgttttgggttgtgatggaatggctcagtgctttgctggaaagccggagttgggtgtgagacaaagttgtgcaccttctacagtgaattgccatatcagctcggattcagggcagaacctggtggtgccccatgctttaagccctagcgatgttattggaagcttcatggtctcatctacctcaaaggatgagtagatattgtaggtattattttgttgagtaaattgcatattggtccatgttttttaaccatggtttcacattggaccaccattaactgaatgctttcactttacaccagattttattaccaaaatgtatcactttggaccagtggtccacttgccagtgtggctgaggggaaaaaaaaaaggaaacttctcggttgggaaggaaccagcgagtccgctgactcatctcctaccacaccgttgatctctttccaacttcacccaaccatctcatggcggtgtgggcagagatcacgctaaagccttgggggcaacatggggagcttgtgactggaaagactcgtgtggaggtcgatgttaggcgacgtgagcaaagaggagctcgtgtacgtccaggtacagcagaagtcgagtcacggaggcgacggcggtggagaggagcttgagctccgggatggcgcgcgggcatcggagtagccgtggagatcgaggttgaaccgggacggcagagaggagcttgagcccaagtacgatgtgctagtgctactgaatatcgaggtcaagcgaggtgcgacgacggcggagaggagctctagctcggggacgacgtgcgggcgtaggtgaagaacgaagtcaagctagcgagggccgacggcggcggagaagagctcgagcttgaggacggcacgctggggcgacggagccacgtaggtcaagctggggtggtggataggagctcgagctcaaggacagcttgtgggtgctgatgcctgctggtgcctggaggtcgacgtcgagcggggggagacacggcagaggtcaaggccgggggtggcgcgtcggcatgggactatgggagagttcgaggtcaagacggggcatcaacgtcgagcggggagagacacggcagaggtcaaggccgggggtggcgcgccgacatgggactatgggagagctcgaggtcaagacggggcatgacgacagcggagattgaaatcgagactgggaaatgcgtgtgtgcgggaacaggcggaagtcgaggtcgagccaccggacgacatcggcggagattgaaatcaagccagggaatggcgtgcgagtgcgggcggaagtcgagatcaagccaccagacatcgagcttgagcctgagaccggccggcacgacgggaacaaaagtcgagctagtgtgacgccgtgttggcggaggttgaccccgtgctggctggactacgagcttgagatgcgcgggcgtcagctctgttatatatgctcgagctctcttaggcgtcgtggtctttgtggtctacagccatcgatgaaaacagttggagatgatcagatagggatgagagattggctctgagagactgactatgggccatacgcccaaagtgaaaggttttggtataaaatctggcctaaggtgaaaacattatattaagggtagcccaaagtgaaaccatggtaaaaaaatatagtccaacatgtaatttactctattttgtttctagcctttttatcagaagataagacagtagtattacagtgccgtggagcctggagggttgatgcctcgtttcctaggtggcattttacccctgaaatctggtgcaagttagtaattagttttcaggttcattatcaaatacaaatttttggtttctacgtagtgtaaaatgtctttggtttctatgcagtgtaaaatacacatttccccctcttttccagagataatgttcagttttaggaatttgtgttttaggagctgttaattctgagcatttccttcttttgcagatactctgtccaattctgtgagtggttgggtgtgatattctgtagttgttaactatgcacttttacttcttttgtagagatgatgttctgtttttggaaagatatttaggagctgcatgactcatgaatccgatggctgtataatattttctgcgtgccaaatctcatgatttttccaactcattaactggattaggacacaaatctgcaacagtcagctggagatccctgatgagcagcacaaaccggtcctgaaactgttcaaatacaacaagaacaaatctattatcttattaaagtaatagaaaaagaagccaccacatttgttctcacggcctagaaattaccacgttaatcgaagaaaataagaaaaataaaaaaggcaagcggagaaggatatgttaatagcatgaaaatatgaaaagaaatagtaaagcaatcaatcggacaaggattcatggaaactgtaaaagtgtcaaacatcaataagaaacagacttagtgtgtggaaacggaaatacaacgatacaagtaaaaatagactccggtcacagtgcattagtatcgtttagagtccaaaagtaaaaaaaaacaaaactatttaaaatacctgaaattcaaaatataactaactattgcaagaagaatctatgtataaatacaatttatactaatatgaaattacaattattttttttaggaaatctaaacattgagaccagagttatatagaatttacttaaaaaagagtccatataaaaatataatttaaaaatatctgaaattcctaattaaaaaaaaagaaatattcaaagagaagactagactccatgtatatacaatgtagaactaattaaaatttggaactaaagttagagtccataaagaaacaaaatttagaaataactaatatttggaattaaaaaataaaaaatattgaaagaatattttagattcattatggaaatacaatttacaaataacagaaattcagaattaaaagaaatatgggaagaggagtctagagttcatatagtaatacaatttaaaaataattggaattcaaaattaaaaataagaaatacttattgaaagaaaggtttagagtccatatggaaataaaatttataaataatagaacatttaaattagaaaataagaaatatttttaaattagaaaataagaaatattggaagaggagtctggaatccatatagaaatccaatttagaaattacaaaaattcaaaatttaaaaatagttagtaactatcacgtatatacaatacaatatgaatattatatgtgatatacaatacaatatgaatattacatattggttggtgctgttaagttagtacaaaatttaaaattatgttgctattttaatatattttaattatattatgtgaaaatatatgctactatgtgaaaaaaaataatgatatacaatacaataaaaatatcacacatttgttagttcaaccaagaatttaaaattatgttgtcattttaatatattttaataataaaatatgaaaatatttaagctaatatatgagaaaaaaatttaacgatactagccgtgcaatctgcgcgggccaccatgctaaatttttttttttttgacaacagaggtacacaagcaactccaacttcatttcagacgtacacagaaaacaggtacaccgtacacgaacacctttactcataggcgtgcaagaccaagtactccattcacatcgcatacacataaaaactcataaatctcacgcaaacaagaacatcataaaaataaatataaaatataagatactaaaataaccagagcaaaggagatcactaagatgattcactcatagttatacgaaaagaaagaagcaacagagagctcaaccacaatgtttcagttccagacaaacgctgcgacggcgagcacagcggcagcaacagcaagtgagcagctcccaccggcggccatggggcccgtcgccgccgcgccgttgttggacgatccgctgtactgggcggtggcatcctcaaaacagctgacgatgcatacgacgaacagcacgagcgcaatgaccggcttgggagaagaacgctccatcttgttctgcttttgcttgcctgttcagagttcagatctcagagctgagacgatacacttgagcatttcgctcaaattgacaggatttatatagaattgcctcaagttgacatggtaaacatagtacacagatgcacaatacaagtttgtccatttctctacatcgtgttctgctcgccaggatgagttgggtttgatctggacggctggtttgttgctgcatattcgtctgaaaaattcaacaagcagatgaggtgctggctttgtttctgatgctagagttccttcctttttgtcacttgtaagttgtaactttcactatccatacaacaaacgtaacaaaatttccttttcagagaacaaaactgatgatctgattgacaacgtcagttcttatgtgtgttggtcgcatcgcatttatcaatgagcttagatgatgcctatgttcagctgatgcctgatgccatcagccacagccatgtcgatacgctggctgattagctgatcgatgactccaatgtaagcatggaaaccacctagtacatcatatggcactccggtgatgagaggagttcgtgttttcttggggcgctgcgttgctggagttcatggggccagccgcgccgccgtccgaagccgccgcggcggccgacgatgtggtgctcccgtacatctcgcgtattctcatggaggaggacatcgacgacgacatgttcttctgcctgtaccccgaccaccccgctctcctcgaggcgcagcagccgttcgcccagatcctctcctcctcctccggcatcgccggtgaggtgaacagtgcacccatggaggattctgctgccttgatgatgcaggggagcggcaatggtaggggacgcaagggtagtaagcatggcggggacgagctggaggccgaggtgggcagggcgagcaaactgatggccacgccggaggaggaggacgacgacgacgatggcgtcggcgacatgttggagaagatgatgctcaacggggacgaggagatgaacgcgccacgcgtccccccggagaaaaacggcgggaaggcggcccggccgaagaggaggcagggcaagggggaggtggtggacctgcgcgagctcctcatgtcgtgcgcgcaggcg

SEQ ID NO: 15633 - DNA, 5229 bp, Oryza sativa
gcgcgcgtcgcccatggagttgctgaaagcgtaccaggtgttcatggcggcgtgctgcttcaagtgggtggcgttcacgttcgccaacatggccatcctccgcgcggcggaagggaggagcaaggtgcacatcgtggactacggcggtcagtaccacggcctccagtggccatccttgctgcagcggctggcggagagggaaggcgggccaccggaggtgaggatgacgctcgtcggccacccgcagccaggtttccggccagcccgacggctcgagaggacggggcgccggctcagcaactgcgcgcgcgcgttcgggctcccattcaagttccgcgccgtggcggcggcgaggtgggagacggtcaccgccgaggacgtcgtcggcgtcgaccacgacgaggcggcggtcgtcgtgaacgacgtgctcagcctgggcaccctgatggacgagagcggcgtgttcgacgacccgagccctcgggacacggtcctcggcagcatccgcgacatgcgcccggcggtgttcgtccaggccgtggtgaacggcgcccacggcgcgcccttcttcccgacgaggttccgggaggcgctcttcttcttctcggcgctgttcgacatgctggacgcgacgacgccggaggaggggagccacctgcgggcggtgctggagagggacgtgctgaggcgggcggcggtgggggtgatcgccggggaaggggcggagcgggtggagcggccggagacgtacaggcggtggcaggcgaggaatcggcgcgcggggctgagacaggtggcggtggaggccgacgtggtggaggcggtgaggcgcagggtgaggaggcggcatcacgaggaattcgtgatcgaggaggatgcagggtggttgctgcaggggtggaaggggcgcatcctgtatgctcactcggcgtgggtcgtggcagaggatggtgcgcactagcaactagccgccatgacggtgttcgtgtgtactgggaatgcttgtttgctgttggatcagtggagtttatggtctttggattgtttcatatccctgcagcaactagcgttggagagctcacagtagtaacaacaagcttagtggcaataatcctttcagctgcttcagcacaagacgagcttccattgtccaccaatgaatgactaatgtaatataccaggaaaaccataacggcataaccactagcttcctttcagcacaagacgagcttccattgccatttgtccaccaatgaacgaccaaccaatgtaataataccaggaaaaccacagaccagaccacataaccacagattagagttcagtccttgaagattgctgaagttcgatgctgatcccacgggatctttcaactgttggcgttacagcctttctttctttggtgcttagcttgggcaacgtacaggtacaggcaccgcccatatttctgcagttctgctctttctgaagcttattgggcgaaagatattgccgtgtcaacattagtgaccactgaccagccaacacaacataagatacttctcaccgagatcaccccaacacacacacacacaactcaaaaacttgaagaaaccggtgccccctccacttttatccgggcttgggaccggcactggcagtgttaggcacccccctacccccaaacataacaccccaacacgtcaagtgaaaaaacaattggagcacctctgactgttaaacagtatgaagttagtgagtataaagaatagatcgagttagctacccatagcccatcatagcatctaccaacatcaaggagagcaaaaacgtcgaataaagcaactatcgtcataatcaaatactagtaattcaccacaagcaacctaggcagaaggagctatatataaccataccgacgaaaataaacaaatgcaaatgcagtttgcattagactaacaatgcaaatgcgcatagaaaaacagactaactaccaccactaggttccggtaattatactagtatatgctagtttgccaaacaggcagataacataaactaagttcaacatctaaggataactggaacgctacgctaataaatttagctaaaaccaaattttccgaatgaaatcgtcttatcattgattaaccgattttctgtgataaatttttagcatccgacaagtggaagtccatactcaatattgccttcaaaggatatacatgaaatacaaagtcagcacaagtgcattttcagaacttaggacattcaacatggttaatactcccaacacataatttaggatattcaacatggttaaataccacaacacatatctcaattattagtgtactatgcaaagaaaaaaattagattgagcatggcgacgttacggagtaaaaattatgttcggattatatattccctaaataaatgttagctcatgtaaacaaactgacagaaggtatatgccaatcaatacacacacaaaagggaagatattataagaacaagttatcattttaataatatttaatttaattacatattcatcatcctgttaaagatcatatcaaaccacgtttgaatggataagttgaaaatattttaaataatatagattcaaaactatgtgcactatattaaatttaattccatatccatcaccctattaagtaacttactaaatcagaactgtagtgcatcaaaggaaatagctgaagaaaacacgacataaatcagaagaaacttggcaaatgatcaagtcataataaaattacattaatgtaagcattttaagtgtatcacattgcaaaaaacattttgaagacatcttctgatatgtactttatgcacaataataggaggtaaatcaacgataaccacacagaatgggcaatgacacacgaaatatgattaaacaaacatgagctggtaaaagaaaactaaatacataattactagctcagcaatttccataaaaaaaacatacaaacactatatctatttgacctcaatctcatgaattactagatcttcacaagtattcgcatagtaacacaacatatattgacatcaaataaataaacatcagaaagcaaccatagaacatggatatgatactttctagcctttggaacagaatgcagatggaaaactaattagcaagaatgaaatgttaatcacgcgaacaaaatttagtaaaaaacaatttttgggaatgaaatcatcttatcgtcatgcaaatgatcatttttactaaattccaaacatctgacaactagaagtccatactgtaacatgaaaaagacaatatttggcagaaagctcatgtaaaatatattctcacacaactgaaatcatctggtgccagtggatttcagaatttaggacatttaacatgattaatacttgtacattccaacacatacaactctaaattagcaccttattatgcaaagcaactaaatttggattgagcgtgtatagcaatcactattaacaacattaaaaatgttaggattagattttcctaaaataactgttactaggtcatgtttacaaactgacggagcatatatagcaacattattaacacagtaaagaaaatgttaggattagattttccctaaataaatcttactaggtcatgcacacaaactgatagaacgtacttacgtacatgccgacacacacataagggtaaggcattaagagaacaagttatcaatttttaataatattcaatttaattgcatgttctaaatcctgttaaagatcatatcaattcaggagtcaggtggtggaaaggataggtttaataagtagctatatagattcaggagtcaggactatgtgcattatatttaattaaatccatcatcttgttaaagtaactacgaagactatcagaacagtactgcatcaaagcttggttagggatcaagtcattatcaaaatgatattaatgtaagcattttaggtgtatatcacacttaaaaccattttaaagtcattttctgatatgtactttaagcactttcaatatgtcgtacgtcactgcactctaataggaagtaaatcaaagaataaccaaaaagcattggcacatgcaatataattaaacaaaattcttgcaggagctaaagtaaaagaaaactctaattaaaccaaattagccgccttatcgccttatttataaaaacgcgaaaggtgtgaaggcatcaaagcttttaatagcaatacaaatggcagctactagcttagtaatgcctagaaagaacacacacaaacagtatttatttgaacttgtatctcatgcattactagacatagacacaagtaatggcacagtaattgcattgacgtcaaacaagcaaccatagaacattgatacgatatttctaatatttggttatgcagatggaaaacaaacaatctgggaattaataattagcaagaaaaaaaatgaaatgttaaggcgctagctggatataggatatatttagcacaaagaaagcatcaagttttagaccataaaataaaactatttgcctagaataaattaatgctacaaaaactaaagcacctatacatttagccaaaaagagattactaaaaccaccagataatgtatgaagagatttaaggttggttcaaattaaaaagacaaactgaaaccatgcacacagagttgatgcacaaataaaacaactggtggacaatcaaggttctcaaaaccactatactagtctaattagacaaataaaatggagaacttgtatgcagtttcaatcacagatttattgacaagagaaataaccagttagtgaattctgtagcttgtatgcaatttcaatcacacaagaaaaatgatgcaacaaaacaagtcttaaggacaaaattgaaactaaggaagaatgctagccatctagcaaaaacatgcaagggccaccctagaatgaaatggaagttccacacatgcaggtatataaaaaaaatgaaatggaagttccacacgtgcaggtatataaaaaaaggaagaagggattctacacaaaacaagaaaatgaaatggaagttccacacatgcaggtatatataaaaaaaaaaggaagaagggattctacacaaaacaaggtcccagttgagctaagtttatcttcacaacgtataataaaattgatacctatataaagcattacactggacaaaaatactaataagcatgcacatttaagtgaatta

SEQ ID NO: 15634 - DNA, 8430 bp, Oryza sativa
gttgaatgagatataataattataaagaaagaaatatccagacaaactgtaagaagaaacaagttagtgataatgtgttgttgtgattagcaactaagttcaagggattcacctcaattcaaaagccctggacataagatatataatttaggacaattcctatcaagcataatatttaaaaaacatccacatttccatcttttatgagcctaagcaaaaattgcctcgaccctgtaaacttcagttatctaccaagttagtatagaagatgaataactttcaaaactgtggaagctgcaagacgatccaaaatattcctggaaatatcctagttcctgaatgaagtgctacaatgctacattcaacactcacaaaatgaaagcaagagagaacaatgccacaagagccatagagtttcattctatacagactaaatcagtatatggacaaaattaccatgttacaactcaggattatcaaaacaaattaccatgttacaactattatacagactaaatcagtatatggacgtctatatcatttgataattacaatttccaacatcagagggaagcttaatgaacacacaaattacaagatgacaccaaaccaacatacaagagggccaatcatatgttgaaatgaacccatatcctagctagttatggaacagtacaagcccatatgtaaaggatactactggagatgcaagctggaccaagtagaaatcaaatactgctactgagaactcctccatggttcataaagcaattgtttctactcagaagaaacttcaaacagatggctttataatgttgaggtccataaatgttcttgaaataaatcttcaaattaatttcacccaaagtagtcaaaagatttcagaatcaccttcacaaccttgtaatattgttcgaaagaactgccaaatgaatcgtctaccacagaaactttaggatgtgtcttcttagttactacataaccaccctcacagcaagttaataactgactgatatagcttttccggaagtaaacaagttaacgtcaaattctcggagaactatggccatgtctatgttctgacaagacaaccataaaagcgcagcaggatggacttaaataaccagagttttccaagcagacaaatggcctccaaataatatcaatctcacttgttattttgacccaaaagcgtagcagcagtcttgaatggaatggagaaaacatcttatacaccaaagactattcctaacaatgaccaatcccatacaacaagcttcaatttctctggtttataaatgttcgtattacaaataaaatgttcttggacagttgcttgtaatggaagcaaaccaactgcacaatattgacatattgaaatttcaataaattgcaattaaccatagccctaaaccaaagcatcaaggttcctaaaactaacaccagtaaacagggaaatcacgagatctgtacctcaaactgagcaggtcaagcagcaagtaatctgtagttcctgtactaggataaattaatccacagggaaggcggtcaaaaagagctccttaaatcctcgcgagaaatcctgatgttaaactttaactaagaactgacacagaagaatcattccaacgccctagcacatagtgacgatttttatcaaagccaaaaagcaatacatggtccggttaagatgacacacaaccatattcaagataatctgaagagtatgtcttgccgaaattgaacaagttaaagccggtgatttgaaagctctgaacagaccttaaattttctgatatgacttgaccttatcataaaaattactagatccgaaggaaaaactgcatagctgcaagcagacgaacggtctcaaacaaaaccaagcatcacgaacttgaaaggaaccgaacaataatctgaggccagtgagcaatcctaaccatgaccaattcagagcgaaaacttcagttcatctagcctttgatcaagcccaaaatatccatgacaaatccatcgcaccaaacatgaattgacacaaaccaaccgatcgcgcatattgtacccaacacagcaaaccacaattagccataaaccaatcgaaagagatactgtgttcagaaaactaacacaacagcagaagcaaatcgccgaaactagaccccccccaaaccgaacggatcaagcaccagaaaaggacgagcaagcgggcaatctatccggctagttggtgcgcctgatcatcaatcaacaaacggcagcgaacgaggtgagatcgaaaccgattgatcccttacctaccgacttaccagcccacccgcggcggaggggaaaaggggaagaatgaccgcgcgagaagaggaaggaagccatgggaccatcctcaacgaagaaaaagcagcgaggatcgggctgcatttatagaggagcggagaggagaaccaccgaggaggaaaccgagtcggtgggctggagccgggttgcgagcggaatcggtggtcgcccgcctattcttgtcgcggtcggagtcggagacgagactaggcgatgttatctggcgctttttccggtgtcatggtggggacgttcttatcgctttttcttttttttttagaggacgttcttatcgctttttctttttttttagaggacgttcttatcgctagccgaagcagacacgcttcaccgtcctaatcggctaatcctcgatgattcgtcgttagcagcaaccagttgtgcagctgtgattttacgtcatgttccatcttccatgcttccatggagcacagtaaaaataaattatttgtcatttttgtttttcaaccgaaacaaaccgtgttcacacttgatcaaccatcgatatttggatggttgctggttcacgaaggttccaagttccaaccatagctggaaatttaaaaaaaattagattcgaccaaactatggtgatttcgtggtcaattccacggaactaaattaagcacgacaattgcattccacaaagctagctgatctatgcatttccacaacaaaaagtgtgcgtatttgacggggaacatttcaatggtcttcagtgctggaaatatttttgtcaatgactgctgaacatgtcttccaaagttttcagccagttcatatattgccaccgctccttctcaaccaaatggtggtgaagtgagcttgccagtttggaattaacgcctcttgccaccagatatcctttcagtgcaacctgtaaccgaggatccaaatctctgcaaaaacaatggggaacactgtcattgattgcaaataggtacaaggaaaccaaccttgtaatgatcttaatcgaaacaacaggaatagagacccctctaacctcttatgttgccaaaaaaaagggaaacaaaggctatttgatgtttaagggaacagaaataggccccttcagtggagcaatgtgatacagtcaactttcaatttcataagtaccatttcatgaatgagcagtaaaaagaactatagaaacattatagctcaacaaacataaaacatgtttgccattgaaccagatagtaaggatacaagtaatggctaaggttactttaactgctggtgacaatgaaatcctaccaccaagcctcattacctagaaattatagaccattgagtccctaaacaatcacatcacgatgctatctatttgagatgacatgtcctgaggtcattttgctaacaaaaaaaatacaaatgtagtgatgagccatctaagcatagtctagtcccaagttaacacatgtagcgtgtaccaagtggctgatgagatgcttacagcccactgattctataaatttgtactgactcgcttaaatccagtcaaaacaataaaatccaaaaaaaattgggatgaggaattgattaaatagaataaaaaggtccaatattcctccttgtttattttagaatatctattttaatccgaaaccaaggatcgattttcagactttcatagttatatgctgcttagttggttcttactacacttgtacctccaaaaagatcagcatcgcccttatgctacaaaacactttcaaccaacaagcttttcttgttcattttgcactttaaattaataaatggaggcgaacatgtgaaggttccaaattttagcatgagcatactcacagtatggccaagtaatcaatatgtttgaacaaattcatgtgaatccagccacattcatgttgaacatatttggacatggcgttgcaagccaatataaaaaaaatctctaacagaagacatcgtataaatttactctataaaaaaattaactgagaattgcaggtgcaagcaagagtaatggagaacaggaattcgtgagacctctccaccaagtttaccaaagttccttttaaaaaccatccatcaagatagaacgcaagaaaaattctacattgaattttgacaatagggtataactagatattctagcaaatgaagaccctgcggcttaacatggagttaataacaaggacagatacttggttcactgtcatgacaagactgtaggaaaataatacatagtaatagattttcagtctaccaagatactatgttgtaagacaatgtaatcaacaatcagcgcgttagaacagtaaaccacaaaaaaatatacgcatgttcctctacttttgtagaaagaaaagataggtggtactgaatttcctggaaggcataggctctcctgaaattgatcatgtgctaattttttttctaccggtcactagaattacagagctccaccaaaatgccatgaaagtgcttgtttttccagatttcttggaggaactccaagtttatgagcccactgcgcgcatcacaatatccacaaacattgtgtttggttcattgcttcaacttgccacaccgtactttaggctgccacacctccttagccttggcaatgttagttaagaaccaaacagcccctaaaatcacatgaatgaagaaacatcacctgaactcaggcccttcatacttgtcttccccagcgtcgccagcaaacgggtgataacaagcattagtaacatcatagtcagcagagccgccatcaccttcatctgcaaacgcgcggcagtcgaaccgcatcaccggcttcacatcaggcttactgacgaacaccttcatgagcgcgtccctgggcaggggctcctccccttcgaaccgcagcggctcgagcaccgccgacacgaggacctcctcggaagcatcccggcggcgcaggagcacttcctgcccgcgcggcgggtccgacacggtggcgaagtcgggaatgtcctgcgagaaccagggggaagtgagtggcgctggattgggggcgggaggatgcggtggtgggtacctgggattggagcgacgggggagaggagggggtggaggaggagagctcatgcgcgatctcggcgcggacggcggccaggacgccgccgttggcgccgccacggcggagggcggacgcggccaggcggcgcagcaacatcacgccggaatcattagcgagctgtcggtcggtccgcgaaccaaatacagtggaaggcccataaattaaattggccaatcctgcaaggcccaatccgttaagagtccatgaaaactgaaaagggcctggtacgtcaacgacccagctatgaaaacatttgccttaaaatgtcgtcggctatgaaaacattttagtttcactttacccccaaaatatcgtgggaaatcacgttcacaatttcgcctaggttcttctccttcacaagtttaacggcgaaatgaagaatgacttctgcggacagcaaaagtaagtataagagagaaagaaaaatagtgactttgtgctgtgcttaaccaacactttttttttgaacattcaatatattaaacattaaaagcacaaaacgtgcactggagatacatgattgtctttccaaagagcagcttgtaagagttgctttgtaggacaagtattgttattacaagtatgactaatattttgacaatttagcacttcagattcagaagatgttctagcttttttagataggtagtctgtcattttgtttatgtctctgggaatccatttgatgttggaggggccatcacctgcaaaaatttttaaaagtgcaagaagaggtaaaaggctccagtggcaattctgattgatgtaatcagtattttgaagtaacagtgttagctcttgattgtctgaaagaaaaagaggatttgcaattttaaggaaatcacagatgaagagagcaagtttgaaggctgcaagttctgcttgcattggtgatttgtagagacttgatttcccctgcacaaagatagcttgatgattaattggattatgaagaaagaggccaaaacctgttagattgtccttccaagaagcatcaaagaagcatctgtttcctggtaaaaagtttagacaaacagtaggattttcatttatgataggagtgtcattattatcatcatcatttgataaagcagtaatgtagctcttagacatggcattggaggcattacaaatttgtaaaggttcccaatctttttttctgaagaagtgatcatttttagctttccaaatataccaaagaagaatagagataatttgaaagttattatcaaaactattagaagcaaggagatagtgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaagagctaagccttgactagaactgcagcgggaacaccactccacaggcatcctcgacggcacggacgaagcctactcctcggagaaacctccatctgacacatactcatactctggggttgggaaaaaaaatagagcaagactgagtactacccactgtactcagcaagtcataccggaataggggtatgatgcagggaattatcaaaggagagctagagtggttcgtttgcataaaacgagcatttataaacagaagttgaaagaattaaacagttgcaataattaattaatattgatcatccgctgtccaacgctatcccacgttgcaacagggccaaccatccacctatactatccaatttcattagactaaactagggtaagactaatcacggtgaatctggttgaccgcccataaccgcgggcacggctattcgaatagttttactctgatcagaggtgtacaactgtacccacaagacatagccccacgacacgtttccgtgcgccgacatgccaccacgacataccggaaagaggccgtgacaggacccttcgcataaccccatctaaccaagcacaccacacctcaggtttcaccccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactataagcccagccgttgcccacgctggcttgtggtaagtacgataagttcttccagggcatcccgtgaaccggtccttaactgtcatgggtgtgactagcaaaaccatgcacccacagcccaccatgtgattcattttaattaaccaacaccaaaatggtggtactaaaccaaccttaccaattgaacctaaagtctatattttagtgagctttccccattgtgtgctagtggaactaagcatggctaagcaattcctagtccaaaatctattcaagttataacccaagctaacaaaggagcatgatatcaaaatagcatggctgtaacaataggtaaacaccccatagtaacattataaaacaatgcaatatttgaagaaaaacaatagagcatttgcaatataggatcaacatgttcaagtgacaagcatgacttgccttgctctgctgctggaggaacctcggcgactattttgaagtacaccggagcgtcggaagaaccggaatctagcgacatacaaggcaaatattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaataaatcccagggctgacgtcatcaagggggacgcggcgccgacatgcgggccccactggccagcggctcgggagagggaggaaaaggggcgccggcacgcgggcccactcggcagtggctcagggggggcg

SEQ ID NO: 15635 - DNA, 3173 bp, Oryza sativa
cgggagagagaggcggcaaaaggaaaaacgaggaggagagctcggggatggattttataggggcgggaaggtcaggaatgacccgagcgcgtccgatttcgccggcgacgtggggaaggagagagagaaggtgagggaggattcaaaatcgaatcccgcccctctcgtgcgcgggcgcggccgggagacgcggggagagggggcggcgacgtagcgtgggcgtgggcaacgcggcgtgggcgcagggaaagcgggggaggtggggcacggcggcggcggtttcgggggtggtgaccagcgcgggcgccaggaggttgggggaggacccgacaggtgggccccacctgtcggcgaccccgggagaggagggaggcggggcggcctggctgggcctcggcctgcggccggcccagcggggaggagggggagaaaaaggagagaatgggctggcggcccattcggaaagggaagggaaaaagaaaaagaaaaaggagaaaaggattttccctagaattaaaatattgcttgctcaattttaattggttaaaattatttctagggctctgaaaattccactaaaaatcctgttagtgaatttcgacatgtagaactcaagaaaaattccacatgccagattcgattactatttgtattacttccttagggttttctcttgatttgcaccggcattttcttagggtcatttataaattaaattttcggcttgggaggagaacttcggggtgtgacagataggcaatgatttcagaaacattatgcctagagtcaatgatagaatgattgaaatatagctcagaaattttccaagtgagtctagcaaaggtgcagtggaaaaagagatgagtatcagtttctgggctgttgcagcgagagcaagaatctgaaatgtttgaaactttagagtgaaggttagcagcagttggaagagcatgtcttagggcagtagcagtgcggtagcgcacttgaggagcccaaggcctccagctagactagaaaccggttagagaaccacacctcacaatgcatgtgtcttagacagtatctatgttagtgggtcccacccatattagtaggacccacccatccctcttttcacttccatctctccctcccatgcatgcaagcatgtgaggggaccactcacagtttcccttttggcatgaggaaaccgcaccctggctaggggatgcaatccttagcaaagatatgggtcccgccaccttttttcattcacatcagattttgaactagctggcaaacgaggtaaccctccagctaggagtactgtgaagagccttataagtctccaaatgaaagttttgaccttaggaggaatgcattttgtagaccaagtttttagaaggatactgcgatgtacagagttaaagttggaagaatttgagtgagaattgctagaaacctgtttgtaggcacttttggaagtgcaaattcatgtggttgttggagtccagcaaagtctgtcttcattatcttgtgggacaatctatacctgtgttataatttgtgccatttcctgataaaaatttgattcagcttgtttaggtcccaatcttttctgtcattccaaagacgaggcttactgacgaacaccaagctaaccaacagtagcttaaagcattgtgacagtgtgagtggtacccgtcaaatgtcatccatgtcgcttcactttgcaactactcctgcggcgatatatatggtgctttctcagcattatcgctcagtacctaaacattcattcatcatcgggcgaacacagcaaagcgccgagttactgtgctcttccatcagaggacggaaacagcaaggcaagcaaaatcagttgtgtgcccttagccgtcagagtccaccggattcgtcggatccatccatccataaattcgagttaacggaaagtcctagccatcgcctagtcaatatcttttttttttaatggaatcgcctggtcaatatcaatctctcgtcaaaaacaaacgaatttgaatctaattcagtacaattcacacaggaaagaaagattcaattagaaaatggcgatccgatcgcctgccattttccatattctttatcccaaacatacagggcatatgcagttgtcttcttttattagaccaagaagttgtaagctttggagaaaaaaataactcctttccctctctccccttcctctccggccgggcagagcagagtagtagtggaaagtggagtggtagactgcgctgcgtgtgcgtgctcaccggccgcggccggagatggagaagctggacaggtacctgcaggagaacttcgatgtgccggccaagaacccgtccgaggaggcgcagcggcgatggcggcaagccgtcggcaccatcgtcaagaatcgccgccgccgcttccgctgggtgcccgacctcgagcgccgctccttggacaaggccaaggtccgctccacccaggtactaactaaccacgaactagccgctctaatccattcccctcacatcgttctccatttcaagatatcacggtttttctgtttgatcccctctctctttctaccgcatctcatcgtgctcgtgggtcgatttgcctagcaagaacaacatttagctaacaaaaaagaactgcttttggtttgtgtgttcattgttcagtattcagtaaccgttgtatgtcctgtcttttgccatcagatcgtgacacataatacagttctcctcttgtttagatcgctctacatgtttcgtcccgttcatttgctcatcggtgccaaacaattaagacaaaaaatcaggttatttatgctattgctccatcgtactgggcacagacgcacagtaggtccgtatcatgttgacatgtataaaagatcaattactttcaaggaaacttccgcgaagcaaccttacaaaaaagtacgaaataaatggtgttagaaaaggacaaatatatcaccctatcacatcgattctgttatgtaggagtatgtatagttatctccacctgtcagtctttgcaaatatgagatcattgtttaaagtccctaatttggagtactattgatttcaacttttcttgtcttcatgggaaaagaataaagaactctatgtttgtttggctgggagaatccaattatggccttgtttggatcc

SEQ ID NO: 15636 - DNA, 4194 bp, Oryza sativa
cgcaaaatagcctaggggttatggaatgggttttgtcagtaatctacgtttaatactcttaaatagcaagattccggagggctatttaatagccctccggatccaaacagggcctatgtcttcagagttgatactcttaattcagggattaattctacattactatgtgctgtatattttagtgatgtatacgctatgtgctctaggtttggtggatagggtgggcagattcctatttctgacttctgagccaccctatcagatactccctcggtcccattttgagtgtaaccattagtttctgtgcccaactttgatcgtccgtcttatttgaaattttttataattagtatttttgttgttatgagatgataaaacatgaatagtattttatgcgtgacttatgtttttaaattttttttaaaattttttcaaataagacggacgatcaaagttgagcacggaaaagcatggttgcatttaaaatgggacagagggagtattatttttatcacacaaattcacaaaagtccccctattttacggtttattcatatgaaccatctaactccagtttcactagggaccttcttgttttataaattcttctagatgattgagtgcttaacattttgttctctcatatgccgatagttttgattggaatgtcattactttatgcttaacaagtcaactaatttaattttaacaatcatgctgggaaaattcgcaaacatcagcttcggtatactggttggtctgccttttcagcctagaaaagtagtgatggtatttatatattaaaataaaatgacccagtatgatgcaggtatagtggcaatgtgacttcacatgtaataggagaaaaagaaactgcaataaagtagccgactatcatgtttgcaacacaagcataaaaccatatttcttgtaagaacaatcaaatgtggagatcttgcactactatattttgaatattgtgcacgactgaagttatttatattgttgccatccgaagtgttggattaattaaattcattttcatggactaaacaacagtattgctattccttatcagttacctttttgtaattttgtttctgttaatggaaacaagagaaggctggctctctttctcaaaaaggaaaaaaaatctctaccagtttccacattatacagtatgtgattttatcacacagctacaggaaaataattataacatatatataaccagtaaaagcgtttccattttttgtgtttgttgtcccaggaaaagattcgggttgccctctatgtgcaacaggctgcactcatttttagtgatggtatgggataccttttttacgttattgttcattttgttgcattatcaactctctgtaacttgatttaatcttaatgttttaaacaaaaggtgccaaaaagaaagaatacaaactaacaggggatattattaaagctggatatgccatcaatccagatgagctagcattgatcacaagcaagcatgattcaaaagctttaaagatgcatggtggggtagatgggatatctataaaagttcgttcatcatttgatcatggcatatatgctagtgagttagatacaagacaaaacatatatggcgtcaaccgttatgcagaaaagccttcaagaagtttctggatgtttgtttgggatgcattgcaggacatgacccttataattcttatggtatgtgcattgctatctgttgcagttggtttggcaacagaaggttggccaaagggcatgtatgatggcttgggtataatactcagcattttcttagttgttatggttactgctgttagtgattataagcagtcacttcagtttaaggagctagacaatgaaaagaaaaagatatttatccatgtaaccagagatgggcgtcgacaaaagatctctatatatgacttggtagttggtgatatagttcatctgtcaattggagatcaagtacctgctgatggactgtatatacatgggtactcccttttgattgatgagtccagcttatctggtgagagtgacccagtgtatgtttctcaagacaaaccattcatcttggcaggaactaaagtgcaagatggatctgctaagatgatagtaactgctgtcggtatgcgcactgaatggggaaaattgatgagcacattgagtgagggaggagaggatgagacaccactgcaggttaagctaaatggagttgcgaccattataggaaagattggactggtatttgccatattaacatttttagttctgctggttagatttctcattgacaaaggcatgacggttggtttgctcaaatggtattctactgatgcattgactatagtaaactactttgcaacagcagtaaccattatagttgttgctgtacctgaaggattgcccttggctgttactttgagtcttgcatttgcaatgaaaaagttaatgaatgataaagcacttgttagacatctttcagcgtgtgaaacaatgggatctgctggtaccatctgcacggacaaaacaggaactttgactactaaccatatggttgttgacaaaatatggatatctgaggtttcaaagtcagttaccagtaacaccatttcaggagaacttaattctgtggtttcttctagcacattgagtctgcttttgcagggaatttttgagaatactagcgctgaggtggtcaaggaaaaggatggcaagcaaactgtcttaggaactccaacagaaagagcaatattagaatttggcttgggcttgaaaggagatcatgatgctgagtatagggcctgcaccaaggttaaggttgagcctttcaattcagtcaagaagaagatggcagtgctgatttcattacccaatggcacgtccagatggttttgcaaaggtgcatcagaaattattttgcagatgtgcgacatgatggttgatggcgatggaaatgctattcccttatcggaagctcagagaaagaacatcttagatactatcaactcatttgcttcagacgctttaaggacgctgtgcctggcatataaggaagtggatgatgatattgatgacaatgcagatagtccaacaagtggttttactctaatagccattttcggtatcaaggatcctgtgcgccctggagttaaggatgctgttaagacctgtatgtctgctggtatcacagtaagaatggtaactggtgataatataaatacagctaaagctatagctaaagagtgtggaatattgactgaagatggtgtagcaatagaaggaccagaattccatagcaagagcacagaagagatgagggacctgatactaaatattcaggttcataatgttttcctcagtctatgcgtttactaaaatcttgaccaaactttatatctggaaatattttgcaggtcatggcccgttctttaccattggataagcatacactcgtgacaaacttgcgaggtatgtttgatgaggtggtttctgtgacaggtgatggtacaaatgatgctcctgcattacacgaagcagatattgggcttgctatgggcattgcaggaacagaggtactgtttcctatgcagttcaaaacttatgaacgtagcatcaatagacattaaaaaagtcagatatttaggacgaatatgtcagtattcactcttactgaattaagttgatcctgataatccatttttcatcttctgaaatggagtaattttgtcttgtatttgtgcaggttgccaaggagagtgcagatgtcatagtacttgacgataatttcacaactataataaatgttgcaagatggggtcgtgcagtttatattaacatccaaaagtttgtgcagtttcagttgactgtcaatattgttgctttagtcatcaattttgtctcagcatgcatcataggtgagggcaacattatagtattcatctgatgctatgtatttccattaagtggttctccatgatctccaagacagtactaatgttttgctcttccgtcacagggagcgctcctctcactgctgtgcagctgttgtgggttaatatgatcatggatacaattggagccttagcactagcaacagagccttcaaatgatgaaatgatgaagagccccttgtccaaaaagggaaagtttaattaccaagttcatgtggagaaatat

SEQ ID NO: 15637 - DNA, 11914 bp, Oryza sativa
catgcatcataggtgagggcaacattatagtattcatctgatgctatgtatttccattaagtggttctccatgatctccaagacagtactaatgttttgctcttccgtcacagggagcgctcctctcactgctgtgcagctgttgtgggttaatatgatcatggatacattgggagctttagcactagcaacagagcctccaaatgatgaaatgatgaagaggccacctgtccgaaaaggggaaagtttcattaccaagttcatgtggagaaatatcatggggcaaagtttatatcagctatttgtacttggagctctcatgtttggtggggaaaggcttctgaacatcaagggtgcagattccaaatccatcataaatacactgatattcaactccttcgtgttttgtcaggttagtgcattatggaacactgtaaccgtgctagtatttccacaaaccactcacataaaatgatgtttcttttttggccttaagacctatggtgaaactgaggtctttccgaagtctgccacaatatgtgtttggttggtcacagcttatatttccaatatcatgcttaagaatcctgaactgatagagttatcttttttttttaaaaaaaatcatgatttggcaaagggaatttcttgttctaatgatgatgttctggcaaatgttgtaccaggtattcaatgaaataaacagcagagaaatgcagaagatcaatgttttccgtggcatcatcagcaattggatcttcattgcagtcatagcagcaaccgtagcatttcaagtggtgatcatagagtttcttggcactttcgccagtactgttccactcaactggcaacattggctgctcagcgtcggccttggctccatcagtctgattgttggtgtcatcttgaagtgtataccagttggttcaggtgaaacctctgcaactccaaatggatacaggccacttgccaatggccctgatgacatatagctgaagagtaatcactaataagggaaagtagaatccagggtgcaatacagcatccagctgcccagctcagttcagttgttttggaatacactaaccaaccactgattttgttcaaattttgccaaactcctgtcatgtaattgttactacatcacacgttactgatgtgcacccttaccactctgctttcaacttcagacttcattgtatcagtgaattcatattatcattatgacggttggtggtttggattcactctgaaataatcttttgatgccatatatgccatttgaaacagatatatattagcacccttaaggtcctgaacaggagttaaattcataaaacagagtaaataaagaactagaagtatcattcatgaacagaacagaacaatctcctaagatctgtctacaaatcagtaactacattgacaaagaatcatcagatatatgttcagttcttccatcgtctcaaagaaaaaataaataaatgaataatcatcgactactctaccccagcgattcaattcattcacatagtatgtggccgtggctgtctccaccctcgttgggattgggattgggatcaccggcgccgtcgaagtcgacgaacaaatcgttgaagaaatcattcatctccacctcacctcctacttgtggttcttgtctcacctcctcattgaagccaacaccatagccgttcatcggtgagaacaaggtcatctccccgttggtgttctgcattgccaatggcatctgtccctgcgtcccgatgccaccgtggccgttgccgcagagaaccagctccccgtctgcgttgatgccgatgccgtagtcgccgccgtcgtaagcatctggcttgatggcatcaacgtcgccgtagtagtaggcggcggcattggccgtgtcgtccgccgtgtgtgtcgtcgtcgagcagcagtagtccatcgaggcggtcgcttgagacgtctcgccgccgccggagtacgagcatccgacgtcgggctgtggcgtctccggcgccggcgcgtcgtagccggtggcttccgcctctcggagcctcttgggcccgggaaccacgttggtttcttggcgttcctcctcgtcggccgtcgcctccttggccctcggcgagaggtagaccttgcagatgaccatgatgccctcgtcggtgatcgccgccggcaggttgctggcgatctcctccatgagccagttcgtcttcttgttcccgggggcgcggtactcgaaagcctggcggtcgccgtagccctcgatgacgcggcggcgctgcgagttgtgccacgtgccgccgccctcgacgcagcggttgagccggccggcggtgccggcgccgcccctgccgcccttccacttggcgacggtgaggaagtaccacgacttgccgtcgtggccgtacgccctatgcgcctccgtcagcgtcgccgggtcggagccgtagacgtcggcttcccggacgatgtcccggagctcctcgatcggccggccggtgatccagtggttaaggtagtcgcggatgagctgctccggcttcggcacgaagaagtatcccaagggcaccgtcacgtcggggcccttctgcttcttgtcatcttcttccgccattgatggtgatcctcgtcgtgcgtttcaaaactaggttttggcgcgggcgctcgatcgatccgtgtcgctgtaaaagaaaagcatgcgtgggtgttgaatctattggtccccgatctcgttggttcgagttcgaatcggtgaagaatctcgagtccgagaaggcaagaaccctttcccgtctcctctcgcgttcgctaggggtggagcggcatctagggtttgtgcgccggccgccgccctccccgctcggcgccggcgccgccccttctcctccccgcccgacgccgccccttctcctccccgtccgacgccggcgccgctctgcttgtccccggccggcgccgagcgtgctcctccccgcccgacaccggcgccgctctgctcctccccgaccggcgccgacttgctcctcccagcccggagcccgacgccggcaccactcatccaggtacatgtttgttgtgttcgttggttgcagaaaagtaatcagattaggaccttgaacacagcagcaaaaacccagctaatgctttagggtgacaccttggttgctgtcagttgttagcatcataatctttttttcttgcaaggtttggggtttggttggttgtccccatcagaaaaatttccatactgtcagccaatgggcacccaacacattccccaaatggagttggtttgtcttcttaaatgtaaaagtggggtaattatgtatttattcatgatctactagtaatgcaaaatggaatataattctgtagttgtgtccttcaaaagaagcaatcttgtaaaaaagttctgtacataatggttgacagattagaaatggggacctcactgaccatactagtatcagtacactggtaatagacagtttctgcttaattagatatgcagatgcagatgattcaacagaatgatacactcatctgcattcagcaagacaataatcaattacatgatcttgtttatcaggacaagaattttgcacatcttcagtgtacaacattatattcagttaatgtacatatactattattctcatcatcgcatttcattttaaattctaattgaccgcccttgccgcccgacgccgccccggctccgacgacggcgtccgcagcccgcccgacgatggcttgacaggtgctccgacgacggacgatgagagtgaagatgcagagaatgatgataccatgaatactatttgtactaggatagctgatgcattgagtagtgcatgaggaggatagttattttgagatatggcatcattgtatgaaccatttatcttttgctctgtttatgtggaccatatcactttgatatatgaaaaactaatatattttgatgaaaaactttgatggatgaaaaagttataaatttttttctttccaattagccttttaaatacgaaatattgaacggattaggtttttacgagtaattagcatataaacagtctcataggcctttaggggcattacaggtatttcttctacaacctacagttttgcaactgctctaaccaaacgggtttctacttttcccacaactgatttcccacagctgcttttccacagcccacagtagcttttccaaaagccacagctcaaccaaacacaccctaagctgtgttcttcgttccatttcgtttagtactgcactgtttagtgacatggagaatggcgggcacaaatacactgctgcatccatggattctcgctaggccaggtagtgctagcgtcgtaacccaagttttcgggggcaaggtggtgtgtgggtgttaacgaccaaatttgataaggccatgggccggattcaaaaccagagtcaaagcaaatttggaggaattctatttagggaaatctatacggagctaccccggaggtcgccttcactcctagaccgagtgactgctccagcacaccaccacctttttttttttacaaatttagaaaatgcagttatttgaccacatcttcatatatctaccgggtaaaaatgagcttaacattaatatattcatatattggcagtttatttggccacatcttcagacatctattggacaaaaaatacagtttttgcagtttatggcacattaacgcgccccaccccaaaaccctagtagaaaaaaccggaccgggtcaacggttcaaccggaaaaaaccagaaccagaggtctccacacggttcggttgcgcgttcaaagaccggacatgcattcgacccggattgaaccggctgaaccggccggttttgcactaaaccggatgttaaaccggcccggtctggccacacgcctgtttttttcctcaaaattcgcagaaaaggctggcgcggcatgggattcgaacgtgggtctgtgcgatgagagcacttggctctagccatccggtcattcgccactttgttatacaggaaatatacaacttttatatatctattgaaccgtggttcaaccggcggttttccggtcggaccatcggaccggcgaaccgagaggttgttcggtcctctccggtccggttttttacactatgccccaaaccaacatatgccgggtaaaaatgagctcaagatagacatgtcctaactagcactttatttgtcggaacttcttcccaagagagtaccaattctttgcgtggctactcggaaaagatgaattgaaatcaagtgcagtcctaactttgctgcaagtaatttcaaccatccattttttttcagcaaatagttgagatctgatactacagtctacaattctattattgttacagtacctctatagttttctccgcgtgtgaatagtactacatataatttggacccttggatttacatcaaacagtccatcagatccaaatccacaaaggaaaggctaccaacaacgcaaaatctattcaaaaagaacatttgccaactctccaatatgtgagatatgcaaccaagacctggaagacgctactcatttttgtttccgttgccctgttgcgatggaattctgcactgcaattaaagttaaccccaaaatcacccggactgaaagactacacatcagctacaactgataattcaagcgatatcaaagcacttcgaaactttcatttcactcggcttcgtcctctctctgagtcatttcacaaatgcattgaatttgtcggctgatcgatatgtgatgtctatcggaagagtcatgacatcattttcggagctatatatcctcacatacatgagcgttgtaacttgtaacatgcccgatcagggaagcacttgtatcatttcaaatccaaacaataaactcagttaaaaacaagtcgatgaacacacgttacagaaccgtttcaacacaatgggcatggtctcctgaaaggtcgactgtgcagcacactgccattttatgcaatgagaaaagggagtacagtcagcatgaaagcctcgtaagtaaaagtcgcagagcccgagaaggctgtgtctttttccttgaacttctcagtcagaccctgtaaaattgttacaaatgaatgttaaaagagtgaaaacagaacattgtgctaggacttaacagcgcctgtgaaggcattagtgtattaccttaactgtgaggcagcatctgcaaaggcaaacaaaatagtgttaggactgttatataggccgaattggaatgatagaagatatcaagattttaaactatatccaatatttaactttgaggttaggacttgcttggctgtggcttataataagccatgacacgtgaccaaagcaacaaaagacttttatatttctacacttaagtggtttaaaatccaaggctgaaaaatagaacgatgaaaaaacaactagatcaattcaaagttttgcatcagaaaacagaagtagaaagactagttgatgcatacattatctttttagttattgcctcaaaatgtgcaagaaacaatttaacaattatatttgataggaaatatcatctttaaccagacatttgatcccaaagactacttttgtgtcaacaaatgtccaaacagaaaatgttaaaaataaggctgaaacgaatttgaaccaatcctattattagctgaccatataaacatatgctaaccaagttttggattttttttagataatgattggatgattggataagctaatagcttgaacaattactaagaaagcaatctgcaaaacataattggagtcatcttactcaatgaagttatcatattcaatggctttgttcttgcccccagtcttgtcaaactttgacacaagcaagtctagcacagttggagaaactgaatatcccagactgagaagagcatcacgcaattctgttgcatcaattttaccacttcggtcacgatcaaacctctcgaaaatggactgcacagtacaagcagaaaatgcacgtattcagtttcaacagtaacttcattagttccaccgcacagaagaaaaggaaagctgaagctgtagcatctcaccctccaattctgaagactgtaaaacacagaggtaaattccttgggacctgaaaggatcaaagacacatattcaatgtggtttacataaaaacgaataatataagaaatgcttaagttcaaagtacagtatctagcaatccagtatttgttaaatcaggtgcatttcacaggttagaactaaaagtccaaaattccatatacaagctcactagctgatagcctgaaacatagcactggtttcagagtatacactgctcaagcaattcaaagctcatgattcaatctctagttctctacacagaaaacagatgccaaaagaataggacaaatggcattgattaaagttgcaaatatctagttttcagtttagcagtaatttgaaattgtaaatagaactgacaaacaaaagttagtatacaaggtaacatgtataaactgccaaagtagcatgcccttttactggagtaaacccaaaattctttctacatcacaagccgggagaacttacaagttcattgtgcaaataaaccagtatatgtgtctatgctgtaccaaagtagaccacaacaaaatgagctaggattttccacaattctattgaatcctatcccacaaagaaattgatgcaatttaagaaacttaattaaaagaacccgcatcccaacacctaaaagtaaactccagcttttaacaagttgccactatatcgttgcccccaccacgttcccccgtcttcctcccaaacgacaagtcctggccgtatgatgcaaacactgactacagccctggctggaagactccatctccgcatcggaagccaaaagtcgcatactggcatcgcaaataccgtgggaagcttgataatcccgcggagagccacgtgccaatcgcgtgccactcgtttgactacacatcgcccaaagcacaaccaccattacgtatgccgctgaccaggacaacgcgcacgatagcaaccatggagcgatcagactaacgcacaccatccccaaggccagaactattcaattcgcgggtgagaggatgaaacgatgaacttaccaatcttgcggacgttggtgttggtgaagaggtacatgaggaggtggacggtgcggaggctgaagctctggctgtacccggacagcgcggactgcagctccttgtcgtcgatcatcccgctgccgtcgcggtccgccgcctggaagcacgccaccacgttgggatccgtcccgggcgggaacgccgacggcaccagcgacgcgaacgggctgccgtacccgccgggcgccccgtagggcgccgacgagggcggcggggccccgtacggcgcgccgtacggctggctggagggcggggcgccgtaccgcctccgctgccgtagggctgggtggatggcggggcaccgtagccgcctccgccgccgtagtaaggggcggaagaggaggaggtcttaccttccttgggaggcttcgccccgtacgccggggcggagggggcgggggaggacccgtacggcggtggcggggcgccgtagccgccggcgccgccgtaggggtagccggagccgggatttggcgggtagccggccattggagagagggggtttaggagagagcggaggttgcgatgcgcagctgcagcttggggaaatttggggattgtcaaagtcaagctgtctgcgtcctctgatattttgtgtgtttcgaaattcaaaatggaagaaagcagtggagtacggtacgggttcatatattgaagaggatgatgacgtgggaagtagatgcggtagttgcaggcttgaagaggtgaggacacacggtgtacgcgtgagttgtgaaacgtcgatcgataccttgtatttgaggacaccgggacatatgtcacgtaccgttgggtcgaaggtggtagaagaaagggcgtaatgcgcgtgggcagcgacggcacggccgcgcggccgccggcgaattgagtgtgtggcttaccgttgcgctgcatgtttcattgttcgttcttcaaccaaaggataagcacgaagcatcggggacgcgtttggtcgactggcacacgggaatacgggatgatccaatgaacgcatgcttcatgcttggaagtggtccatccctcagttagaccgtcggcccaaagaaattcgaggacatgccacttgatttgtctgcctctaaattttcgtcacccaatccacgtgcttttgaaatgtgaatattttgatttcgtactactttcaccggaggagggcaagaggcggcggcgacaacaacggcaatgtgcggagcttgggacctgggagggagggggagggggggcaagcctgtaagagaggttgaggtgatcggcgagcttgttcaagctcaagctcactcggcatctatgcaaaggaggtggccaacgaccttcatcaaagggtaggcctagctttgccgctggcacaccgagctcgcccttgcccctagccccccctccctccccttcttcgggcttcgcgtgggtctccagcacgcacgcacggacctaggaccattgctatcgtcagtgtcctccaccggcttcttccccgttgccagattccacagccgctacctagggacctcctccacctcgtcttccttcgcttcaccaagcttcgcacaatgaggcgttgccgccttcgcttcactcggtagctgactgtcgcgttatcgttgatgttgctgtgagggatactgtcacgcccagaaatttagcctaaatttctagactattttgtgtattaaatctctgtccaggcatcagccagggtacacaaaacgacaaattaatatacagatccaaacgtaaataaagcgtaaatacttacagaagaggcacttagtcctcgcaccgaaacaaaagcagcagtagcggaaaaaaggcgatcctagcgaggcttcagctccactccacaggcaaaactcaactggggtctgagccttggtcctctaactccatcttcagctcagaagtagtacacttctgaaaatggggaaacaatagcaaggctgagtacaaccaccatactcagcaagccacaccaatgatgcagacgtgcaaggagaacataaggacggtttgtggctatttgcataaaggcagttgtaaagcattttattgagcaaaacagtaaaactattgagtaattaaggtaatattaaatctccattgatcaacgctacaccacgttgaacaagcccaaccaacccacctgaactacagtgcattgagtcgatttattaagtgtgagactaatcacggtaaatctggtcgatcgcccataaccgcgggcacggctattcgaatagttttactctggccagaggtgcacaactgtacccacaagacacaatccaccggcatgtcaccgtgtcattatgtgcccatgatgaacacgtcaccacgtcgagtgattgtgacaagaccattcatataactctcccctaaccatccacaccacgttaaggtttcacccacactcctcgcaaggcagcgggcagtcccctcgtgcgccgcggtgaatccgacagctggacaaccggacaccccggccgacccaactccatcacgcccacccttgccactggtgcctaggaaagggtcgagctatacttcagatcaagcagttacccactcccgcttgtggtaagcactgtaagtcttccagggtttcccgtgaaccagtccttaattgccatgggtgcgactcgcaaaaccatgcacccacagcccaccattcagtcgcattttagttggataattacgaccatgaaacatggccagatgtcttgagcacgcagctcgtcatgatactaaaaggtctaatactataattatcccatcaactgagctagtggtaattaagcatggctaagcatatagttctagctaggtcaacataagtaataccagctagtcggtttatcactcaaggtcgacaaaggacagatatcaagtaaacatggcacaagtgagcagataggtaatacccggatcccatgtaattagcaagacatgcatgtttatttgtaaacggtaaaacatttataaattgggatcaacatgctcaagaggaatgtgtgacttgccttgcttcttcaaaacaatctttcgaactcttttcctcgcgaccgcgatcttccgaaacgacggattctacacgctggcaagcaaaacgaggaaaaacactaataaaaaccaagaaaacagtacatgaaaagtaaacaaacatgtagagctcaattttagatgaattttgcaagttgaatggcccaatttggagttcgaatgaattatatatgaattttagaagttgttgagtcattaaatgaatttctataactatatccgaattattgcgcaattattaattatttcccagaggaaaggcctgctgctgacgtcatcaaaggggccggcgccgacaggcgggtcccacgagtcagcgacacacaaggggttggcgcacagtggtcacggtccaccgcggccggggcggcaccgtggaccaggaccaccacgggtccacgggcggcggcccagatcggcaaaaagggagggggtggctcgccggccaacccgacaaggcggcggcggcacaaggttggacaactgagaggcggtggcgcacgagagggaacggtggctcggtgcggcaaggggaggcggcagccggctgcccagcattgccggtagcgacgctggcgcggagcgcagcggcgatgacccggccggacggccaccggcggcggcggcgcgtctcgagcaggcccgggaa

SEQ ID NO: 15638 - DNA, 4586 bp, Oryza sativa
tctggagagtatattagggcacagagaatattataaaatatttccggccaatgatttttaaaggaaaattttaatttcccctataattcacttaattaaattgctttaacttttatttaatttctagaaaatgtattatttaatgatttttaaccccgaacaaaaatcggggcattacagataccgcccgccgccaccaaggaccaccgcctcctaccctccttcgacgaaaatggcacgaaatcaaaagattagcacctccagtggcacttttgcaagggcacacagattaggtggcgaaaattcaaaggcatgcgaatgaggtggcataccctcaaatttctcctctggccacggtccctatatacatatggccttgatatgttcagtggcggagccatcggtcttgcaatatggcaatacctaaatacttgacctttagttcatttcctatccctaatctagagattgtagttagactgagtactcagtttgtgattttccatcttttcaaaataaaatagaagatggttatttgtgatattattggtagtttaccttgagaggatttagcaataaggactagttttaaactgccaatgatattattaaaaagctaaaatttagttcttttgaagaggactagtttacacattgattattatcgaccgtgaatattttatctcctttcctattgacactggttaggtcttacacacccaacctgaaatcccgctttgtcattgggtacgttgtgtcatctcacctccggatagttcatactgaggcccaagatttctgggtatgtttggattgatgccctaccaaaattttggtagtgccaaatcttggacaagttttggtactacgaaaattttggtagggtagagttgaaaatgtttatttggattgaagccaaaatttgcccataagagataagttcataggcaaagccaaatttatggcataggtagagttttagtagaaatgtttagtttgcaaccctactaaaattttggtagggcaaattttagtagggtaacaatccaaattggcccagagttaagtcagcccatcttaagcgatctacagggagggaggaaacagcagttagatggatggataatccgataggcgaccgaaccaacggcccaccggcttcacgtacccaaccaaacaagcaccgccttgcgccagccatccctgagagcacagagcactctaacaccactcggctatcttcgccggaggcccggagcggagcgagccaaagagcgaatggccaccgtggtgagggcatgcatgccgctgccacctgccgccgtcgcctcctcatccgccgctccctccacggacgcgcaggcgcagaggagtccctcctcctccagcgcgcgcgtgctcgtgctcggcggcaccggccgcgtcggcgggtccaccgccaccgcgctctccaagctccgccccgacctcaacatcctcatcgccggcaggaaccggttggtgccccctatatgctatgcctcctccgcaccgcactagtctgttacatactttcctcgcctgttttcatctgcagaatgaatttgcttcacttgtgttgcaatttcttacgtttgaacgaatgcaaacctcatctagccatttcgtagttcacttcaatagtgggaacagtttctttcttctgtcaatagcatcttggctggatgcctgcaatcttgtgcagttccatctgtacaatgagacgattatagtagtatgaccatttgtcgagtatcttttttttttttttggccagagagaaaggtgaatctttggcatctaaactcggggaggaatcggagtttgtccaagtagatattcgcgacaggaacatgttggaggaagtgctacagggttagtaatggagctacctgcttatgttgtacttttaagttgaaacaccgtatgatttcaaaaaattgttgcaaatattttgaaaagtcatccacaaatttcttctgatgtttgaccattctagtttttctttttttttcccagatgtggatttagttgttcatgctgctggacctttccaaagggagaatgagtgcactgtcctacaggcagcaatagcgaccaaggttagaaatgtgcaacgcctgatcatcaaatgcataagtttaataacacgttgaaatcagtgacatccttaacctttttttttttttacagacggcatatattgatgtttgtgatgatacagactattcgtggagagcaaagggtttccatgaacaagcaaaagattgcggtatcccagctattacaactgccggcatctatcctggagtgagcaatggtcttacttcgcatttctatcaaacatatcagtttactttgaaatttttcaagttacactgtccagatatcatcatgtgctctttcacaatgtccatcagtactcatggatagtatccattgctctttgaggcagtttacatatgtgtaaaatcaccaacttgattaatgccatgtattagtacataatagagagttagagacatgatctagcagtaaactatgaagacaatgttttgatctagctaggtaagcttcatatcttaattttttgagtgcttagaaatacactgttttcttcttttggaacagtgatggctgctgagcttgttcatgctgctagaagtgaaaatgctggtgaacctgaaagattaaggttaggagttatttatttcctgtaaaaattaaaggtcaaactagtcatgaagtatggaaagcgttgtcgtattcatcagaatctatgctagtatgttgctaaatcctttttctagattcttttattatactgcaggcactggtggtgctgggccaacaatattaacaactagttttctgcttcttgcggaggatgtaatcgcatataacaaaggtacttttcgataatttattagtgcacttataggatttctctatgaggaaaatctaagttttgttctcattacaaattcaggagaagaaataaagttgaagccctacagtggagctctcagcattgattttggcaaaggggttaggaagaaagatgtttacttactgtaggcactgaacattaattactttttgagatcttaccacaataaggaaaaaccactttggttagaattcaaaatggaagctaataaattttatattatgccactaatccaggaatttgcctgaggtgaagagtgcttataaggttttaggtgtgcctactgttagtgctcgcttcggtactgctccttttttctggaattggggaatgcaggccttcgcaaactttttacctgttgtatgtcttacttctcaaattatgcactatcaatttacttctttcagacacaaccggtgctattagtattctagtactagtaaactctactaaaaaaaatagaagttttaacttttaagcaaccaattgcttacattttattttattatttaattatgtagttggtgaaatcaactaatactattattactgttaaaccaacatggtttgcttgttttctgctgaaatcttaaaaatgggataatattaaactggtgatttggtgctaatgcggattacacctgactgcaacttgttcgtgttcaggaattcttgagggatagaaataaggttctaaaattggttggatttgttgatccttttgtccgagctatcgatggtattgctggagagcgtgtttccatgagagtaagtacctaaagctgtgttctggaggtgaggttgggaactcacttcatgcacccgcaaaattaattatttacttttttttttgaaaaaatgtattaatatgattttttaaagcaacttttgtatagaaattttttgcctgtgtgttttagaagtactagtttcttccaaggctccaagctatttccagagttaactgcatactctttcaagctgtggccagaataggtatttgaatgccagttttaaaatatttgttcagccaatttttcttcagttttttaaaataatttactttctaaactttgatttgatcaattataagattgattttatcacttcttcaaaaagggagcgaagtatggaccatgtaactctcaatagccatcgatttccacaaaatattggtacactgagactattgtttttactagttactggccaagatttgtttccttggtccaggttagcagcctagaagcatactacttctagtatttcctcaagccatacctggagtaagagtaaattaattatactcaaactttgtccaaagttgtatatgtagctactgatcactaccttttgatcaaatttatttcatttatatgcaggtagacttagattgttcaaatggaaagaatactattggattattttctcatagaaagctatctgtgtaagtacgcacttctgcacaagcagttgagcattctcaaggtccattacctaattgatatttaccatattagtcatcaaatatcaagacttttttaaaaaaataactatcacattttttgccctagatcgcaggaagcttcacataagtgctctctaaatgagaccccag

SEQ ID NO: 15639 - DNA, 3865 bp, Oryza sativa
  unsure (1)..(3865): unsure at all n locations
ccttatatttagggacggtgggtgtcataggtagtgggccgaggggtcgaggccctagggataaggatagagttggttggataggattagactgggtcctccctccatctatataaggatggtttgtatcatcattctaattaagcaatgaatcaagattagtctctcccaacctaagtccccctctcatccctagcagccgtcgccgcccggctatcctctcggcggtgtttaccccctatgaatcctaacccataacagtgggagtattgttttaattttctaaaatcaccacttttattcataatgcagccagagggagtagcaattgaatcaaggaaggtgcttcttgagcgggcgtctcaaggaacaacgatcttcgtgatgaacaagtgatgtcctctctgctcaatttcaacacccattagtaagctaataatcaataatgagtatgctagctgacacaataccgtaaattttgattgacaggccttcctggatgatagagactgatccaaaggaagttggcctgggaatatatgtgtaggggaatagtatgtttccctcactatatgtctatattgaagtttacagctcctaattataattttgacggtgaaatcttagcacttactacaaagttcttgggtatgagtaagagcaagagcgacaaataggacagggcaatgaacaagtaaattcttatccattttcaacaaggcacctctgtctctttgttaatcgcactgttctgaatgtggctgtaaataatagaacgaatttgtaatgctctaagagtatggggtggatgaatgaaatgaattggagcacaatacaaccaaacgagggttacagttttgatgaagtatcctagtgcctgttattgtcttagcagaaatgtgtggtgagtttatgaggtctctaaagaattcgttacattccaagagcattaatgcatccaccgaaatgaattatccgtagcaattttggtcatcgtgtttagcatcgacttgtgcagcctgtgaattgaagtagaagggcatatatatatatatatatatatttctctgttctgctcttgcctctgtctacaaaattccacgtattctttaaaagcaacggaagctaaataacatttgtgggtgggtgtggggggtaaaacttatctcgttctatacagattgctgagactaagatatcatatatacctatgtaagctacgaagagctgatgatagttcgttagcattttatcattacctactttacatttcaactctgacataattcgcatgttcaacaatggcgatcctcgtactgcagctcttgttcgactatgatatgcattctacatcaccattgatgttgcaggaaacagcctgtccagtagggtataaacccctccacccagtagaaatgcaccactaccaagcaaatggcaaatgttagcgcaaggcgttaatccaaaaaaaataaagtataaaaggcagattttttaaagaaggaatggcttatatttttttagagatccttcctttttttaaaaaagaaagaacacgaatgtttctgaggaattggaactgtgcaaagcacatgacagaattgtggcaagaagtttagaacaatatcttacaaaagaatattaaatggatgataaggtaaatttgatgtgctatattctctgaaagaagcatgcccaacaaatgtgatttcaagctctttgaaccaagacagtgaaattgtagcgaatgctatcaattaacaaatatggattttcagtgtttcctttgtaaaaggtagtaaaaaaattattactattcatacagataattaattgcaacgtgcaggtcttttgcaatcaaattacaaaccaggaacctctcaagatccagaaagagctaaggcacatacctgattgggtttatccatgcagaatacctcctgaaggaaagcaaactctacagaaagcaaataatttatcaggcactaaacttaaaatgaacaggtgttgttgttctaggatttgtgctgttaaactgttagtcaagtctaagtgagatttaaagttccatatttgatggaactatcttatctatacttaaccagatgtgtatatcagaaggcatttatacctgcagtgctccagcaaaagaagctgcaatgagaagaggtgcaacatagccagttgtataagtcaataacaaacttcccccaacaatcggatcctgacagaaaatgtattgtaatcagcatgtcagaaaattaataaattaggcgaacataaacttcttgccaacaattatgacagattgctaagtcaagtgtaacatatattagaaacaaagaaatcaaaattactgcatatcgtacggtatgtgatttactaactttagtaattaaagacactatggtaaaatttatgacagttttactgttttgaaatttaagaaaaagtaataaaatattaatgtaacttatgaatgttcctgttatgcatactcttgaagtggcaacatatcccagaagggtagcaagaacaggtgtactgcaaggtgatgctgctaatgcaaacgtaagtccggcaaggtatgcttgtacacctatagggaaacagcaagatatcatttaccgtaactgaaataaacataatgaggcatatggtactttgatacaaaatagaaaattatgtcaaagcattactggaagggaggttagctgcagcagctcgagggtcataatcgctgaaaaatgagggaagttgtagctcaattacctgtaaatacaagataaccagcatagagaacagtttaaggcagtgagctaatatctactataacaggagtgatacacatttcattgaaataaattaccatcgcggcaaaggatttacaattatttataaaaggaaaaccatcaaatcaactgatacttgatttgaattgtggcaacaagttagcttgaaaaattaattggcatgctccgctttatgagttttcacattggatcatgaatttacctcaagaaggttcaatcccatgataactgctaaccctgaagcagccactggaagtccttgtcctacctgtccataggcctttccagcaaaagaagcagcaacaccaaggatggctaaggttgttgccagtcctaatgaaaaagcaactgaatttccaacaacctaatagatagaatggaaacatatcaatttacatcaagaataacatggatgaagtttttttcttctacatggtgaatggatgttatggcatacgaggttttgggtatacatgctctatttaatttctataagttattttataaataatagaatatacctcagatcgatctttgcccgagccaaaagcacctgaaagattttaaagaatatgtcatcagatcagtgccatcaattgtaactgatcctgggcaacaaaaaaaaagcatctcaaaaggcaatcgctatacttgcctatatatcctagagtcaatggtagaacactgagtgtacaaggagacaaactagttacaagtccagcaccgaaaattacagccaagctggagaatagagaaacatgtcagaaaaaaatatggacatgaaacataaaatataatctgagaaagtaagtaaacagattctgtccataggcaattgaccgcaggggaaaaaaatgcttacctagtgaaactaagagcagagagctgatcctgaacagcctcgttggcttgctgacccgctgaataaagcaaatttccaaaccaatctccaatgctaaggtcagccaaagcaagtccagatgaccctaactgatcatannnnnnnnnnnnnnnnnnnnnnnnnnnnnnnnnnnnnnnnnnnnnnnnnnnnn
